United States Patent 7,868,149 (PLANT GENOME SEQUENCE AND USES THEREOF) - sequence listing, part 100

SEQ ID NO: 53366 - DNA, 17848 bp, Oryza sativa
ttaggatttgtgatgtatttgatctgtgtgtaggatttgtgatgtatttgatctgtgtgtataattaacttaatatttgggatgttgatttggagatatgcatcccatttgattcgggagaaaatacagggattaacactagccattagcaaatcaacaataaaataaaataaaaaagatctcgaggtctttagtcccggttggtaccaaccgggactaaagattccccctctttactcccggttgatggtgttaccaaccaggactaaagatcgatctttagtcccggttatttgaactgggactaaagatagcgatctttaatcccgaattcgtagtcccggttggaaaaccaggactacaaagggttctaaaccgggagtaaaaagcatttttccaccagtgactgttaattgcttgcggagcagtcttgagatcaaggccgtagtgcaaaatgttatgaattctggctgcggtattattagcagtcgtctacttgatgctgtaagctagcttcaagtgaaattggaggtcaatggaatgaaatactctgagatgcagttctgttcgtacaaaactgagggtaaccgaaggtttttgccttctttaaaagttctgttttggatgcttcatgtcacttggacaatatgctggcatagacggtatgtacgattcattgaatataatataacatgattcttggtttttcggatatttcatgtaataatgactcatggatccattaattcttgctatatagctggtacccattactaacaaatattgctataaagcagctctctggtgcagccacatcatcggtatgttgtagccgtggatcgttggtcttgttctgatctgagccatgtgatagcatacgccatctcctgagtcacagatcaattgagcagcctatgtttagcggctaagccaaagttaggaggatgtatggacgtacgacccatccaataatcctcacggtcgcatggcccccttcatccaagtcttgctcttaagacatctaagagcaagttctacataattgaatatcttgactgcaatgggggttacatatttgaaactgtttatgtcattttgaaagtatcaaaatatttcagtagttttcatttgatatcgatatctattgctacgtacaacctgttttttgctacttactacagttgcatatatatcgcagcttgcttgtacggtttcaatatgtaatactcctccctccgtttcacgatgtaagtcattctagcatttcccacatttatattgatgttaataaatctatatgaatgtaagaaatgctaaaatgacttacattgtaaaacggaggaagtaatatctatctcagatctaaaatatagatgtaataccctgcaacaaaatatagatatgataattaatattatgatttttggaaagcacttaatttcctatttagtcattatttgagttagaaatctatgtattaagtcatctatgaggtcctcgaaaaaaaagtcatctataaagcccgcagcaacacagcggggtatctgctagttgggtctggtgtgaatgccacgttttgaacgtgatgctaaatggattggtgttgcaaggctgacttggcagggggctgacttagcagggttgtggggggcgttggggacttgcggtgtattgacctctattttggtcagagcacaagggacgtggtctatgtgacttttttttgtaccgtatgtgcaatcgtaaggacgcaggaaaaagaaaagtctagaggtagctaagtcattttgctcgtgcagattatggtttatcacgggaacgctttgcaagctcttaaatttaaattgtctgacaattatagtatagtaaatgcaataactaaattattttgatcatttttttatacatattcagtttctaaatatacttattttgtattcagtttctagacttattttgtcaatatacttttcgtagatttgtataagcatagtgcttaatttttattattctattaaaagtcaattaattttactatgtggaaaattttgtatttgggttgagatttgagaaggtgaagaaaaaaacaaatccaaattaggggtgcaaattcaatgagcagcatatagatcaaatgcaagattataatgtaggcaaattttgctacaggatatcgcaacttcgtggtattagctgtgggacaccgcacaaagtagcttttggggaaagacagtctcaaaatgtggtcatttgccaatgcacaccgcagacattaaaatattaatttctcgttcaataggagagataaacggtgtaaaaggtcaaaaatgctcctaggcccacttgtcatattgttttcccacacctaactcccggccatatccttcgatcaccgccagcgaccaccccgacaccgacgtcggcaacggcgcgaccgcaccaccattactacttgttctccagcaagcagctcaactcgttcggcgccacggccgtgcttgccttctccaccaccgtgccgctccttgcgctctacatcctcgacagcctccgcttaggcgacacggtgggtgtcaccacggcgtccccgcacgcgttcctcctcgccgcgcagatcttcaccgagggcctccacgctgccgctgggtaggtcgtcgtgctccatctcggcgtgtattggcttgtgtattgtgcgtctatggtgggtgttctctctctccctaggaggccttgtatttataaccatagatgccccattgtctaagtagaactagggagtcaagtatagatacgatccgagtagtccttttcgtttccatatagaactttattggtccttccttatctgaaactccttctgtatacgaggtatgattccgtataagacttggtatatggtgggtcccgtcgagcttagtcgattactattgggtatgtggtatccataacgctgacactattagaatataatccacttgtcaagtcagagcaaagttttgtattatatagtaggaaaaacttataagattacaacattagaggttgtaccctggcaaaaagaaaagaaaacaaacatgccaccactaccacaacacaggatggcagctccacaaaaaacgtgagagggtactagcactaagctgattgctgctaagcttgaccgatcgccaatagacctaagggggtcataggtgccccgccaaacaccgactccacacagaagaacgtcaacgtacgagctcccggttaaactcatgtacaggggttgagaagaggaagagagcgagagagaaggagatccacttggacctacctccaaccttatggcaacaaccaagaaatgtcgatgattaaactgagagaaggcggcaacagtgaggaacgaaagacctcctgggcaatgcctgtggggaggtgacgctagaggctccaccgtcacccatgaaggatgagaaagtggtcgcttgacaatgccctaatagagggtcacgttgctagaaggcatcaccgttgctggctcagggagatgtcgagctaagctttcacctgcagaacccacacccacacctatcgtctccaccttaaagccttgttacccgatcaatctctgctagcacataactccgatgcaccaacaccccaacgccggctagctcattcccgccttcgtcgggtctccacgtgccaaagtcgcctcccgcacccatcggtgtagctcaccaccgacaactgcttatcctgcaatccatgccacgaccaccagcctccattgactcacccgcaatggtcgcctacagctgccggtcgtgctggcctccttgctgtctccaatgtagtcctcttgtcgcgccggctgtgttagcctcccgggcgttgcccgtaccctcactggccgctagtggctatcaccacgcgggccttcagatacggtgcggaggtgctagatacggatgcgagactccagatctagtcatggcgacaccgaccactagctaccgtccctagggccatctgcgggagcgctagaaggtgtcggatccaccgcctgcaccgccctttcttcgtgctgcgtgccacactgtctccgcgtgcgccagcatgccgccttcttcggtgagcacaccattgcgcggtgtttcccccaagccgtgaggtggatgagaggagagagacgagcggtggcggcacctagggttttcccccgagctaccattgggatgtaaataattatatccatatatgtagatatacgagaaatgaatttatatttagaatagagttacataatttgagttggtcaccaggattctatgtttgcactgtggggtgtcgaactagaaaaatgatacgttttgattagtgttcttctctatgcaaacgatgagttcaactcccccgtcttataatatagcaacataatactggatgaaatatatcctaatatactacgaatctagaaagagagatgcatatcatctagtactagcatgagacagagggagtatataattataagagcttgtcccagctcatatcgttgtaattgaagcctgggagagttcgcgtctatcctaattcattttttaattgtaattaattggctatgtgcaccgtgaacttagtgcaaaggtcggaaatatatgctttctataaagtttattaagtctaaaactcaacatgcaaccataccacatcacccactagcaataattacatatttaatcacatgtaagtatacaacatgatctatattttatttaattctacaaaccaaaatgcaagcatatccaatcatcacccctcatatcatcatttacacaatattttaacaaacatatctatcacttttataatatttaacatatagttatcaatatgtttcacactaaagcacaggtatcatttgactgataaaccctgatgtttctcttttatttctttttactcctagcttgattgtaatatatatatatatatatatgtatatatatatatatatgtatatatatatatatatatatatacatatatatatatatatattgaatcgcttagaaattcccgcagcaaagcgcggagaatcacctagtgtgtgtatatataaatatacacttcctattgttttaaaaaacatgcatgtgacgaatgctagcaaatctgaaaacggcgtcccatttttcttcaactcgatcgactctagtagatcccagttaacttttcgcgttcccatatgtagataagtatatatatgaccaaattcgtgtattactgataatatactttgatcattctagatcaggaacacaaatttcaacacacggtcccggcccctttgcacctaccagtcaacaagcagtaccaggtcttcaccctggctgtctcttatcgagtgatcaattaatcctagctagtcccatgtagctcagtcgaaacttcataattcagctgaggtagatgaactcatattcgtcaaaggcaaatttcttgcgttccaggtaatctaataaagaccaggtgatcttctttgtggttgaatcgtgacaagtcgactgccgccagtggtcgatcgtaacagtcaactctaggacaggtgtttcgttgcctagcatagtgatgaacttactatgtcatataaacagaagatttagtacgtagctggtgacgacaaccatatatatcttgaagaaaaatctcaaacacgacgtagaaattaacacacggcgatcgagtatatttgggcagcaataactataaatagaaagccccacctccaaatgagatgcagacacacatctcaaggcattgtgcacgtagacacgagtgagctgtttaattgagacttcgtgcagtcgtgctcctatcttctcattaggatttaacttaatctgatcagaagatagtatatgcacacgtgagtgagtttggcggttaaagtgcggtgacagtctgagagtgcgtgcgtgtagttttcaaaagaaaaaaaaagtgcgtgtttcctagttgaactcgtaatagaataggagtagtaaactaaggatacgtggcactgatggaaggcagccgcggtgacaagggcaaggtagtggtggtgatgggcgccacggccaccggcaagtccaagctggccatcgacctcgcattgcggttcggcggcgaggtgatcaactccgacaagatccaggtgcacgacggcctcgacgtcgtcaccaacaaggtcaccgacgaggagcgcgccggcgtgccgcaccacctcatcggcggggtgccccccgacgccgactacggcgtcgacgactttcgccgcgacgccgcgcgcgccgtggcgtccgtcctcgccaggggccgcgtccccgtcatcgcgggcgggtcgaacaggtacctcgaagcgctgctcgacggcgagggtgggtcgttccgcgagcggcacgagctgtgctttctgtgggtggactcccgcgcgccggcgctgcacaggtacgtgcgccaccgcgtggaccgcatggtggagcacgggctcgtccgcgaggtgcgggggcttgttccgctggacgacgccgactactcccgggggatcccgaggtccattcgcgtgcccgagatggacgcctaccttcggcaggaagccaccgcgccctactgacgcacggagacaagtacaaggtcgcgctgttggcttccgccgtcggcgagatcaaggcgaacacgtggagtctggcacgccgccagctgcggaagatccaccggctccgcggcctgcccggctggagcctccgccggctcgacgtcaccagagtgctggagttgaaggtggaggcccgcagcgaagcggagtgcgccgccgcgtgggaggcagacgtcatcgcgcctgcggcgcgggaggtggggatgtttctgcatggaggagggaatgtggtggagagcggtagggaggagcacccggtggtggtagagaagatggaggttgcggcagtgggtggtgccggtgcggcggcggccgcggagaagtggtgtggtcggcggttgctggagacgacggcggcgtaccatggaatggaggcggccgcggcagtttgaccagttaataacgtcggaagagtagtacatatatattcatgacgtttcatggtttggtttggttaggttagctggcgattattttattaattaattgtttcattttttaataattgttgtatccatttaataaactcaacctgaaggttgattttcggaatgtaagtttgcgtcacctcttctcaatatactggagaatgtcagctcatttttttcatcaaactcaaacaattataaaaaaatcactaccgtagaaaggcaacaagtgccggttgggaaaccctaattggtgctggtttttccaatcggcaccacggaagcagtatggatgacactggtcatcggtgccaccaaaaaccggcacctatatagtcctaataggtgccggttctaagccaaaaagacacgtggctactaaattggtgccggacctagctaataggtgccgattctaatgtaaagagacacgtggctgccaaatagctgccgtctggtaatgaaaaatcggcacctatatgttgggtaaaaaaaataaatattgcaggaaattcatccatacaaccctaattccatacgaccccaatttcatccctaagtcaaaattcaccaagtctaaaaactcatgggtccaaaaattcctatctttaaatcctaaacatttcaatatatattctaactcaaaatatgctaagtttaaatttcctaaatcaaaagattgtaagtctaaaatttttgaagtctaaaagttgtgggctgcggcctgctaacttgtcaaggcctagctcgttaaggctcgcgagcagctcgagctggctcgttatctctaacgagctaaaatcctagcccggcttgttagaaaaatgaagccgagccgggcttgtcacgagccgagcgagctaacgagccacgagcttcctgtccacccctacttacatccattgtaaactagagttttggagtccttcaccatggttgtgatcttgcgatattccctattatcagtgccaaacctctccccatcgcgcagcatctgatctagaataggttcaccatgatcgacacacgtttggtcctcctcctcctcgcagccgtcatttgcatcatgcccgtgatagttgccggcacttccctcaccttgctcctcctcgccaaggaagttgcccacaaaaccccttgtaagaagatgtgcatggacctgttgagccgaaagttgtctgtcttttttgcaatcatgacatggacaccaaatttattccagtgcatcaactaagtttgtgctggtggccacggcaacgagagccacgatccgctgtagttatccattccagatccattacattcaatgggtacctgcgattattatcgtttattacaaaccgtgaaggaaaaaacaatgaagatttcataatttacaattacattagaataaaaacaatgaggaatgaccattttatcctatgataaaattgagatttttgtacacacccacgtcacaatacttagatattcatggctaacgaaaatataaaaaaatttctatttttcgtcaatgcgaaaaaatatttggctaatgtgaaacactaacgacgatggcatagatggaataaaacattaattcaaatttagcataacatccgagaacagatctacgaatgactgatggatccatacaaatgactagtgcattttacatgtattaccacatggcaattcaattcaacgagaaaatgtgaatcggggtgagaaataatgaatatttaccttgtaggcttcaatcttcaactaaaacccaagaaaaatcgagcaaaaccgcttccacctcctctagccgatcgatgggcaccctaagataaatttgagataaatcaagctgtcaatggacatttccgtggccttaaaatagtttgactagcattaatttgactaacgaccatgacatagatggaagaaaacattaacgcaaatttagaatttcatccaacaatagatttaatgagattaatcgagtggcaagggagggaatacatgtactgctgttggaataaaggtgctggttcaaaacccaaaaccggcaccttaatttctcttgtcaaccggcacctatgtgtggggcccaccaacggctaatacatgtactgacaagcattgttggaacataggtgccggttctagacccaaaattggcacctttgtcttaaaatcggcacctatgtgtggggcccagcgacgtctaatttgggagggagaagattaaaggtgacggtttgacggttttttactatgaaccgacacctttctctgacacagattttaggtgtcagttttatttaaaaaccagcacctattgtacataaaggtgccattttttgaaaatttggcacgtgggagcaggtgcataggcacgaaaggtattataggtgccagctttacctactccggcacctatagtgccgacaccgtaaataatacgattgactaatgtaagatataccggagaatgtaagtctcccgtaactttttttatacaaccttccttaccgagctctagctggtaaccttccagattgcttaataatgttgtggtcagagtaaagccatagacgcaaaacctgtatctggtctagacaagagaaagtacaagtctataatctctctaatactgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcaacagcggaaaaaggcgatcctagcggggcttcagctccactccacaggcaaaactcaactggggtctgagccttggtcttctaacttcgtcttcagctcagaagcactacacttctgaaaagggggaataatagcaaggctgagtacaaccaccgtactcagcaagccacaccaatgatgcagacgtgcaaggggatacagggatggtttgggctatttgcataaaggcggttgtaaaacattttattgagcaaaacagtaaaactgttgagtaattaaagtaacattaaaatctccactgatcaacgctacaccacgttgaacaggcccaaccaacccacctggactacagtgcattgggtcgatttattaaggtgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacatcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtccttaattgccatgggtgcgactcacaaaaccatgcacccacagcccaccattcagtcgcattttagttggataagcacgaccataaaacatggccaaaagtctcgagcacgcggctcaacaagatactagaatgtctaaaactgcaattatcccatcgactgatctagtggtaattaagcatggctaagcataaagttctagctaggtcacataagtaacacaagctagtcgatttattacccagggttgacaaaggatagatatcaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcctcactttgatcttctaaactcttttcctcgcgaccgcgatcttccgaaacgacggattctacacgctggcacgcaaaacgaggaaaaaccctaataaaaaccaaggaaacagtacataaaaagtaaacaaacatgtagagcttaattttagatgaattttgaaatttgaatggctcaattcggagttcgaatgaattagatatgaattttagaagttttgagccattttaatgaatttctagaattaaactcgatttattgcgcaattattatttatttttacaaaggaaacggacctcgctgacgtcagcaaaggggaggggcggcgccggcaagcgggccccacacgtcagcgagtcaaagggggagggcgcacggtggaccaagtccacacgtggcctcgggggcacgtccaccacgtggacggcccagatcggcccgagccgatcgggcggccgaggggagcggcggccaggggcacagcacggcacaaggccggcctggtcgagcgatagcgcgcggcggcgtgcggccagacgaccgccggcgacagcggcgcgtcgcggcagcgggcacggggagcggcggaggagggaaaaaggagaagggacggtggggattctcaccgaggacggcgacggtgagacgaccacagggaggcggctggcggcggaaaggatggcggcgactggcacgagaggcggcgggaacggcgttccggcgacacccgaccatggcggagacgcggccgagggccggcggggccctcgagatgacgaagccggaggaggtggcggcacaagtcggcgtcgaccggagaggcggcgcgacgcggctagactcggcggtggcggcggagagagatggtgaacgcggcggcggcgttccaggggcagggaggggaaacggagtaggggccggggtgcggcgaggaacggcgatgccgatggcggtggtagcgcagcgcggcagcgacgggagcggtggtggcgcgcgactggaggtgacgagaggcagctgtggctcgggtgcacggtggatgtggtgtttcggcggagttttgtggaaacggagcggtggccggtgtgcggcaaagagcggcggagccgacggtgcaagcggcgcggcgcggcggcgactaacgcggcgggaaacggcgaccggagtttgccgaagtgtggcagcgcgtgggtgcggcgtggggagagcgagggagagtatgccgggctcgggaaaaaaggggaaacggacgaggggagcacggggatgcttttatgggctcgggaaggcgggatcgaggccggacgtggcggatttgaagcgacaacggccggcgacgtgggcgacatcgtgggcgaagtagggctcgatttggcgccaaaaattggggaaaagtgggggatttggtggagaaggtggaggggatcgtgcccacgtcgttggatgcgagctcgggtgcgggagggcgccgtattttgcggcgacgtggacggcaatggcggttggggtcggccggcgagaggtaggaggaggagctgacgggtgggaccgccggtcccacctgtcggcgaagggagagaaagagggacgcaaagcagacttttgcgagcgggccaagggagaaggccggcccgagagggagagaggggggggggaattgggccgaaaggggcccaaagagaggagggaggattttatttgttttctttttattttaattggttaaatgatcttcgtgactttaaaactatttctcgagctccgaaaattcacggaaaattccggagagtacattagggcacaaagaatattacaaaatattcccggccattgatttttaagggaaaatttcaaattctcccattattttacttgattaaattgatttatcttttatttaatttctagaaaatgtattattaattgatttttattcccgaacgaaaatcggggcgttacagcacagggtacacattttttattatgtgttctatatgcatttactcattgagaattagtgccttcaacccattctactcccctctcatgttacttgccccgtcataaccttgccctcttatgtcttgtaaaaagttaatgtcagacaagacagcacaaattgagttcttaagagtcagtgaagaagtgtccttataagtcctttgttgacaaaccgaagaactattgccatctgctcttttttagatttatctcgagcttcatcaaccattatgcaatacttgctattaccaatttcttctctaactgatttttgcactttttgagcaattatgcttaggatttctttttggacatcggatgatgtatacttttcatttcttggagaattttctagcacaacttctcgcacatctttgctatatgaagccaaaagcttaaccatttcgagaaaattatctcgatttaacgaatttagagattcattatggcctctaaatggacacccttgaaatgttaaccacctacaaggacataatcagcacacaaacacaaggctattagatattataatagtatagcctgtagagtttagatgtaaataatgtgcaaaaaaaaaaaagaacaactcatataattatctaatggattcaatggtagtcgtaagccttagtcttgctccttccaccaatatatcattctgcttaaccatcacctcgtcaatgtgagccataaagttttttatattattgtaacaaccaactcaaaagttatgagcagaagtggcattccccatgtgtttcacaaaagcacattcttttccatcattaactttcttccattttgaaactccttcactgtgaaagtaactaagccgaacttgccaactggttctttgaaaagagaaaacatggcaggcaataagcacggtctgtgtgtggtgaatactctagccaactaaattgtttaaaccaattactttggaatcgacgagcatggaatgcaccattcagtgggtactcttccaagataaattggtatggcccctcagatatataaaatctcctaccatcatctcgttggtcagcagggagtgttgggatacgcataagctacgatagcataaatcaaaattttctaccacgtaaactaggaaccatgcaagtattagatagatcgttaccactcgacgcgctgcgcagcgaaagaaagcgctaagaaggcgaaggaacctcgcgatgtagcgtacgtcgatgtagaggaaatagtcgatctcactggctcgaccttctcctcctcgtgcgttctcctcgccgtactcctacgccgatcagcaccgcaaaccagcggcccctctaccggtatccacatgtacagggatggaacgccacgcgcagatgtgctagcacccgcgcgcggctagggttttgctcggggaggggagtggcggctagggtttctcacgtgatgcaataccttcgccggtcacacccctcacgaatatataggatccatgactcaagtctccaagacccgtaggacttctattcggatccctaaccgaattaagctcattttggatctccatccaatccccttattccggcccattaagcgtgcgaccctgtaggttcatgtacactcggctgtaacccgaaaactccttttcgatccacgtgtcaacagcggcccctagcagaacgtattgacccaccaggcatacataaagatcatatcggctaaacctctagtgtatacttgtatgaacccctttgcctcacgatatcggttaagctcaaggctagatatgtgtcatcctctaataactcaataattcacttgacctgtgatagattatataacttgtgattgactcctcaatcacctttggcatggccatacgcttccataatctatagcatcgaggagcccagagatatctctccataggaggggcaaatcccatcttgattattcatatcccactacatgtttcgtagcatacccgaaaaatacttttataactacccaattacggagtagcgtttagcaatccctaagtaagctactacacatgttgagaaccatgataatcacaggtctaataattaaacaccaacactaaatgagatcactgatgacacaacacatatagcccttgcagtgtctcatgttgggtctatccaacaacatgttccccaacatgtgtctacattattaatttggtatctctatatcatgatccatgagacatgatcatcaattaatacatgtgctgatcatttaaacatatttgttccacatacgatatttgatcagggattctttagaaatagtaacaatcaacataaagagtctcatgaaagaatcacatattcattaaccaataatgagttatctatttcaagaaataatattggataaatatgtaaacatattatgtgatacaatcttctcaatgattacccctaaggcatatcactaatagggagtgcggagatttgaacatgtttacctgggtccctttcaaatgccgtagttacattccttgtcagctctaaaggttcagcactgttctgattaggagattgcagattaaccggatcaacagcttccacattagttgggttaggatttttcaacagagcctgcccttggagccactggcttgtaaaagcaatcaatcgttggtatcttcctcttcatcttagctaaacacctagcaattttgatgtagctgaaaatataaataaaggaaaatcacaaaattgattattgattctgctttaccggatcaaggttagtaaaactagagaatatagagtggatttacagggtatttacagtgttcgatttggggataacttaccaaaaagcagcagccaacagataggtggaacctggtccgtgagctcagaagatgtgcgcatgttctgcagaccacctctgttggattgcttgctcctagctcctgcttggtgcctcgagcagccactctatcggcggctggccgcgtcgccacgagactgcaatcggctgatcgccgattagcgccggacgggacgagggagaccggaaacgatgcgtcggtgctgcgtgcttgagaaactgaaggccggcccctagcgatcgcccgttagccatctcgcaagcgatgggacttcacgacgaagccgaggtatcgcttgactctctcccgtatatcgagactccaagtgctaatgggctgggcagctgcgcagatggccagatgggctttgtcgggggtggggaatcgttcatgggccattggggggtgccaggcccagttcggcaccccctatagcttcgacactgctaccggcaatggtcgagtgcaccgtcgccggccatgtcggacgacgagaaggtcctatcctcgcctcctgctccactaacgctgccatctgctgtcggtccgccgctgcggccgacggggcggatgaccttgtttcccacagcggcatgcggcacaacttaaaactactggccctcaccggctcaccgcttgcggctcacctccagctaaggttgtccatgatctgcgcccgctctttcctcctccccactggcgacaccaatggcgaagaagaggggggcaacaatgtcttttgttaaattctctctccagctctaatgaaagtaatagtttaatggttctattgttttgccgtaaattatcatatttttaaagtgtttttgagcaaattaacgttcttaatatgtctaccagtaaatatcatatttttttaatatcctgtagcaaattttgttaaataattattctaattctactatgttaagaataagcttgtttgtttagggtaattttttaccaagccaaaattttatcaactttaataatgtcgcatgtatatttaatttgctactctatttttctcacagtagttcaaattctatacttaaatttgatattgatagcgccaaaatttattgacgacactaacaaaattttgataaaataaaaatgaactctattccaaacgagctcaataattcatatggatgcgagtcttacgccaccgtgaaatatcctactctacctttgtgcgccccaaccagccgctgtccactcggccgtcaacgacgacgtcgtcatgcgcgagagcgaagcgcacgagcgctgaccctgccgcgctgccgcagccaacacgccacgccaggagcttagcactgagcgcgcacaagagattggctggcatgaattagacacggcttccagttccaaatccgaaggaaaaacacagcactgcacgccccccgccccagcttgatgatcgattaattgtcggcagctcatctttccttgtcacatatcgcaagagaagtcatagatgcactagtcatatatagtacggctccccgggacccggccacggcaggcttagctgtgctgtgtgacccagcgagttttgccggccggcgcctctccatctccggtccagtttgagctccatgtcagaattcacaggactgcagtggacccaaacgcgctcgatcaatcgccgtctaatcaggccttgtttagtttagaaaaatcatagggttagttgtcacgtcgaatatatcactggtggagaaatgctttctagtcccggttcataaccccctgtagtcccggtttttcaaccgggactatgaatccgggactaaagatcgctatctttagtcccggttcaaataactgagactaaaaatcaatctttagtcccggttggtg

SEQ ID NO: 53367 - DNA, 9255 bp, Oryza sativa
  unsure (1)..(9255): unsure at all n locations
ccaaagatggtttctccaccagtgtatggacatatatttaaagtattaaacgtagtctactaataaaataaattacatattccgtcaggaaactgcgagataattttattaacactaattaattcatcattagtaaatgtttactgtagcaccacattgacaaatcatggtgcaattaggcttaaatgattcgtcccgtaatttacacgcaatcagtataattgatttttttcctaaatttaatactccattcatgtgtctaaacattcgatgtaacagcgtgaaaatttttattttgtgaactaaacaggccgttagattatatagattaaatatcgtttttggacgattgagattaaatatcgtctgtgatgccatattttcaggtacatctctcaacatgtgtcttattaagtagctttgaaaattcatacactatgttagcgctgaaatgtccaaaatttttcatgtgaaatgtgcattatcctttgaagtagtcactatataaggagaactgatgcggaaaactatttattagcttcccgatttccttaaaaaaattgcaaaacaaccccaaaaaaagtcaatcagaagaacaacgacaaataacaataggctccacataagggagacttaattgccaatcgatcaaggtgaaaaaggtgactgaaatacgaggggggggggtatgacactactattttttagcaaaattgtttgaagaaatactggtctctccagaaaatcggttactgctattattggggaaaaaaatcaaattattaattttaaaaacctgtaactagccaccactgctaataacgagttgttaaccggttcttgagtttattttggatccaaactattaatatagctaatgtgtaactattcataatatggcatatagaacacatacatatacatgcatacattgcttatgaaacacgtttttacgagcggccagacgtcctatgtgcgatcaaagagatgcgaaaatcatcaactttagcaggtagatccacgttcgtttgcgaaaaccgatttttcttgctagcacccctaagtgacccccctgcaaaaagaattttggaaaaaaaaacattcacatcatacatgctttgatttaaatccacatctatgcatcaattcagatctacatctaaagagcgcatcagatacaaatctacaggcaatagaacatgcaaaaaaaaaaaacaacatcaatggcagatagatgtcatcgtagcagccagaaacagcgcgctgctggctgttgtcgtcactgcgtcgtcgcaggatccacctcttccaagtgcgtcctcacaggatttgtcttcgcctccgcctctcttgacaaccaccacagtgtgctcctcgacaagcttctcctgtaggtgcaaacgttcgatatgacaaggtgaaaaattttagaataggatctaaacaggactatagtgtttatacatgacatacaagtatgtaaactatttgatagcttctgggttagggatggcctaatccctcgtggatatagacagagggttaatgaaaatctatttaaaaaaaaagttgttgtaacgaaaagaaaaaaatctctcgcaagatacgctgatgatcatgtactactactgtaccttttgttggtttgaaattctgctgagaactaggggacaaaaatcagcactagcgtgctagcgttatcctaggtcgttttcgcgatgaattcaattcaattcggtcggtggagcggccaatttcgtaacctgcatctgtgccgacctatttgtccatcaagtaacttgaattcgataaatagcacgctatcaaggaacttgaactcgatagatatcgatcgtgctaggctagttaactactcgcagatgttctgaacatgtcaacaacattttaataacccctaaaatacatatatatagtagcatttcgaaatatgttttttatatcttttatctaaagttagcgtttagtgtgcgacctgtgctaactcatacctcttagccttttagcatgtgtgatttaaaaaagataggatgtgtttggatgaggcgaacctattttataagatgtttacttaaaaatagatgggttgagattaccttcgaagggaattattttttttaagatttgggttagctttacgtgaaaaaagtggcgaaccaatcaaaaccactttcccgctctcgctgacatacgagtcacgccatcccttttctaaaaaaaaagtgatcatttataatctcttaaataacaaaacaaatagctagaaccatcctatctaaaactagagataaacctaacccatcccaccttatataaaacctaaaacacgcttagctataacctattagccgtatacaccaagtgcagatgccagaaatatagtccagggactaaactttagtacctatcatatcggaagtttggacactaatttagagtattaaacatagactatttacaaaactaattacataaatgagagctaatctgcgagacaaattttctaagtttaattaattcataattagataatgtttactgtagcattacataggctaatcatggattaattaggctcaatagatatatcttgcgaattagtccaggattatggaatgggttttatcattagtctacgtttaatacttctaaatagtgtccgaacatccgatgtgacaggggctagccccatccaaacagggccacttgttactattttttttgctacatcaacagaacatacataaagccaagaacatctcttgatttttgtctagttaacaaatttttcatgttaacagaatcttcttctgtgctctttcagacgcagtgaaccagccagcagctagaaaagaaagcttgattctttcgatctctatttttcgtatataggaaaaaatggttgcgtttcttttgttccttttgttcctttgggcaagtcaagtcatccactttcctaactcaccaacccaacaatcttagcttaaagattcaactacgcacaaacagagccccaaaaggaggaagaattacttctccaaacatacttcacaagttacgctattttctcccctcatagttgcttcatgtcaaaagaaatcgaacagtgtacaatcttctagagcaatttcttcttcaactttgctaatcgatccagctgaagcaatcaaattacacagaaaaaaaagtaggataacaaatgaaagtaattaattaaattaactatattctgaatattgagataaatagtaggagaaaccaaactcaaagttttattaattagaggtatgtattaaggaccagaaatttcctttgggaaggaaacaaaaaggggctgggatttacatgttcatatacactccatacaagatcttggatcatctgccctaccaaagtaccaaccttaagtgcacagttttgttttcactaacttaaaatccgaaaacctggcacttatagaacacctctggatacccatccatcgtccgattcttaaccctaaatcctgaacccgaaaccataaaagcgtcacacccctacataaaaaatgcttctgctatagctgcagattgatcatctcagctcatgagtgattcataactttgctaatcttgaagcataaaaaagagaggaggtgtcttgagctctcaagaaacaaggagatttttgttccttgtggcacacagctgtggtgcagggagctttgagattcgtgcagcggcagggggagggcgcgcgaagctttcacgaggcgtgcatctggtcgaggaggatgacgacggccatggcgagcgccggctcgaagcccggctccaccaccagccggaacacgtccgggcccacggcggcctccttactgcacaccgccgccacgcgccgccgctgctcgccggcgctggcggaggcgaacacgtcgaggcagcgggcggcgtacgagccctccacgtcgtaccggcaggcgccgctcggcgcggtcgccgatccgccgccggcggcggcggacgacgacgcgcgcgccggcgacaggtgggcgagggacttggtggggcgcaggctgacgtggcgccgcgccgtgaacctcttcggccccggcgccgccggcgacgccgcgtcgccgtcgtagatgagccactcgtccgcgaagctcagcttctgcaaaagacggaccacacgagaacatcagcatctgcggcggccggccatggccatggccatgggcaccaaaaaaccagagcaagaattcagagaccacataccttgcggcggatggtgaggagggcgcggccgtcggcgtccatgagcacgacctccctcggcgaccccccggcgtagctctcgacgcggaacacgaggttccccttgccgtcgaacaccgtgaaccccttcccgttgaacagcagcgaccgccgccacaccgtcagcgacaccgcctcccctttctcctcctccaccaccgccggcgccaccaccgngacgttggggtgcaccttggtcatggccgctcgctctgcggcgcggcggagcaggggaggtcaaggacaaggagaggagaaggcgaagcgagaagaggagacgagtggtgatgagaagaggcaatagtgtggcgcgttggatttataggtgggggaggcgcgtggacgaaaatgcccctgcgtgtttggggtaattacggggcatgccatgatagagattagtggcctctttttgctaactgcgagcatcaaaaggtcaaacctgaatttgggtggttaatgggtggtgtcaccactaggctagtattattaataatgaatagttcacttcgaggttgataattttgttttcacctgcacgtacatgtcaccttgcacaaagtatataaatatactaaaattaacatttcacctaacatgtgcatggtatagcagatgcttatataaaatgtacagttacaaaaaggatttaatctaagcaagaggttaatatcttgtggcttcaattttccctaaatatgtgtgtttacttttttcacaatttttccaaacagttcaaggggttctcctttattgtggagggctatatgtatatatattcttcttggtgatgccttttaatttgttgcctctttatgtggtaggcacagacttggaaaggagtggagggaacagatggttgtttctgtttcttgccttctccatttagaggttttaaagatatttagattttacacgtatgtgctagtatatatatttccaatacttgtgcaattatctttaatatttatagtacatcatatcttgattatctggaagttaatttttgtcccggggagaaaaggagagattttttttctagtctgaaattctccaagttaatttcatattggacatgtgcggtcgcacactctatctctctcaaaagagacagtatttcctttttggcaattatataagagatgcacgcagccacaaacacaccctttaagacatcctcaagagatagaaatcactacaaatcacacaatattctatttaaagcataatctagtcacgggctcacagcaggtgctctttttttaaaaaaaaaagaaaagaaaagaaaaaggaaatcagtttgtatattcctctatattattgcaatatatccatctgaatttagcattaataaataattatatcaaacaggcctaactggtaagttaatgatttgatttttttttgtcatatatagcgacctagctaggcagctacatgacattggcctgaaagcgttgttttgctactttggcaacgtggcctggaaaaaaaaagacaatctttgcagtaaggtgatggaagtttgtttgcttgtttttgttttaataaaaaataatctttttcctgttaggatcgataaaaggtacgtaattacctagctatgtaattaatgtacataatgccatatcattgatgctttagacatatatataaaaaatggcgcagatcattactaaaaaattgtgtgcctctttcaagttatcatcaaattttgtacacccacgctcttggaacccacatcaaacacggccgacctcccaaaaaaaagaactaatgcaactagagaggtcgtatgtgggtaatatatccatacacattaatttaagtacggttttttggtagcatatgtaaaaatatatttctgtagcgtaataaataacggtgaactatgcagtgactttctcgctaatgtcttagaattgcttatacggtgaacagtcaaacatgtttaaaaagtcaatagcgttaaatatttagagatgaaggaagtagaatgtacatatgtgtatttataagacgagtgaatatatggtcatctacgctgtttgtactgtacttaaaaaatatcttttgcttgttccaaagattttcttttcttcaaaacgatgttaccatcaatagagcaaaaaatctatactaccggccatagcagcggcttaacctttcacgcatggtcaaacacacgatagatggtgctccatatatagtagacccaattcctggccgagagagagccacgtgggacgcggtaaacacccaattagtggtgtaaattaagaagggaggtgttaattaactaattaattaattaaattaagattagccgatcgagtagctcgatcatatggctgcaagggccctcgtagcttggccggctcaaggcggggcccaaacccggtcatagttagattaattaaaccgactcctaatcagttgattaattaattaattaataaataataaccagggatatgatatctttatctggctcctatgggccggcttagatctccatcacattagattaaatcatcaggatttgttaggaaatcatttgccgtcgacatctcggcgtgatgggaaggagctagctatgtaagctccggtcactgctttggctggtccatgcattgatcccttcaccttgataatctctgcaataattgtcggtttgtgtgctaatgacgttggttggtggttgttaattacttgggtgtgcaatggacccaattaattggtaattaattagtcaacaagagcgttgctactgtggagtaatttgtttcttctcatttcagattttttttaattgttctggaggacattaattaattatagatctagccagcaaatgcaagccatggtgcatgcatcaggtgtgttttgcgtgtaatattattcaatcatgttatttgttgtgtgtggtggtgattgaaacctaggctggaatttcatgacgtggctttggaaatcttgtttttaaagtttggcagcttggaaatttcttattgtcataatggtttctaaactttgtctctcgtggtggttgtcataactttactgctggcaacgagaaaaccctgaaaaatatgagccatctttggtcttcatatatgactttgaaaattaaatttatactaaaaatctataaaaccatgcataaaaaatataatattgtgagtgtaacttttgaggaaaatatagacatatccaaaataatatgttttcataccgtaagggagtagagatgtacagttttatataagtaatatacttaacatntgcgctttatttttatttataattagtanaatatatagtattcttttattaattancaaaaatattgagtatttaatctgttcgtttggaaaatagaaacttcctatcctctttctcgaggtaaatctttctcgaggttttacctcaaaaaaggtagtatttcttttgttcatctggaagagatttgcactttatctattgaatatgtaattatattttgtggatgaacaatatctaatactaaccgagcagatggcgcactaattcacagtattcaagtaaaatatgtttttacgtcactgtttccaacaggtaaaaaaaatgttttttcgtttcattcatcgttgccctagttattcaaactagcttgcttgtctagcttggcgattttttttctcgagcgcttggctattttttttaaaaggaaaagagttcaggattgatgctattttttttcttttttgctattacgattatgataattctattgccatcatatatctgccgtactgtaagagaagataatcagaagcaaaatttgtttagtgtatggtgggaaatatgttgttatatatatcctcgaaaatttccaactcatgtagtgagcaaacagatcaacatgtacctacaagtctaataagcctattatcacaatatctttttgtcagcatacatatcacaaaagtgctgccttttgttctctcgacatatcctctgatggaccatctgtcccctacttttctgaaggatatcctttatctactgtagagcatgcagaaaattaaactaattaaacaaaacaaagatattaacatccagcatcatcagcagcaaccagcagcaaccagcagataagggagagagatcgatcgagagatcagagaggaacagaattgatgcaataatgcagcggcgtatcacgctcgaagtttggaagcaacaaacagatagggtgacccatgtcattaattttaggccatttggcagtctacaagagagaggcctctgacgaccgaaactgcaaaaggtagtagtagattccagctttttgggaagaagagccaaacgggtaataggattgtgacatgcactaacacgtcgcacaaggagtatggttaatttggttatgggcatccatggcacatggattatattcaacgagtttgtggcaaaccacgcatggagctctcctttccggccttgcagaaaaagttgtggaagagaaagacagcgatcgagaatgatgaaatgaagaattggagattatgcgtcttcacgaaggaatggaaaaaaaaaaggaaggcattgagaccgacagggagtgaacctccaattaatgtatctcatacggtagagcatttgagtccaggcgtgaacaatgatgtgatgtataagttttgtgagaatattgccttgtactccctccgtcccatcttaagtgcaaccataaatttccatgctcaactttaattgtccgtcttatttgaaaattttttataattagtatttttgttgttataagatgataaaacataaatagtaatttactagtgacttatgcttttattttttttaaaaaaatttaaataagacgaacaatcaaaattagacacgaaaaaccataactgcacttaaaatggaactgagggagtagaatttt

SEQ ID NO: 53368 - DNA, 1103 bp, Oryza sativa
tgcagcccccactcacttgtgcaagaggatggtgtgatttctggccaacaaaacttgctttcctatattaccagcttttataaagaattgtttggtcattctaaagaaaacaatgtctctttaaacatggagggtgtgagcaaagttaagaaggaagatatagtggaattaaccaagcctttcagtctagaggaggtgaagaaagtcgtttttgaattgagaaaaaacagagccccagggccagatggcttccctggggaattttacatgaaattctgggacattatcaaaaatgatctcttggaactgattaatgactttcataaaggtttactgagtgtcgagagattgaattatggcattgttactcttgtccctaaaacaaaagatgctgcacaaatacaaaagttcaggcctatctgcttactcaatgtgactttcaagatcatcaccaaggtgttgatgaatagactggacagggtcatgatgtatattatttccaagaaccaaacagcctttctcaagaataggtttatcatggaagggattgtcattctacacgaacttctgaactctttacattcgaaaaaacagagtggcatcctttttaaggttgattttgaaaaggcatatgacaaggttgattgggtgtttgtatatagaatgttgaaatcaaaaggctttccagatttatggtgtgattgggttatgaaagtggtgagagggggcaaggtcgctattaaggtgaatgatgagattggtccctatttcaacactcacaaaggcctgagacagggggatcctctttcacctttgctgtttaatttagaagcagaagcactcaccttgttggtgcaaagggctgagagcagttctcttttggagggtttgtcagtaagtgagaacaataaggtgacaattctgcagtatgctgatgacacgatatttatgatcaaagataatatggaacatgctagaaacctgaaattcatcctgtgcctctttgaacaattatcagggttaaagatcaattttaataaaagcgaagtgtattgtattggagaggctgtggaaagagaaaatgtttatagtaaaatttttac

SEQ ID NO: 53369 - DNA, 11399 bp, Oryza sativa
cacttttggcaaggtttattggagattaaaaacaccttttacaaattctgttctaagaaactgggagatggcaaacgaactttattttgggaggacaattggattggaggtaggcctttaaatgagcaattctcagacctgtacaatatcactaacacaaagcacatcacagtggataaagctctgcaggggggttgggataaagtcacttttagaagaactttacatggaaataggcttgaggactggaacagaataaagcatctatgtgctaatatccatctgcagaatggccacagtgataagctttggtggaattttaataaaaacggctcttacacagtcaagtcgatgtacagagctctcaaattgcagcagttttcatgccctttgaaaaaattttggtacatcaaaactcccctgaagattagggtgttcctctggttatttctcaaaaacaaaatcctgactaaagataatctttacaaacgtggttggcgaaagggagacaaaatatgtcagttttgctgtagggaagagtccatacagcatttgttttttgaatgccccttagcaaaattgatctggaatgtggtcatttgtgccctcaatctaaaaccattttcaaataaaacccaacttttggggccttggttatttggctttgataagaacacaaaaaatttgatgatggtggggattactgctgttatctgggccatatggaaaaccagaaacagagcgtgttttgattatgttcttcctaaagatcccacagaggttatcttcttggtttgtaatttgattgaatcttggactgttttgcagaaatcggaggcaaatcgaatggagctgggggtctgggtggtaaggcaagttgcaagtgatgtttacaactcaagatatggttggcgtccccacgttagaagattggaatgaatgaaggatgctgacgtgtggaatgctgttgcttgtgaccgttttgaagcttctgtgctgcttaacagatccctttctagctttgttttctcctctggtctttgttatatcagccaggaactagcagtctccctcaaccagttgtttttgctggtctttctgtgggaaccctcttactgggctttctgttttttgtttagttttctataagacaatttgccgttccgttaatggaaaggggggccttgtgccctagttctaaaaaaaatgatgtggttatttagcatgaaatgatgcaagtgcaatggaaggcccaaaatccaaaaaaaaagtgcaaagcgtctctcatgatattctatgagaatttagagacttgttagtaaaaaggaacaaacttaacaatatgagagcactaatgttggtgacaattactcaggcatgtatacatggggggttcagcagaggcagatactcagacatgaatacatggtaagatcaagccagataacaactagaactaggtccctgttggagcaaagggagagaccctggacgatggcatctttcaggcctggttgtgatgtggaggccatatttcgctcggtaacagagtacatcataggaaatggtgaagacaccgatttctggacagcaaactggactgggaagggatgctttacatggcggtggccgatcctgcactcttatgcaggccgtgtcaagctttcggtcgccaaagctctcaccaacaatcgttgggtccgcacactgcagggggcgctgtccaacgaggcgatgggcgagttcttctagctttgggacgaaattcatgatgtgttgctgctcccctcgacggatgaaatcaggtggaaactgacgaacgatgggcaattttctgtggcgtcggcctacgacatgttcttcatggctacggaaaactgcgcattcggcgagctgctgtggcactccagagctccctcgcgagtccgcttcttcatgtggcttgcgctaaaggaccgttgcctcactgcggacaacctcgccaagcgaaactggccacatgatgatctgtgctcactttgtcagcgagatgatgagaactgccaccacctgttcgttgcgtgtgattacacggcggtgtggcgttctatcaagcgatggtgcaatgaaagctttccaattccggcagatggggatgctgccctcgctgattggtggctggcaactagatgccgttttcagaagagctacagagcagattttgactgtgctttcatgctaatatgttggctgatttggaaggagcgtaatgcacgtatatttcagcacgtgtacaagctaccggatcagctcgcggaggacatcaaggatgaaattgccgtttggagggtggcgggggttttctcccaatttcgcgagtaatccccatgggtgtttgcggggtttagcctcgcctttgcttttcgttcttggctggctagggaccttccttggccgccacgacattgtaatgtcgctgtaaacttttactctgttttcctcccaatcttaatgaaattggtcggccaacctttggccgacccggcaaaaaaaaaaaagaactaggtccctgttggctaggtttggtaacaatgttgagggcattaacaatggacatttcggaagctggatttggagtctgaaagacacttgatgaagtgtgtactatgtatgcagatttgaggagggttgggtgttgaaagttgaaaccttgaatccaatcatcagagattcagaattttgtgacacagcaccatgcaaatggctgcacatgtcagatgaaaacagtaagtatttgcatatatacatactcaaccaagcataagaattgacactgatgattgatgtaacaagtacagtaggtgggtttaggtagcactagcacacaaaatcatatggctaacaatgaaaaataaaataaaatgcgcagcatcccctttaataccagattaatgaaaacaagatacttaatttcagatggataactttatcctaagcagtaaaatacaaggagttctggttaataattagtaaaaggcatagcttcagtcataaacacgagttaatttattcatgggaaaaagagggtaaagacagttctgatgtccacgcaaattacagaaagtgctttaggtattactcacaagggaaagaccttaaggaattcaaagtaaacaaaaagaagaagaagaaagaaacagagagagaaaaaaaacttcagaactttagctatgtgggtcatttgctcattgctgccttcgatgcaccagaaagcagaagaagagggcaatatgcttgacaagttatcgagtaaatcacgaggaccctttgacccagtccttcctactgaggcttcccaaacaataaatttccaccctgtcacatcgaatgattagacacatgcatagagtattaaatatagaaaacaaataattacatagattgcgtgtaaattgcgagattaagcctaattgcgccatgatttgacaatttggtgatacagtaaacatttgctaatgacgaattaattaggcttcataaattcgtctcgcagtttatagatgaaatctataatttgttttgctattagactacgtttaatactttaaatgtgtgtttgtatatccgatgtgacatgcaaaaacatttcacccctgaactaaacagggcctaaagccaatacgctgccgcaccagtgcgcgattacacataccagcccatgatccaccatcgccgctccagcgcccgcactccctcctgccgctgcaatccttgctctccacggatggccgaagaggaagagaaagagagataagggagagacagggaggagaaaggatgggagagagagtggatgacatgtgggccccacatgtactgggtccaataatattttttttgtgtgaatgacaatgggtcccgcacatattttttaattccaacgtgacataggtgccacttcaacgccatgtgggacgaagacccggttaacaccggtcagcgaaaccgccctccaaaatcgctgagagagtcaaattacatcagtttcaattgttcggggagtcaccctacccagctttctatttaagggttacaaattagatttggcctatttttttttagggagtcaaaagtggactttttcctagtggaaaagatagaacgcaagccagagccctgagcacggacgggccgcgttcactcgtgccgtacggggccgcttttgcttgctcccggtccgcaagcggcatcgccacaagcgcatgaggcgatgtggatagaagcagaagcaaacgagatatttaactatttgccactcttataagtgataattaatgatttgtcattggacccacatgtcatatattacgagcggcaaatacttaattaccacattttaaaagtagcaaatagttaaatgtctcgaagtgagcacgtcacctggaaatcggcccgagagctgtgggagcgtgaactcgccctcatctttaattttctccgattgctgcaaaagtgtggcagtccattaattggttttcctgctagcgctggctatagattagttgccagatctatgctctctcttcatttcttctcccttccacgtgagattgtattgttgtgaataaacttatagctcagtcttactgtacctgcagctcttaattagagagcatcagcagcggtcatactcaatgacgagcttgagaccttggataataggcgacatgtgacgagtaggcaacccacaacacacgagatggagagaaacaacaacatgctagatggcacattgagcttcaacatgggtgaccggcgacaggcgaactcaagggcactggcacggtcaagcttgatggtgcaacaatagaacctgatgattcaggctgatggtattggatttaaagtttgtatgctaattataatggttgaaaaatttataattcatctaaaatgagaataaaataatttatccaaatgttaccgacgtaattgtgcatatccaaatacatagatctgtagattaggaatacccaactacatgagaacttgaatctagagctatgcctaatagggtcctagattgcacggtaacgaggtagctcgcccgggggagggtggcgttatgagagcatgagctcaagttcgagggtgttgacatcgagctatagtgcacaacagctccgaagagctttggtgaatagggttcggtagaggaagaagaaagaagtattcacattataattttagaaaaaaataataaaaatctaacgaatgattgggtggatcccagcagtggccccctccctcattgggtcttgacggcggtgggggccctctccgtcacatggtctcgatgacaacgggcggaaaactacatcggcgatgactgcagcgacagccccctcctccggcggactgcatcgatgatgatggcggtggtgaccccctcatgcggatccagtggctccctctctcacggtgcggcgggcgacaagcaggatgatggagagcacgacaacggtggtggtggcggcgatgacgacattagctcgtgtggtcggcattgggactgcatgcgaagatgagattttcgcatgcggttgggttacccgcacggaaaaatgttgatttgcacagacacgggggtgcatgtgggccgtttagatgcatgcgaaaacccattttgtccgtttgcaaaaaaaaggatttctgtacttgtgtgatcaattaagctatagaaagcttttaaaaagattaatatgattaggtgcgagccacgagcaatgcaatggagacgatgcgggaacttgagatttggtcggcccaagctcatggccgtaaaccggggtagcacactagtgcaaaacaaaattttccaaacgggccaaatatggtttttgcatgcggacctctggcccgtctgcccagaagggtatgcgaaaatccggttttttcatgcgggtgcttatgtcgtccgcacactaccactcgccgttgccacggccatgctcctcccccgaccgcacacccctggccaccttcgccgtgctcccaccagccaccgggcacctgccgggctctgcagccgttgcccctcgtcaccttcgcggcgcacccgctagctgctgttgcccatcgtcgccttcgtcgtgctcccactggccaccgccactggcagagagagagagagagataggagaggagtatgcatgaaatatcctgggcaaaagaaaaagaataagtatgcttcacctatatttcaaagggcatgctaggtaataagctagaaagctaaaagtatcaagtctacagtgcctccacgttcttcaagaaggaaaacctcacaagtgaacggaatactaatgcatatgtcaatgcattacgaggaggagaggagaggagataaagaatgaggtaaggagagagagggggaatgagttgaaaaaaattgaagtgctaaaagagagaatggggaggtaactcagacttctagatggatcttttagtggttcgcatgtgaaaatatattttttcgtgcggccgtttaacatgcctgtctagaaaaacagccctatttatgcccatgtagtagtggcatacaatcaccaggtcactatatatgcatgcatggatctgactctgcaaatcaaatcgggtaattttatcacgtggaaagcttggaaaggaataattgtacgcacttggagcgcgaccgagaacaaagccacgttttccggccgggtgcaaggtcaccctcggcgcctttcctccgcggcggggcggcggccgtccgcgcgcccaacaatatctcgcgcgcgccgcgcggcatggccggcagcaagcaccttttaaatgtttagctaccccacccagagctacctgcagtcggccggccatatgcatacacataaagattaaaaattaaatgtttcacgtaaaatgaagtgataataacgtgtgattaattgagttttaattattacaaacttaaaaaatatattaatctcatattttagaaaaactttcatatagaaagtttttacatgaaacgcatcgttttatagtttaaaaaacgtgctacgagtattcaaaagtttatccaactattgttggagaaaaaaataggcctgtgtgtgtgctttggactcgctttcgctgctggatggtggctttcgcaagcatgcatgcgtaggtacagtagtgtattgagctagctactacagcttttaattttggggtatctatctattatctagctagcttattagatactccatccgttgcataaaagaccaacctagtaccggatgtgacatatcatagtactacgaatctacacatatatatattcagatttatattactaggatatgccatatttggtactagattcgttttttataggacggagggagtagggtgctggctagatatgatagtgctctccaaactccaaaagaagatgtggcaactggcaagctagggagagagagagaggcaggcacaggcttctggaagatcgacgatcaaagcatcggatgcctgcttgcgccggccaagcgcaaccttcgatctcttcggtccttctcagcttctcgatatgcatggtagctcgtatgtaggagtagatctgtctcgttccattaattcttttcctctctctccttttaatctgtgttcgttgaaagactatcttttgcagcgcctttctcttgcagctattgctgtcggcaaattcgttcgtacgtgtaaccaaaggaaatgaaatcgagagagacgactgagatttcatatttgctagctaggcaaagtccaactcacgtctgcacgtgtgatttaattaatttgatgatagttgcagtataggtgcattgtccaactttttttctacttaggtttataagcttttaggtcgatatggttagtgtatacaaccgcgttaccaagctatagctgatgcacaattaaaaagaaatacagatcatttatatgacatatacttcctcttaaaaaaaatcaaacttatagatagaagactatgtttgaggcctaataataaagctttaatgtgagactatgttggagtataagtgaattgcttacccgacttctcttatgcgtcttaaaattttgtttaaactaattggactaattgatatatacaactcaataataactcatcagtttactttctgtttgaaccaactagttcactgaactcaacaataataaagggtttcttggagtaaaacaaaaacgagttaactaggcacttactactgaagtatcctcttttgcatgcagtcaaactgtactggtggctgaccgtctgcggacatgcgcattttcgtatacggatgagttagctaggcgctcgctacaatagaaaccctaggtgtctacaaacatgcgcattttcataagcggatgccctagccgcttacgaagatccattatcacaggcagaccacttaagctggttgcctatgaaaacacacaattgcaggtgaccaagttaagaggcctgcctgcaatagtgattttttcacgtggccgttaattaattggtcatttggaaagattgtgcgttctatataatttaatatttctcgtaattttttaatcaaaatctgaaatgtttttaaaattgtccattttgtagtggctcttttgtactacacataggacctaaccgagagatcgttcttagtacatagtaataagaatcttgcattgacaaataaataggtgcagcatgtaaaatctttgtcacatcccttggatttatcgtataaaagatcctttgctgacttctctaactcctttaaattgtctaaccctcttgttgtacccattagcacttctgattcagtgtgacgcaacatatcctccaagtcaaaataaaccttaaaatcattaatatcaggggagccatcttcgtccatcatatcttgggcaatgtcattaactgtaaaattttctaccacatccattgaaaaacaatcctcttcacctagggattaccatcacctttaggaacagtgatttctccgtgataggtccaaactttgtaattttttcacaaatccgcacttcactaagtgccccttggttgaattgggatctgtccatattttctgattcttacaatcaatgcacgaacaacaaatttccctccaattctcccttaaagaatgtacctcaacctagtcaagaaatttaaaaacttctgacatgtagaatggataagttcttagcgtatcgtacatccacgctctatccaggtgctgtaaatgatcacaatacaaataaattaaactacaagttttttcctccaaacatgaaaatacatgtatcttctcgtaaataaagaaataaaccaattaactagtgcttacaataacaattttgctcatcaaactaatctattttagctaaaatttgcaaaattagctcataaattccaattttataactgcaaattctccgcattgcaccgacgattttttttaaaaaaagcggaaaatggaggaggtaagcaagtatctaaccttgtatatcaatttcaaggaaagatttcaagttcaatatatctccctctatttgttgctttgttttggagagtgaaacttcaggttggaaacacagaagctcgggcaaggagtagtatataggtcgatcatcacatgtgtgcttcttaatggcttgcctatggtaccgcattacacacgcgaacctcttaactgcctgcctgcgataatgtgttaccacaggtgtgctatgaaccatccccgcggaaacaatttttcatgcagacgcaagtacggtcagcctggagcatggagggggccttgtccatgaaaatcaattacgtggtagtgactttatgttaatcctagatacaactatataactgttactgcatattccctaccaatcgttcatttagcatgcctttggttgctaaggttaagcagaattttattttgataacatttgacacaaactacggtttgaactagcaagcatgtatgatattacttgaagtgcggaacatgcctatattctcactaaaatgggttttatttggagggaaaaaaggcatgatagaccaaattaacaccatcgatgattgtcggggttgatcgtctgtactttgtaagtgttctgtattattagagtgctgcatcatcaagattatggtttgaattactttgaagcaggaaaacaaacgcccgcccagcagtttaattggaaaaaaaaacctgaaccgacatatatatgtcatggtttggattgcatcaagaattgttcacgctattgcactggagttaactgggaagaccaggtaattttcatacgaaccggcagaccagagaactacttgactaacaaaaaccatccatcactcaagaatatcgcctggcccgcaaataaatgagaaaaatggtggcgggatgcaaacgtaggtgggtgatttccccgtacatcacctcacaactattgtggactagcaaatatatcacttgtgatagacttggaatatacatgtaaatcgctagaccgtagagttggaccgatggacaggtgaaccgagggttgtgccatgtcaactaccagtccaagcttctgtgctatgtttgaaggggagttgtaacatttattgatccctgcaactactatctcaagtaaaaaatctataaaatagttatttgtccaaaaaggggccttattgtaggaaaccaaccctcaaagacataaactcacgagacatttgtcacagctgcaaattttcttgatgatggcatttataagcgatcacaaatatacatgtacaattgacaaccacataccatctttaacacgaaagattgttggctagtctttttcggctgcctcagctagaatataaccagcccttaagaaattaaatagcaattttgtttctagagaaaacaacagagaggactagctaattaatagaccttagtgtgtgaagaatctcatgccacacaagcgttcaagggtccacatgtacgtccagtcaagtcgccatctacgtacattacttgtgtgctgatttgtcattagtcagtcaagtacaagtctttcccttagttctaaatctataggacggtgcctcccgaggtccaattgtttcttgtcctttccactaatttaatttcctgtttaactaattaaattttcagaaacgttgtcgagcatcagtggtactatatatacgtggcaatatgtatatccaggttcatttttagtttggcaatatatatcagtcgtgtccatggtaggcactatgtacaaacctaattagggactggtggccataatttggtaggcacaattagacaagccacctcctcttgatgttggtaggccaccctttcttactcactgaa

SEQ ID NO: 53370 - DNA, 4250 bp, Oryza sativa
ctaaataatgccttacatgtattttgggcacattatagtagtgaaacatatctacatataaatttaggaaatatatctgaaatgtgactgaatcgtctttagtgtaaaagtattattgacaatgtttgaagtgcttctgaaaattttcctgtgtgtctacaaaagtcttttattgtagcatagtcaaatatatattgggaaaattttaaacgacgggaaatttgtaggagtgcatacctttgcatattgtgactagaatttacttttcaaataatatatcgttgagcttaaatacacaaatacacaatagctttccctttaaggctaattttgtaagcttacctgttagtttttatttgatggtatgttggtgccattcatggcatgaataataaaatcttttcatggcatgaataataaaatcttaggaaaaggggttttcctagctattattcccaagcaaccgataaaacatatttttcccaataataatttgtcagacatttagcaatttttgtgtctattcctatggatatttcatagatggtttttcgccatacaagtcactatgatactcatacaaacattttgctagagattcagactaatggtggcagtgaaaatagttgtggaggcatgaccgcactgaaatcatcctataaagttgcagaaagacctatatagtatttgcaacctcttttattgcaggacaccaatggctgaaaatttggtcactccttagaaaaatatgtgcacatgtactataggcacctccaaaccattgttattgaattgtgtagccaaatagttctattttttcccccaaagactcctcaactcaactaacaagagcatgatgaaataaaactcaaatcatatccactacatggcacatgcaatccattttactctaaaagaactaatcgattgaagatgttattgtcaattaatttttatgttagatatcgaagaaatcccaggatcaagctgagctcatatctatttcaacaaaggaatcaaaccaaggttcgttcaggttcaccgatgagcgcgtgccaacccacagattcaccttcatcccgtctcattaattaactaattaaataaactaaatgttacttctcaacaaactctcatggatcagcttgatcacactcacctcgatctagtcatgattgatggatccatattgatttcgcggccgggccatacagtccatgtgaaatcatggaaatatcgttattggtaatctgtgatgatccagacaaacacatttgccaccaccacaaattgcctggaaagagcaaggccacatgtatgtacatgatattgtccatctttttcttcctttgagccaagagaataacacatacatagctgtttttgaagtctttttcaaaggaagaaaatggtttgcatgtatatattgatgtgccatattgcatatccccaagcacaatgcaacattgcacgattgcgatgagcactacctcccagccgtggctcctccaaaaaaaataataattgtttctaattggggaaagagagaatttttttttgacaagacatggttctactgatcaaagggtgataggtgtggttttaaacattaattgtggttatctcctcaagtctaggtagggaattaattaaggatgcgctcacataaatattaattcatgtagatacatggaaaagtgcgacatatatatttacgactgatcataataatgaaaatgatcttgaatatagtcatgggttcgtacacatacttgtttgttctgtgtgttaggaattaatatgttgaacaatcacacaaatctcccacatacgtcttacacatatgtagtcactttaatttgtatctcccaaaacatggtccctaagtagctaattaatttacttgtgtactcttagtcgtagatgatattgtttttcaaccaaatgatatcgatcgatggcacacaaactaagattacatttgagaggtttggcacaccgacaatgacacgggagaatataacatatgtggtgcatgcctttttgtttcctggctcgacgcatctcgatcggccgggcacgtcgatatcgacccactctctaggtctcgaaatcattgatatgatgaacggcttctccggtacacataggtctgcatcgacgtagagcactctcatggtcgttactccttcagaaaacatgatttgtttttctctttagtgggtagggcagattgtgttatatatgttcggagttgagggggtaattcgtactttagcgatagtttgatggaggtaaatcagacaaaccttttattaaatattaattaagtttagggggtatatataggttatatcttctccaatcaattcagatgttctcgaaaatggatgcgtgggtcttaagaagaagtcaactcctcatgcgaaatatatatatatgtcgtccagtattataataatgttgttattattacatgaatataatattcactggtggagaaactcttggtagtcccggtttgtaaccccttttttcccggtttccaaaccgggagtaccaatccgggactaaagatcgctatctttagtcccgggttaaataaccggctacgtggctgagccatctttagtcccggttagtgttaccaaccgggactaaagatcgagctgaccttttttttttttgcatggccctgttgctgcatggtttatatatatatatataaaccatgcatatatatatttttatacatatatatatatatatatatatatatatatatatatatatatatatatatatatatatatatatatatatatatatatatatatatatatatatatattatatgtatatatggttcagtacatatgtacatacataatatatatgtatttatatatatatatatatatatatgttatgcaaatgcatatgtgtgtgtgtatatatatatatatatatatatatatatatatgaccaaaatatatttacattatagaaaatgtagtcatgtattaattacaatctattatatgtcctagctagctatgatttcgacgtagtagtagtactcgctgctagctcagaagctaggaccggtgaattgtgtttctgtcgtagtagaattcaccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgttatgtaatgaaattttgaatttatttgtacatacatcgagctctcttggggtgatgatttggtctgcaaggcagtggcaatactcgcacacgtagtagccgcacaagttagttccctgcttttgctttgcgcactacaaataaatgacaaattaacggcatgagatctaattaatatacacttgtatgtattaatttgaattggagaaatataaatgtagagcatgtgtactcacaggaaatttgaacctccgcctaagtctttctctccagttgccgcagaccaaatgacggaaccgataccaagccctacatagagtttaaagatatgattcgtagtagaaataattaacataacaagaatttcttaattaacagaggaacttatgccagtacctgtatataagttcgaaaaccttgttaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattaaactaattctgtgttgtacggcaacagtatgaacgtcttgtaatgctgcgccttcagaagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtattttattttatatagtttacttatatacaaggacctaattaattaaaggagacgtagtaattaagaaatataactgagcgatatacttacaaaatccagcaactcataatagagacgtcgagggcgtccagctggtatacttcgtagattctcttgaaattgatcc

SEQ ID NO: 53371 - DNA, 1483 bp, Oryza sativa
cagaagatgctttcttcagcgttcgctcatagtccgatagcttgatggcctccttgacaggtgcagacatacccctgaagaagttcctgacactggggtctataggaatcttcttttctagacttcgaggcttgaattgtctcttgacttctgatgcaacgtaagcgtcaagctcctcttgcgtgcaatcgtaccccgggtccttgttcttggcggcatcaattttcgccttcttcgttgcccttgtgtgggcaggcggtggagctgggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcacgagacgctgcttgtcgcccagggaggatgatgtaccgcctacgccatagaataatggcatggcttgtgtctcgtagatgcgtctcaccatcttctccagggtaatccagctcgaggttctcgtacgcgccttcgaccaacttaacttcgaccttcgagtatcttgctggaatcgacctgcagtggtaagtacctgaagggtccgttgggatggccatgcccgacgccaccttcatgttgtgagagattatttattagtaatcaacatatataagcagcaactagcggaatggctaaatctagaatatataaactacgagcttacctttattgataagttcttgtaaggaatatgcagctcacatggtgttcgttgagtgatgtcatcaacgagacaggtcgattcgtcctgtatttgcatggcatccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgctgagttcgtagctcgatacccggaaatctagatctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtccggtcggaacgtgccatgagaggaggcttccactgcatctgttagtcatcgcgcagcctctcgtatctgatcgccgaagaccagtgagccatcagctgggttgagcgttccaccgtgagcatagtaccagaacttcgatcgttccggccaattggcagctaccggttcgatacccctctcaatcaagctagccttcatctcctcccacttcggcatcacgacgctatagcctcctgaccccaag

SEQ ID NO: 53372 - DNA, 771 bp, Oryza sativa
  unsure (1)..(771): unsure at all n locations
cgggcccnttagangtacantctancttggnacccccccgagcgggcgaggagcgcggcgcggccccgcttgagggcggggtcgtagtagtcgttgaagttgtccagcccaagcacgccgtccccccgccggcggagggcggcggccgcgtgcagccgacgaagcccgcggcgcccgtgacgaggacggtgagcccccgcccgttggcccgcctgacgcgcgcggacgcccgcaccttcttctcccatgcggcgccgccccacgtggcggcggcggacggggaggacgtgtggagggagcggcgcggggagtcgggcgccgcccgcggggccggcgcggtggagggggagaggaggaggaaggcgaggaggagcgagagggagcatacggaccataaggcgagcttggagaggagcgaggtcggcgaggggtggtggtggctcgtggcgaggcggtggtggtggaagtggtggaactgcgggttgacggactccgtgccgcccgccgtccccggcgtgtcgggcgcgccggtcagcttgtgcgccatctgccgatctgccgtaatgtggattgagcttctcgtcggatcttgctaatttgggtggggttggggagagagatatgtgggcggggggggcttttctttccttttttaacctctttatttaaattaaaccccatcccttcttctgggttaacaaggccggtgctctttttgttggttttcctatctgacccgtaacaattttatggtcccggttctatttttct

SEQ ID NO: 53373 - DNA, 21810 bp, Oryza sativa
  unsure (1)..(21810): unsure at all n locations
gcactaatatctctatccatcaagaaaggaccggatcgaaccttattggaccgcgagagcggcacgtggtagtcgtcgtcatcgtcgccgctgtcgtcctcgtccttcttggccttggaggcacccgcattgcccgccttcttggcccgagaaaccgcgagcggcacgttgtcctcttcatcgtcatcctcgtcttcctcctcctcctctttatacttgggggcggccgcaccgctcgctttcttccttccccgggcatgcgagagcggcacgaaatcgtcttcatcgtcgtcttcttccaccaccttcgggcgcctctggaccgctgcggcgccagcggaagcggcggcggcggcgtcttctccggccatcgctagggtgggggcgagggttttcggatttttcgcggctggaattgggggagaagcgagaccgcaaggccgagcgtgacgaggagacccctggctttacgggtatttgggctcagaacgctcaagctgctactttattgggctgcattctgtttaggtcctacacgaagcgttaggtaacatgggcctctcctgggaaagttctcccactagttacccttgtggcccatatccggatatgctttcatcaaaaggaataagttttgactcccttgactggtggtcgaatctaatccctattcatgatatcttgagccttaactattaaaaccgatattatttgactcccatgacgggtttggaggacggtttcattaacataacacctacgtgcagtgttgacttggtctttgcacaacgtgggatttatatagcattaaaactagaaaaaaatgtgggatccatatatcattcaaaaatattgggggacccactgacatgtgggtcccacaatcattcttcacagcttcacttattgttcctccctgtctatcccctctgtctctcctttcgacagaaccaaggctcatcggcggtggtggtggcggcgagcgggcaagagctcgggacggcagcaccatctctcccctctcccttctccaccctaggcgatagcctcggacggtggcggcgttgtcgacggagtagatcgcgaccacgatatttacagagtatggggatcgttggtaccatggtatatgcgagattgagataaaagagacggagacaaggattttatacatgttcgggccccttatccgtaagataatagccctactccagttggtcgaagccagtgttactcttattcatcaaaatcatacaagtacaatatttctgataacctatctagtcatcatcgacttagcggcatggaacaccacacatagtcaacgacgaggtagtcttcatcctcgaatacaaactcggcgagatcagacatagcgctagatccctcttgtcggcctctgtggcaccagattgggtatgtctaggcttatctctgatatcgatgtctggcggtgtgtattggtgtctattctgactgagcctcccctctcctcctaaggggtcttgtatttatacccccagatatcccctagtccaaatagaactagggagacaattatggatacaatccgagtaatccttataatttccatgcaggactctccttctacttccttatttgggaataccttccgtatatgaggcatgactccatatagacttggtatatggtggaccccgcagagcctaacccaaaatcattaggtatgtcttatccataacacttacgagcgcttcgcaggtggtggcgggtgggggctggagtagtggtggcgcgccccatggctggcggcaatggccgcagccgaggaggttagagacgagaagagtgacggcgacgggcgggcgagagctcggcggtgccacctctcccctctcccctctcccttctccacccccgacgatagcctcggacgacagcggaggtagaggagtagctcagcggtgttgcgaccagccgagtcacgagtcgacagcggagagcacctagccgagtgctctggggcaagacgatagtcgatagagacagcgatgacggggcaagtggcgacgagatcgttgaggcggaggtacgcagatgacgcgaccgacccaatcacgaaccctcgccatggaagtacacgaccacagggagcctctcatccccaccactagcgacagcggcgccgggctgagaggtagagtcgcagatttcctcccctctctctctctctccaacccttcttcctcctcactttcgctcccttatctatctatctctttctctctctctctcttcccctttgaccgggagtggggtatcgtggcgcaagcggaagaacgtggcggcgcggggtcataaggaggaggcgggaggtgatgtttgcacgccgcgcagcaaagacctcccgttcctcctgcaagatacgggccgcggagcccgagaggcggaactaggggtggttgtgcttcgccccgactgactccacgaaggcggcgggtaaccgtcgcaggaaggagatgacgtggtggtcgggggccttgagcgagaggcgcagcttggagaccacgaagatgggggtcggcgacgacgagaggaggccggccagcaacacgagtgaccggaggtcccgcgcctaggacagcatggggacggcgtcgaataacgtgtcctttccacaattccattgcatcttcacatccacacatgccatagatcagacgagcacaacgaggcgagctgtcgccgctcctgccgtcactgcctgccgccgcctgaaggggaagagaatggggagagaaagagagagaagggaaagagaaagggaggagaaagaagggaaagagagggagatggatgatatgttgggccacatgttcagtgggtcccatatattttttttgtgtgagtgataaataggtcccatatatatgtttttaattctaatgccacctaattgccacgtcaatgtcacgtgggatgaagaccaggtcaacactgccacgtaggcaccacgtcagcgaaatcgtctttcaaaaccgccgagggagtcaaattgcatcggttttaataattgaagggtcaaaatatccggtattatggtttagggatatgaatcagatttaaccattagttaagggagttaaagtgaacttattccccatcaaaatcaataaaatgttgaaccatactggcacagtccagcaaagtttcgtatccagataataacatctcaaaaataaaattcttttttgagcggtcaaaaaaaaatctagtatatgccaaccagctacaatactcctatatcatttgactgaggaagtggattcttggtgatgtggtcaagcattccccttagagcatcaccaacagtctatctattccattcccaatcctaattttttaggattttggttaaaaaaaatttggggcaacagattcccaaaagagctccggacgttttggagttcccatctccagttttctaggtgcatgtatttgagggcgagagaatgactctcaattctctttcccacgcgtttctcctctccttccccacgcgtgggcggcgtcaaggcaggtcgcgcgtgggagattgcgatctcctgcgcacgggaaaggaaaaacaaaactagaatttctattggaaatttaacataagaacccacttttcgtttttggaataaatttaggctatcttttgaagggaggggttttttcatcacctattttcagttcagaatacccaaaaattaatttttagagatagattattggtggactattggtgatgctatttaggcttgtagagttgtaggcaatgaaaggcactctgttgtgttgcaggtgcagaagatccggagctgagtctcgctttccctcacctttactcctttaggccaaaattaagggctgagcttaattagcgtgatccacaatctggcattcgattattgggctgccgcgcgagcccccaccagccgtgtcgtctgttgactactgagatggctctccccccttaatttacgtgtctttccctccacttcacacgttgctatccacggcggattccaaacgtgaaccgctctcaaaccggtttgatgacttgatgtcgtcgtttcattggtcaagaaactgctctgcaacgtctaattaaattcgcacagcgagtcagtgacagtgtgacacagacgttctctgcttccacctctagtacgtttctactctacccgccgctccgcggccgcgcgagtccaccgttccgctccacgcgcgcgcgagccctcgattcgtcacgcacacgcgcccgcgaataacccatttcatcatctcctcgcgcccgcgcgcgcggtggccactagcccaccactaccactacgcgctggtagttacccgcccctatcaccccgcgcctcggcctcgctcgctttcccctacttccagcgatttcatcaagaaccacctagcgagagcgagaccgagcgagagagagagagcacggcggcgatggcgtaccagaggggggagacgtcgtcggtggtggaggcgttcacgctgtcgccgctgccgtacccggtgatcctgatcctgctcatggtgatgctgctgctgggggtgtcgtggttcttcacgtacgaggacttcatggaggaggcggcggagcagctcagctgggcgctgctgctcgtccccgtcgcgctcgtcctcctcatccgctggatctcctccgtcgacaccttcgacggctacttcagcttctacccaaccgagcgccgctggaaccgctacgacccgggccccgccgaggggagctccccatggggcgtcgccatggtcgtcctgctcctcctcgtcctcgcctccttccactccaccttccaggacatgtggaagccctgatcattgattctactgctactcgtcgtctttgatatccgcacgcctattatgcgtacgtacgtggggttatacgctgcttgatttgcttgccggttagtaactagctagttatgcatctgtacatataccgagcttgagactgttaactcttgttttgtaattaacgcgtctggtttttgttcgggatcgagtttgttttctctgttcatccatccgtttcttcttctcttgtttgttgttcactcgtcgactcaaatattctttccctccctgttgaacgtgtgagattcttttcttttctttgccagatgattgatgctgctctcttcggcatgaagggatgcatctattccgttctgaaggcctcgatccttccttcaaaaacttgggtgacgattggtaggatcgagctgcaaccatactataactacaagaatcagtgaagagactacagatatatgataaatgcagacagtgcagagttcttttagatgaggctagagagttcgaacgcagggcaatcatcgcacttgttcgaacgttcgtttatctttctgcttggcctgcacatttttttagagatagaggctgtccaaagtttggatctaaacttcaatccttttttatcatatcaacctgtcatatatatacaattttcagtcacatcatttccaattttaatcaaaatctaaactttgcgctgaactaaacacagcaagagtataggttatttcctcaaggaaaaaaaagagagcataggctagggtaggattttgagagtcgagagctatgtatgatgtatctcctcagcccacgcttgtcgtgttgtccatcgtgtgctagcaagacgcggatgccgctttgacaaagcatggaggaagacaaaggcagggggtggttgggccgtccatatattgccgctgctgccgtcgtcgtcgtggcgtaattcaatccgatgcacgaaacctgcagcaatcagctgtacgtgccgcgacgtgcatacacgtacaccggaattggcgattcatacgagcgtattaacactgcccaaccaaccaccctttgctaattctcatcccgtccaggcggcgtgccggtccatgccgtcgtttatcatgccgatgccggccatcgtgcgtgtcatgcgttccggcgttttctcctgcactcgatcgtagtttggtgcgaatcaacgtgctgtacgtatagtcgatcgaaatcgtcgatcagttagccggtgcccgatgggcgatggcccatcgcgttgctattgccccgtgaaaatgacctcatctggcagcaggaatctcccgtacccgccggtgtccatcgatctgtctcctgtcaatcctgtgcgtgtccatcgaaacgtctgctgaaacagcgacggttttagcagagatactacgggtcgggtatgtttagttcacgctaaaattaaaaatttggttaaaattgagacgttgtgacgaaaaaattagaaatttatatgtgtataaaagttttgatgtgatgaaaaagttgaaagttttttaaaaataatttggaactaaacaaagcctacctccggacccggcctcgagagtcgagcaggtaccattgcctgtcagtgacgcggaccggaaggagaaagacgatgagcgatcgatcgatcgatcgagcagctagagggctagagctcatcatcagcgagcgccacgccgcgggcgcctgcatcaaacagcagcatatgtaagcctggatcggttgcccacttggaatgattcggagagagcaagcaaggggagcacgacaatgatgtggtgtccaccaaacacggtaattagggcaggctttttgccaaaagggctccggttcggttgttgccatgtcttcgcgaatcttttgggccgtctcggcctttttaattttctactatctctcatacagggtagtatgcctttggtggatgcttcatgtcatgctttcttttgacgaagccgcgtgcgcctgaccgacagtagtatgcatgtagccaaggaggactcttttattcgttgatgggaagtacaggattcctcgattgcgatcagcagcttacttgcggcaaacggaagaagcgtgccaaggaggcagcaactaaccggccgcaccaacttcttaccgctctttggctgaaaatttgacattttgacacttttgtacaacatattttacagctagatcgtggtaaaaaatttaacaaaaataacccttcatctcagtgtcaaatcccgaggcgccgaggtccaccatgtcaaccctaggtgtcttagcgctgagcatccaccgtcaaatgttcttataaaaccaaagaccttctgttctaagcatgatacaatggttttggtacttcttgtgtttctacacactgcaaagattcgaactttgggttaaaagcacgataaatggcaggagctaccaccgcatccgcaccaagctcatttccatcggaatcgctaattcgcgtgagcgccagcggcgcgcgtttcgggagcagaaggcccagcgccggcccgctggcgcgcgccgcctcctcccacgcttttcttttcatttttttaccgattttttttttcgttttttcttttcaccttttttattattatttttaatctttttaagtatgttttgagtttgaaagtttttaaattttgagttgaaattttttcaaatttgaacttgaaagtttttaaatctcgacttgaaagttttcaaatcttgatttaaaagtttttcaaaattttcaaatctggacttgaaagttttcgaatctcgagttgaaaattttcaaacctcaaattggaagttttcaaaattttcaaatctggacttgaaagttttcgaatctgagttgaaagttttcaaatctcgagttaaaagttttcaaatctgagttgaaaattttcaaaatttgactttaaaatttaaaacttaaatcaaaagttttcgaatctaacttaaaaattttcaatctgttagtaaaaaaatttccaaaaaattctctagaatcttttctaatttctataattagtgttaagtatatattaactaatagatatgtaattaaggcttaagaggggggaggggagtgctcgctagcagcgcttacagctaggagccccccatttatttaatccgtggaagcagcgccaacaatctcgtcgttaaaccgttgaagttcagtgttaggtaacctgctgttgacaagttcgtccttagcacctaacttcttggcgatgtttggtctattttttaatatagttaccacagtttaattataaaataagttctataaaagggttaaaatgtcaaaattgctctttggagcgtttgccggtgttggattaagagttcagctaaccagtccgtaccacaaaatcgaaccggttcagctatcagatcttgcgttctactactagcccttcagtaaaaatcggatcaatttacccctactgcaaattcaagccggttgcattgcattctctaaattaaaacatcgttaccgcccggtcttatcatattttcagagccgataatagggtaaaagtcagcaactagtgggcttcttagaatggtcctttcaagcagtctgctcttagtatagtaccaccatgcatgcaccattctctgctttctgcattctactacgtgccaagagacaacgttccacgtatcacataggagataaacgtaattttgtttttcgcgagtgttgtggagataaaatcttgtccacaatactcatgcatgatatgatcctaagaatctgtactagcatatatgggtttctcaaagaaaaactgtagcagatgtgtttttctgagaaaattaaggccctcatcgtttggccaattacatataattaatatgttatttggcgtattagcaaaattataacaaattatatataagactttcatatatgtgtttttagcaacttaaatactgataccaaaaataaattttgatgaaaaaacttcaaaatcaactttaaaattaaatttgaaaagtcaaattttggaagcggctgatgttgtacggagaaaaggaagggggcctaattctgttgtggatgtgtcatgaaaaactgtacatactgtcatcgtaaacatgactatcagctaggacgaatgacacatgccaatcaccctctatttgaaaatataagtatatctagtatataaaatttatctccatgtgatattttcatcgcacgtaaaacgaaaaaactcattagcataggattaattaagtattaactattataaaattggaaaatagattatttatttgattttttaaaataacttctacatataaatttttttgtcaaaaacatatcatttaatcccttatccttatgcctatcatccaaaatttaaattttcaaccttaaatttggagttgattttaaattttttttcatcgaagtttatttttcaacttttgcttttagatcgttaagagcacatatataaaaatttttattcataaactattttttgtttgtaaatatgttatttgacttattttctgaataagcgaaacgattggaacaaattgaagtttatagttgagaaaaggaaccgcacctaagcaatacctggcccacacctttaataccttttcagtgtatatgttatgttgtaaaccgttggatcacagccactcgatggatatcaggcattcccaagcattctactccctccgtccaaaaaaaaaaaggcaaaccctgagttttcgtgtccaactttgattgtccgtcttatatgaagtttttttataattcgtattttcattgttgttagatgataaaatatgattaatattttatacgtgacttgcttttttaatttttttcataattttttcaaataagacgaacggtaaaacattaggcacggaaactagggtttttcttttttttggacggagggagtaaacatcttaccggccggtcttatcagaataatagcagtgtttgtatgcacttgtactactcacatgacataggcgataaattaattttgtttttcgcgaatgtcgtgcagataaaatctagtccataatactcatgcatgatataatctaaaaatctctagcatatgtgtttctcgaagaaaactgtagcagatgtgtttctctaagaataatctgttgtggctgtgtctaagagatgcagacaagtcatcaagaaaggcaaattaacgtgcaacgtgctggctagaccgccagagtactagtactacctctgttctaaaataagtgtagccgtaggtatccatattcaatgtttggtcgttgtcttacttaaaaaaaatgaaatttcttttttaaaaaataattacagataaaaaactattcatattttaccatctaataataaaaaaaatactaatcataaaataattgttaataaaataatttttaataagacgaacggttaaatgttggaaatgaataatataaaattgaacttatctgaaggtggagggagtattatatagcacagagtaccccgcacggacaagtcagctagcccgacgtatcgttttaatttgcaccacaatggcattcttcctggtggcatgtctgccatgggtttgtttcatcctcctctccctgtacgtcttccagttgttcgccgatgcgcgccgccgccttccacccggcccatggccgccgaagcctctcatcggcgacctccttgcccttgggaagggcgaccagcagcaccgctccctcgcgcgcctcgctgaccgctacggccccgtcatgtcgctccgcctcggcacggtcctcaccgtcgtcgtctcgacgccggacgccatgcgcgagatcttccacaagaacaaggataacctcgcgggccggcccaccgccgacgcctttaacgccatggggcacagcgccaactccctcctcgggctggagcacccgggcgtcaggtggcgcgccatccggaggttctccaccgcggagctgctcgcgctcagtcggctcgccgagctgcagcccatgtaaggcacaaggtagagacctcgtcctgggcgtttcagagctcacgacgcgcgtctagccagtgcacgtcaggcgtgtcgcgctcagcatagcgttgaaattaaagtgtagcgccatctactcagtcgacttggcccgcgaatggacgaccgtgttcaggtcgagtggtgaaagaggccatgctactgatcggcgcggcaaaccttagggacctcttctcggcgatcgccgcccactacatacagggcgaccgtagcagggtaccggaactgttctccatcacgtaccgccaagacgaatagcaggttgcgcgtcccaggccagatcggatcgccggcaagactggcaagagcaacttgctaaacgtggtgctcgacatggagcgcgagtggcaacacaagggctccgtactaagccacgacgcaatgagagtattatttaccgtacgcacccgtcatttctatgatcacctttataatcgtacgtgggtagaagaaaggccgagtttacttccaactttttaactttttcatcacatcaaaacttttctacacacaaatttttaatttttctgttgcatcgttccattttcaaccaaaatctcaattttggcgtaaactaaacacacctaaagcctgcatgttttacatgttgatccttttataaaaaacttatatttcataaatatactttgagtaaaacttattttaatgatagacctaaaactagatgctagagccattgatatgatgatatcaagtatcaacatgtcgatgccaaggaggctatggtgtctatagcgtcgacacctggcactcattgcagccccaccgccatggctgctaaagtgtttggaggtcggctccatggctatgggcatcaggaaaagtgctacgcttaagtgctaaagtattatacataccactgttttttaatataggccacaattgattttttttaagttacttgacttctcatcatttatatagatatttatgaaaatagacaaaccatgctgctattgtaaaatactccctacgtcccaaaaaatacaacttcttcattttctttaaatataacaacctaggagatatgagttaacgtttatcactaaactagtctggtccgacactacacccatcccagacgacaaacaagtttttttttacaactctatctaatagctatgctaagagctaaaaaaaacagtactatattatggggaggatggggtaattttgatgataaatttagtgatacccttttcacttaactaagtaattgaataaatgttgtaggtcaaagtttgagaaaaaaaatcaaccatgtcatatattaaagcggaagtagtactccaaatttgatttcaggcacccatatgttatagaaagaggttagtgccaatattcctagcacctaacatctagacattcagcgtcgacaccactatggtaccataatgttatttggtactcctccgtttcaaaatttatcttaaaatatataagctttctcaaccaaataaatttctacatattttctaggaatccttatattttggatgacacgagtagtatttattatatgattggcatgttaatgattttctcgttttctcaattaaagtgagaatttatatggattcttttattactttggtgtatccaacggatacgctattaatagcgtaactagccaaatattcatacgttgcaagaaaatattgaaaatagcaaacaaaatctttgttgaaaaatatattattagttggttgaaataggatattttatttttaaaagacaaaaaaataccgtacttagaaaattaaagtgtcatggcctttccctcaaaaaaaagaaaagtgtcacggcctgcagcgagcaagcaaggcgagtattcaactatttatcacccgtatgtcaggatcctggtggtggcggacttgacaacatcactattcactactgccttttaccttttaatagtagtatataatactagttagtatagatatttctttactaattgaaagcgctcgtgtaagttttctcagtttttaatgggtgaatagctaatttagtccctcaagttttaccgaaggctcactttgatccttcaggttttattttattcacataggtcctttaagtatttgttttggccaaaaatcatcattgggcccacttaatatgccatatggctatttttagtcatcaattctattagaaaatatctcttttgcccttaacttgtatacaactatacactagaaaaaagaaaaccaaaatgaataaacaacattacatatgtacttcccattatttcaacatgtgcacatgaaaattgagcctaatggctatcgtatacacttgcaagtacataatttatttttgttttatctataaaaagaattcattacatgcaattttttctcttatatatatgtgaatgagggggtataagtgtcatttatcaaaagagttgttagttatgtgggttcaagtataaatttgaattaaaataaaaacttaaaggactaatatggacacattgaaacattaagtactaaactgatccttgcatgaaacttggaggaccactttaactattcacccgtttttaatcctagatgggtaaaagggctagaggtctccatcgttttctctatacagcatcagttgctgccaaaattaaattttcaaacccaattttgaagttgattttggagttttttttatcaaagtttatattttacattagcatttaagtcgctaagataaaagtcttacctataaattactattgttttgctaatacgttgaattgtttattatccgtatttggctaaacgatggggtataattagtgtatcgtatggttgctctaattaatatgtgagagttccatgcattcgaattttacataaatgtttggagtccatgacataaccaacaagagaataactaaaccaacgtgcgctatatattgagatagagtccggattggtcacataaagttattttaaaaatgtctacacatgtatatatactgcttcgtacgtactcccttcataaaaacaaactcaacttaaatggagatgtgactcattctagtaaaacaaatatggacaataggccgttttggtttgataccaaaacgttgccatactaattttttggtagtttaaatagtaaatgtgatgatttggtttgaagccaaatatttggtaatgcctatactcaatttggcacaattctagaatgttcttcaccacaatttgaaatttggctctcaattggcatcaatccaaagacatttatttataattctaccctaccaaaatattggtagtgccaaactaccaatatattggtaggtactaaaccaaacaagaccaatattctattcagatttattgtattaggattaatcacatatccacttatgttaaattcttttgggacgaaaggagaatctagcgagcatagttagaatgatatatggtttttaaatacatacacttaacaaacacaataacagagaaccttaaaatcccgtatattcctatattagaaattatttgaaaaattaaagcatgttatccaagcgaatacaaaggttgatgactagttccatctaatataaattgcatatctgaatttaaccaatataatctcaggatttatacggtgctggagccagtacgacctcggtattaatcgagtgggcaatagcagatctactgcaaaatccagagtcaatgcgaaagataaaggaggagatcacaaatgtcattggcacgaatgcacagatccaagaatttgacatcgcccggctcccatatcttcaggccgttgtgaaagaaacccttcgtcttcgtgctgttgcgccattggtgcctcgcagagccgaggcaacgatagaggtccagggcttcaccattcctaaaggcaccaacgtaattctgaacttatgggctatcaaccgagatgctagggcatggaatgacccggataaattcatgcccgagagattcatcggcaatgacatcaattatctgggacaaaattttcagtttgttccatttggtgttggacgacgcatttgccttggattgccactagcacaaaaagtgatgtaccttgttctggggacactggtgcatcagtttgaatggacccttcctgaagagctcaaggagactggtatagacatgacagaaaaatgtggaatggtgctatgtctcgcaaaccccctcaaagtcatggctaagaaaatgtagtgaaacacttcagtgaagtattcaagagtaagcacatttgccaaaattgatatgacaccatgtgatcgagcatatgtactgttattagctgtggaaagtaagtgtgtgtatgaataatgccgtaggtgtgtgtatatgttcagtacttgtgtaacacaggagtacaaattcagatatatatctgaagagttctgtgggtactgggtaagtaaattggctggacccttgtagagggctagctcccaatatctagttcagttgaacataataaactcaatgcttgtaaaatagaaggtaaagtgaatgtattacttacgaataaatatgttgcaaaactatgcattatttgaaactcgcaatcaaaaagcaaaaataaaaatgggaccggctaatgattaagtcattagttgaagtacatattcctctatgatgttgagcgactcatacgattcctatatgaaaataccctggagactaatccactgaaatatcggaaatgcatgttagtaaagagcataatgttggacaaatacgaaggcgagtaacggtaatcacacacaaccacttattcagaatatgacaattaagctggagggtccaaacagttcaatgattgttcatctaatctgaaggctaagtatctatcagaaattgagtgggacacagcacaaaattctcaagaaagacaaccgcaaattctttggcggagaaaacgattgttcagcttaattgtcatattctgaatagagatttgctccggtctaataaaaagtacctcgaggtactggtacctcgaggtaatttttgttggacggaacaaatctcatctgaaaaacaattttcttcggtaaacagacattcaagcctctcatgagccaattaaggtgatctgacgactgaagttaccacaaatctctttcacacttctgtagtccaatagtgatatgttggctttgtaatggccacatatttcagcaattttattcattcctgggacgtcattatgtacactctacgtggtaaaaactaagattaactgctacatcatgggcacttggaattgccctggctgctcttcaaattgttgtagcatgggcactcttccttgttcccggacgtgccggatggaacgcacaagcatttctggcagcagatattgcagtacttgaggcatggttcctggcgctttgttgccgagcaacggtagtcgcatttctgtgggcattctgctcatacatcgaaggagagaaaattcagaattaaaagtaaaaggtaactaacattcttgacattttatatgagatggtacaagaagatatgaagccttccaaagagtctgttagttgagggaacgggaaattgcaatatttcataccttctatggagacagaaccttctgcaccaacctacattacaaaaaccataaattaaatcatcagaaaactaccagaagtccagcactcagaaaatactgatgttaataacttactggtcggtaaaagcctccattcgtgctccctgaaacttcagcctgaaagatatgaacacatctatattgtcaatatatatcttgggattgggaaaaaaatggtttttcacttcaaagaagctaaaagagaggatgtaggttaccacaaaagctaacgcgagcaagaggaaaatggtggagaaaaaacgagccatttcttcttcttactacttactggcttactgcagaagtggagagtgattcttgtgagaaactctgtcttcttaccggcatatatatactgtctagctgagcgatctctggcatatggaacgtccatagaaggacctgctaacggatggataaagaaaccgaaaatttaaacgggggttttcaaaacaaatttaagatgatagtaattgtacaaataaattaattggcaccacctcagattatcaacagagtaattgtccaccttaaaggcctgctaaatgctaatggatatatacagaaactgaacaaacggtagatctgaacaacaaatttaaattatagtaattgtctaaataaaataattgatcatttccaaattaattgcccacagtgtgattagtgtgaactttttatgtctaatttacctgctgatgaagagatttacaaatcaatacttagcggcttaccaggcacttaatgctttggggcgctaaaaacagtcttctaaaatgcaaattctattggagagtttgggcgcttattctaaaattctactatgcacttatttggagagtttgggcgctggaaaaatgcaaattccacacatggctagtcatctaaaacagggtctggacctccgaccagctcacgactagagtatggcaaaataatggactttgcgccctctgccatagagaagtcgaaacggctctgcatcttgttgtcagctgcaggtacatgaaaaaaaatatgaagcctgatagctgtctaggtgtcttaccaacagcttgacactagacaatgggagacgactcagaccgtaaaagcctggtgggaggctctaacaaacatggtagaagttccaaaaaggaggatacgcactctcatcctacttgtcgtttgggagatctagaaggaaaggaaccaatgaatcttcaagcataacgatgctatgttgtcagtcctttttgccaaaatcaaggaagaggggcggacatgggcaatggcaggagcaaggcgcttacatgatatttgccctactctatatagtgtactccctccgtactcgtaaaggaagtcgtttaggataatatttaagtcaaaccttgtaaatataattcatgaataactctcaagtcgttgagtttgaaaatgtaaaaattatatgaatagatttgtcttgaaaaatacttttttaaaagtatacacatcacttttcaataaatatttttatagaaacaagaagtcaaagttgtgttttggagactgtgtcgctgtccaaaacgacttcctttacgagtacggagggagtatagagcttttccccttttcttaacctaagggttatatttttctcctgccatatttaatgaaaaggcacagtctcatgatgttttccctttaaaaaaaggagatttacaaatgcacaaagtaaaaaatatatatgaattcaggagtctcatgatgttttccctttaaaaaaaggagatttacaaatgcacaaagtaaaaaatatatatgaattcaggaaacaactttcatctctataactcaaactttttaatccccgttgaagtatttttcaggacattaaaatgaaacatactccctccgttttttaatagatgacgccgttgactttttctcacatgtttgaccattcgtcttattcaaaaaatttatgcaaatgtataagatataaatcacacttaaagtactatgagtaataaaacaactcataacaaaataaattataattacgtaaattttttgaataagacgaatggtcaaacatgtgagaaaaaatcaacggcgtcatctattaaaaaacggaggtagtattcacattcagcatgtactgaactaaaatttgagagctccaacaaaaacaataaatatatcaaatttcaacaagagctgaagcaacaatttactatctagatttcagcacatttaactcaaatttcaaaataatctcaagccagaatttgccaaattgcggatatatctttgacttcccccaaatccacccacctgctccccaattgttctacaagcaactgacatctataccatagactcatagtacatacatgccaatacacattgctgtgccctggataacattgcatatgttgatgatcgtatattgcagttctcccctactaactattaagttgtatgcgccatccaattcaatttaaaaggttaaaattgatgagagaaaaaaaaaggacaatgcacttattcaatattacataggcattgaaaattactgaaatatgggcctagtggtattggcattgctacatatcagtagttgtcattattctagcagtattgcacaggattccgactggttttctagataatctatagtgttattgttttctgtcatgctttgattctttctaaattgttctgtctgtgctggttttcagtactgctctaaaagattaacaacgtgatgataaacacacagcacattatcagacgttgggttattcagtatgttcagatcaatctaatttgcatgcttattagttattagtatcgattaactcctctctgtaccgatcgatgtttcgtgtttgcaatgagcagcgtactatggattgggacgtcatggctgaggtgtacaatccatgtggcatcagcgcgcacatgtcaatcacaaatcatataaagaacgatgcaaatgggcagagcaagcaagcgatttgataaatacaggtaagcagtctcttctcttggtggtcaattgttcaggatggaactactgtatatgtttggcacaatgtttagaactgatcacatgcagctgctatctatcacattctcacatgacctcattcctatcaaagcagcctgatacacacttggagctaatattactaacatagcatatcttaagatgttgggtaaatggacctgaaagacgatggaaactgtttaactgatggtcatcacaagttaaaaccttcaagacgacccaaagattcatgcctaaaattacagaggaatcgcagtagtgaaatcgtagggatatcagccaacatacaggcaacaatggggagaactacaccatgaaatgaagaacaaacagtttttgatttgagatcagaattgtgctttcacagagccttggaacaatgatcttcagcaatacggtttcttgcaaaatattggtacgggggacttcggcaacatagtacaggtaatctggaatacatgggctcattttgctgtagtccatgtaggaatcgaaaaaactgtagctcataagatcttgaactttgtacacttcaatagttcaaaacagagcccgacaagagacctatattggtattttaattacgcataacaatcacctcagttgccactggcacacagaccttccagctctgatttgtcatgaatgtaatttagaaaactctcgaactagtgcatacaagtgttcagccagtcaacactatcaaaagcagaaccatgcatttggcagatcgagaaacatgatctagagtcacttggttagaaagctagatcagataatattgattgaataattctaacccacttcacaaaagatagtcacgctagcaatgatagttatgaccagccaaagagaactacattatgatcaggttagtatggcctgataaactaatctattaaattcaataccatgatgtctgctacctcctccgtttcacaatgtaagtcattctagcatttctcacattcatattgatgtcaatgaatctagacatatatatctatatagattcattaacatcaatatgaatataggaaatgctagaatgacttacattatgaaacggagggagtaccacacagcatggaagtttagttcatcacatcagttatagccacaaatgaaacactagcttttgaaataaaacatacctaatatcagaacaacgtacaatatgcagtaaatacagaccgagcatctataaaagtaacatgacaatgcaaagtacagagagatagcaggttgatcagagctatttcaattgaacaaacgaaacagtcatggtgtacttccttctctcccgtggtacaaaatgtcactaaaagaatctattatagtctttgcaactcacagcctgccccagaacccaacccagttcttcctacaattgtcatcctaagaaccagctaatggaactaggatttgaacgctcagctatggggaagccaatagagtggaagggttttttcaatacaagctaattaatgatcgttttgtttcacttgaaggacgtgctgagcaaaacgagcctctcagacctgatgagttaagcactggatctagaacaatgatacacaccgtcagaagaaggccatgaagaaaatgaatatccaatcatcttgcactgcttgtgttgccactccgacctcgcgaagacttgctgttgctactgccatgctgcttctgcttaccagcaaacccaggcatgtagtactcgagataccaccgcacaaacttcttaacccctgtttgaagatcagttgacggtcggtacccaagctcccgctgagcaagactgatgttagcatgtgtatatggcacatcaccattccttggcatcttgacaatcttcctcaccgctttcaccttgagcaacttctccagtaaatccaccagctgtgtcaccggcacaggagatgtgttccccaaattgtatgtcctgaatggtgccggccctcgcttcttgcctccactgcctgtgctacgcccggctgtatccaatgccccaacacaccccttcacaatgtcatcaatataggtgaaatctcgggaaatggggggctggtgtgtgcctccacctgcactttcatacacggtgattggccgaccagcgggtacaagtcgaatctcaanttcaaaggggagcgt

SEQ ID NO: 53374 - DNA, 3263 bp, Oryza sativa
cgcatttttgaattaggccagaacggtattaaaaataaggatgggccggcaacccgctgccggacttcgtttacctaagggggttggtggaaaaagtaaaatggttggcagcacctcgtagtacttcgaaattttgtgtgcggttgggaaaaaacaaatttattgggcagggtgtggggcactcgtgtttaaagggcttttcgcttccgtttccacaagaaaatggttttgatttgttccgccgtcttcgtttgctgggatttggttttcgggccgctacatttggggacaaatacggctcccttcctttttactactactccttttcattctttttcattttcattttagtagatctactgcagtatccggtgctgtgcgtacagcgtgcttcgtgcttggaactcgcactttcaccgaatatttcctctcttttttttatatatctctcgcaaaaacaaattagcaatgtttttctttttgaaaaggttaaaaacagggttgtacagcgagtacgatcctaggatcacgctggatgtaacgagacaaaggccactccacgcgaaacaattgcagatacatctgttcaaacagtgcgcagaagtttcgaaatccaaactagtagtacgtgcaggtgcagttgcgaacttgccgttgcggttgccgtggcactcgagtcgacttaccagtcgcgagattttggtgtagtttgggttgttgggggagctcttccctcccctccccctcccctcccctcgctcggttcagctgtggccacgggctcatttgctcataatcttaggctaatcgttatcgtttggtgagatttcacaaactgggaagacacgagatggtcctctcccctgaaggctgaggagataaggatcggattttgatttcggccccaaaaccggatgaagcacactgtcggcgatcggcaatcaggttcccgtgccgtgcctgcctatctcccgttgtcaccaactcaccacacgcgtcatgagcgcgagctcctctgaaatgcatgattctaaacatacatggatagaaaaaacatacaattggtatgtcatgtgctaccgaatcttctaagaatcataaatacaggaatatgaaacatgccttctttgggtggttcaaagggaaacttggtggcttattgagagagtagagagaaagagataagttgtacaagacttctcataggataaaaaagtgtttagttcacgctaaaattagaagtttagttgaaattggaacgatgtgatggaaaagttgaaaatttatgtgtataggaaagttttgatgtgatggaaaagttgaaagtttgaaaaaaaagtttgcaactaaacacggtgaaagtggtttgagctcattacctagtttcctatgaaattagtgtgtagaaactcaattcatgggaattttgtgggttcaattcctttgttccaaatggcatgcgtagaaaaaattcctaggggttgcaatccaaaggaaacattattgtcttcatcgatcaaatgcattggtcaaaaacactgctgtttacttactgacgggaagaagtaaacgggggcttaaaaaaattgtccatgcaaccgggggaaatcagatggaatatgcgtcacgtatggagtacagtgcaaggttaagtaaaagccctttttattctgtcttgagcatcaagcgtcgtcgatgtgcaatggacagcacagcaagttgaacaccaagttccacgatagatcagatcgttctcccaagatcttgtcggtcaagccggaggcgtggttccttccttttctccttggcaacacatctcgatgctcccaagaaaggaagccggtactgcgtatgtggccccagacgacctccacggcgagagaaagtgacacaggttgacgatcaccgagtatttttactgatggaagttcggacgagtggacatattcgccgtggcgacgtcaatggctgcaacagcaacaggcagagaagatttttttgccatggcgacgccaatggcagcaactgcaatgtcacatttgtcaatggcaattgggaaaagccacgcagtggcatcagtggccagcttactgcaggggctttgtagggatttcagttttagccaaaataaatactgcagttgtgttatgtagcactctgttgcaatggcctatttcctagttttatgtcgtgtcacacgtaacctccaaaatatatcctatgtacataggccatatatcctatgtacataggccatgtttggttctatgggctaatgtttagccctcaccttttagcctcaaattagctctcaaggatccaaacagatggctaattttgggttaatatgaattagcccccctcaaaacattagctcctcccctccaagaggtgctaatgaggctaattttgtgtggggaccataaaaaagcagctctctctctctctccttctctcccatctctttaaactctctctccaccttttagccttgaattagcctatgaatccaaacatccaccataggataatgtttagcctagcaattcatgactaaacattagctctcaaaattagctctgggcacgttcttcaaatagtaatgtgtccaagaaataggatatgttccctaacctccaaccacacattgcatagaatcatctccacatcgaaaactttggtgcaagtaacaatcaagaaatcctgcgtgacacacatttggggccaaagaataaaagtgaaaatgatatgtaaacgaccaaacagctatagatgacagcacaggacggaagctgagccagagtgtcaccctccatcgaggtgtgttgagaaacaacatagattactcctgaacaaagaaggtgccattgcacaaggaccaatttaacacgcgacacacaacaacaaacattctagcgcacaaaactagaaggtaaataatctcggcattgcatcattacacatctgctattgtcacctcaacctcaacaccaggttcaattgttatggaggttatctgcttcaccacatcaggggagctgataaggtcaatcaccctcttgtggatgcggaactcaaaccgatcccaggtgtttgttcctgataacacagagaatgtgatttggtgaagttaatctcatgacacaagaatattcaaaatgggcaggtgtacaatattagcattcacaagaaggataaatcaagttagacatggcattactagctcaagcactccttaaattagaagacaggctacagtttga

SEQ ID NO: 53375 - DNA, 6643 bp, Oryza sativa
  unsure (1)..(6643): unsure at all n locations
ccagtggattganaccttgttttttgtanaacnnnnnnnnnnnnnnnnnnnnnnnnnnnnnnnnnnnnnnnnnnnaatcatagaaatacaataccttcaccacagggagacttgcgggtagtgatgtggagcaccttggtggggatcctaactggcccctttaccctaagctgcttgtccttggcccccttcactagatccgcacaaactgcaaatacatagatatatgagatgacaaattcaagtctatgggaagaaattcagagcaccttttatagtatatcataccaaattacataggaggtaatagcatattcgatcacaattcacaatgacggtgaggaaaacccaaagaccagtcccaacttgactagcccaatccttgattggacacacctcaacagacaaaatgttcagcaatacacaagatatcaaaattgggtataacagcttggtccaatttgcaatgaagagtaacaggagcaaatattatgaacggcattcgccaatcggctctcccacactccaaccatattgtattgatgaacagatatacaaaagatttaaattgctccgataattcagcggttacaacaccgtatgccacaacttgacaaacagaccaaaagcacatccagtcaactatatacagttctcatacaaatctaaaggtgcacagtgactagtaaactacttcctccgtttcacaatgtaagttagtatttcccacgttcatattgatgctaatgaatctatatagatatatatgtttagattcattagcatcaatatgaatatgggaaatgctagaatgacttacattgtgaaacggagggagtatcacggtataagcaaagtaaagcgacgggaccaattgcccaattaagagcagttcacgagattgagtcgaagctgtggtgggggggttttgccggctggcttacctttctcgaggtttttgacgttcttggacgagagggtgatgcgaatgcggttgagctgcagctcgtgggccttctcgacgccaagcttcccgccctttatgccgccgtacaccgccgccgcagccatgttgctcttgcggaagggtctcggtcggctgctcgtgctcgaggcgtcggtggcttcgattagggtttcggcgtttggttcgagtatttacatgcgactagtggctcggctcgtctcggcccaactgcagccaggctctgcagttttggaccagcccagcatgtttcccttctcgctttagaaaattctctttccttttcatacttgttcattgatgattggttcatcttgagatactattttttttagccacaactcgcaagtcgcgaaaggaaatgctatcgcataacgcatatcttctttttcacaacatcgcagaaagagtacataattgataattgatttgtttcatcgcacaaagagtacataattgatttgttagtctgaagagaagttgaatcataatccgtattatgctagtgtgttctcaagcactatatagaggcctgcacattttcatctcgtcgtccgtcaacaattttgttacaagttctattggcgggacgtgctatttacatgctcagaaatttggggccaggttaataattcgggacaactaataagcaacgacttcacatgacaattgacatgggtgtcgttcggtgttttcagattgtaaagatagggaaaggtagaaatatgtcccaattccatccagtttggcatttaaatctttaaatcctaaatgataacacaacagtgccatgatatacaagggaaaagagaacatatttcttttcccgatttcccctcctatctgtcagatcaaaagtatcgaactaatttcactcgattcaccatcatgctctacaagttacattcttgaccagcagcaagacctttttctcacaaaagttaccatcgatgctccctagagatgttgatcctatagaacaagaaagagggaaaggaagtagaagaagcaagtattgcgaaccaagcagcatcagtggtaatctacagacgaaccaatgacatagtcccctcaaggaacggaacaagtaaaatgaacattctgcttctaatgtccattttcttggatctcgtcttcttcctcagcatcctcgaaacgctggtcatcaatttgaagctgcaacagcaaaaaaccaacgatgtcagaaaagtttatcactcgcacaaagacagttctaggttcatatgatgcaagtcgataatgtcaatgacagattcagtacagtttaataggaaaggaatcctgttcatttgaatgatagtactaagtactaacattgttgatatactaacaagaaagatttagggagttccaaaagaaaaaaaaagtcaatcttaataaatatattagcacaacatcaataaatgattaaaattacagctgaacaaaaccaggaactgtctctcatcaggttacctagtaatgtgctaaacttgacaacattaaccaattcagtgcatacctcacgtacagaacgaccaaggtcatgtagaccattttggcctatcaagttcgtaaagaacatgtgggcttcaagatcatttcctgcatgaagtatcaacagctacaatgaacatcaacagcaaatgcagtcaaaatgtatcatgcatacctaccatcaatcatgtcttcatcaccatgaatccacccaccctcagccatattttcaccaccggaccagccattctcttcattgcgcactggggaattcaagacagtcaagacttgttgaagagctcttttttagtaatgaactgtaatttacatactactagtacttaccagcattaggatcagggttcagttcagcacaatggcagaagacatcgaaaagtgcatcaactgaaaaactttgtaaaggatccaaaacttacgcagaaaatgacaagcaggttcagttctgctaacataactgaaactgatttgggctatacatctgttatttattcgtgaggttactttgtactaacattttcataaaatagaaacaaactgctagcaagtaaaattatgtcttgatcctaaagtttttttctagaatttcataagaataaaccatggaaatttagttgataatctccaattaaacgcctcaagcatgactgcgaaaacacatgtatcacaattcacacatcagaaagataatgaactccaattggttccctgaacaggttattacttaaaaaccatataaatagggataaaatgatgaaataattgtggtggtagtggaaagcaaataggagtaagaagagtctccagaagatggttttgaagtattacactaataatacttgaaaaaataaatcagctggcgtatataaactcaagaaagaaggcatcagagctaaaattgtgggaaacaacattatttgaatgtgacagagatgtttataaggatacgttgaccagggtctgaaagtataatgcgcatctcagagacttttgctagctgcagatcaccatttgcttcgaaatctgatccaccagcctcctcatcagagccatcttctgcgtcaatcttcaaattaaacaaacagaatatcagacattgccattaccatcagggaactcaaacaggaaactaagccaccttacagacactattgtacacccactcagaacaaatagcaaagtagtgatcacccaggaatcaagacacaaattagtttatgaacttttcacgcacagaagttacttttgtttttttctaagattggattagttcaagacggaccacattgtcatagcgacatgtgacaccaatcatacaatcgatgaactatgtgccaaacaaatatacaattcatggctcacaaaacaaagctcaggatcctccaagctgcaagatatttttaaaataggagtatattggaagtagcaaaataatgattgctgatcaaaagagcacatgttgagctgaaattaccaaccccaccatcatcaccactacataactaaaaacacccagaggattgaacaaaccatttcaagatcagtccaggcctccagggctccaaccagtacacacaccccaacaaattaaacatatgtaaaaacataagagctacacctaatggaccatttgcccagttagaccacagagataataaaatggagagttcgtttccccaatcacctgcgtgtagatgcaaggggaggggtacgcctccaggtcgcgcgacacagcatggagcgtgatggcgaggaagtccaccgcatagccttggcccttctccgtctcgctaagccaaatcaccctcctaaaaacgaaaaaaaaaaggcacaacgtgaacgggatggtaggcacaaatgcgcaaaataagagataaggacacggcggaagcatcagtacgctaccaacctggtggtgacgaacagggtacccgggggctccggcgcgcggcggccgagggcgacgaaggcggcgcggtccatgcggaggagctcctcgccggaggcggcgtcgaggcggggcccgccgtccccggcgatgtcggtgaagcgctggagccctggcgccatgtgaacaggagctagggtttcgggctttggagcgtgggagatttggggattctttcgaaagggtttagcgccgccgtggtggaaagcggcgtgtgcgggtgtggacagtggacagcgcgcttcttctgcttacgaccaataaaaaacctccctgctgcgttttataggcacgcgcgcacgcttggatatggaatggctgaaaatttgaagttttgggtttttttaaacaaaagaagactatttaaagattgaataaaaactttgtaaaaggaatccgacattagcgtaaattttattagcgttaaagcaaaacatctcgacactatatactttgacgttaagaatattttcacattgccataaaatccatattaacaggggaacacaatcaatgtttaggtgttggatctaacctcacatccaagttagaatattgagagacttatttaaccaacaatgttctcatgtgaatatgtgaatatgggtgtgtttggaactccaagttcccaacttcatttgcttcgtttttcgcgcgcacgcttttaaaactgttaaccggtacgtttttttaaaaaaagtttctacacgaaatttgctcaaaaaattatattgaatcattttttaaaaaatagcgaatacttaattgattacgtgctaatgaaccgctccgtttttcatacgtattgtttgggatggaaaccggcatatgtgaacacagccatagtgtggtggcaatatgttgctcttttattccaacaagccatgctcaattcctaacggaaacattagtttgtgtattgtattactttatttatttatagcagtgtattatgttttcaagaccgtagaagttatatctcagtatagttgtaccaaaataagttcatttttaatcaatctcacatataacaatataaaagtaaaaaaaaatagaatactctcactttaccaaaactaagtggaattgtccccactttatttaatttcaatggttgttcaaaatgatgttatttttgggacagacaagaggagacacagatgacttgttatgggtacatttgtacatcaaggttttcaaaagcgtggacaacaaaactgcaggtcggaatggtctctttattttacggtcagctaccagctcttgatccctcggccgcacgtctctgccgcccaatcctgagtaaaaccaattccagacgttggatcctgcattgcattgtcacaatgtcacttgagcgcaacggcgcaacgaccgggctatgaagccacttgacgaccacatcgcatatcgcatgcgatgtgttttccgtgcgttgatttggattttgaggccgtgtttagtttcccaaatttctaactttccatcatattacgtcacatcgaaaacttttttacacacataaactatcaactttctactaacttcctaacttttccaccatctaaagacagcctaagtttactgctctgagtcttaaaataagagtttattttactgttccatctaaatgcgtttaattgagcgctactctctctgttttaaaatattgttatcttttagatataatattttaagatagagaaaagtagttccattgaccactgtacggtgtggtgatcccacccccgctagtccgctacagcgaatgtggccggtcccctacttcggccgaggcaccgaggggaaaacaaatcgatggacgcacacgctcgccaggcgcgccagtgcggcgccgcgccacggtccggagttctgtttttcttctacgggttgcgtctcgtccgacgtcaaatcgccggagcgatgagacggtgtgcaggggatggaagcaaacgtatggtgacttgaccgcgggcgctggactgctggctgtgccgaactggtcctcttgactggccagtcaaagggagaccactgtactgtctgcgtgacacccccccgtgcccgtgccctggcacggtcggcccgaattacgagggaggggagccgcccggcaatggaacggcaccatacactggcacgccgcccgcccgggcgacccgagaacccgtgtaagagttgtacagcgcctt

SEQ ID NO: 53376 - DNA, 16555 bp, Oryza sativa
  unsure (1)..(16555): unsure at all n locations
atatatcggcgtggtnaattaatggagcgggtaaataaantacgtctctactttgatgctgattaatatataaatttgntgtaattatcatggcttttttatatnnnnnnnnnnnnnnaaaagggtttgatttcgatntccactngcnannnacnaaaaaaatataaaaaattaaaaagataagtcacgcataaaatattaatcatattttcttatctaacaataacgaaaatacgaactataaaaaatatttatataagacagtcaaagttagacataggaacctagggtttgactttttttttttttgaaacggagggagcaggcgcagtacgaggcacgcggaggcacgcacgccactgtgctcgcgcacggctgacacctgccctgccgagtggcagtgtggcacaactcacaaggcctgcctctgccagtagtcccctgacctctcactctccccctcactgtctcggctgctagcctgaaacggtgcaaacctactgctgttactgacgcgtgattgcgtgtatggctctttaagctgcccccgtgagatgagatggtgtggagcagcttgccttgccgtgacgcgaggctacaattcaatggttgacgagaacggtagcgcacgcacgtacacgttgggggaattacactagcaaccggaatgttgtgtcagaagtattgccggttccacggcacacatttggtcgtgcaacacgtccataccataccggtataccagaaggcgtgacaagctgacggcgcgtgcaggtgatggttgtagcatagcccatcgccttggcagcacaatgcctactctctttttttaacacgcatatcacccgtacccatgcccattgttaccgcgcgatgcatccagtgttcctaactgtgcatatgtggatatgccaaagttcatcaatgtttagcacaggcacgcaaacactttataattgggtgaatgattgttacagtagcatgtgatgcatgtgataagttcagggatcaggaccactgacaaacagtgcattttaggacaaaaggcagtgttttcccgtcagatgctaccttccaattgatggagcaaaaactggctctgaaactcgccatattcaccaatacgtcttcaccggtttggaacttgttcctgtcgcgcatggatatttactgccacaaggatcaggtgagccctatctccacgctcaagaaccacgcggagcaaatactagttgtcagaacctgagttactatcacattgatattagtgataggaacattttgggaccaaaaaatggggattaaggcagggaaagcaataagggtttaccatgcgggaagcttgatcacctcaaaagggcacgaaatacaggtatgattttaagcaaaataacttgcagtcaatcccagctagtcctgttccttctaaattcctttttctgcgaaagcactttcttcttcttgagtctcttcctttcagcggctgcagcactgaaatgaaatacacagcagcaactgaataaacgagtgtaattcgacaatttatagttctcaagtgtgagctagagatatgactacaaagattcagagttcgcatatgcaaaaatgtttctttgatctcctaaaaactaacattgcacaagttcaaaggttggctaatctcaaccgctactaactgtttgcactttggagagtaatgcggtatcttttatagaagcgtatgtagctacttgcacacacttgttacatttttttaagaaagcagatctatacacacttggtgcattcaattacacaaatagtattattaatctacaactggataataaaatatcaaacatcatcagcacattgcagaagtaatgatgactgcattggactttctaaagaaataaaataactgaaaacaacggaaattgaagggagcagatgggagaaaaatagcagcttacatttttcaaccctcctctttggctcttctgagggggtggaggtacataggatgcagcatcaatgattgcctgtaagaagatacttgtttagttaaaaagctaggggagcacaataacatgaaagcctctgcaaattacttcctgacaaagaactgaaatgagtaaagcatacctgtattttctgcaaagcatcttcaatgtttcccctaaaaggataaattgtgtcagttgctgtccaaacaagacaatcaaaagaactgagtaacatttacttttgtgtcctagtttttgtagaagatatcacaagctccccatctttatttatccggttcttttcctgtgtataccaagcaaatataaacaacctcttgagacaatacagaaaaaatgacaatgaagatttgcaaaagaggaagattttttttataccgtttgtaatatccgttctttgattctctcaccaagccactgagcctcttttacattgaaccgcatgtcgacctttgtgttaactgaaaatcgatatcaagtattttagaacaaagaggcgaacataaatgggggaaaacacggaacattgattggatagcagggcattatggtcattatttgaaaattctgaagacaaggtgtatgctttagaaccaaaaaacaatcatgtaatcatgctgagtagcaaataaaatatgctactaaatttttgaacattttaaaaataccagaccaatcccttggtcaatgctgaagtaaggctaagttcttttcagaaaaatcgaacgagcaaccttcttttttttttccgttagcatatgtttcccaaactgctaaacggtgagttttgtgcaaaaatttctatataaaagttttttaaaaaatcaaatggatccatttttttttcaaatttatattagttattacgtaattaatcatgtgctgatgagctttctcgtttcacgcgtgactgaaaacctcatcctaactgcccaagtgaacacacccaatattaataaaaaaatgttgtgcaaaaggaaaaccaatgttatagtattacgaaaagaggaagtatgaaaacaatgattcacgcaaacaaacagattaggaagtgaaagcaagaaacctttattgacattctgaccaccagcccccccacttcttgcaaagttaagagtaacatgatctgcaaccataaacagggtagatctcaaaacaggttgacaaataatgcaagtattaacacaatctattaataagcttgcagcttatcaattcctcatatctttatttcatcctttcaagtctatgtacattaaatacacgtcaatcaggaatagaaaatgtactatgtgaggagatgtgtacaaaaccatttacattgaaacatcttgatcaacatataacaaaatgtgcattcaacttttactatcacatagcaacagttagacaagatgttccaatacctgttagatcaatttatagagatattcctttcaaaaatttacagagacatgctactgctagatagagagtattgtacagagtctttcttattattagtagcgccaattttgctacagtacacccgaaatttgtgtaatttgctgatagacatcgaaaaaatgtgtcacggatgaaaaacatcctaaaaaactggtaattttctagaggacattttcggctcaattggatagatacattcttaagaaagacgataatgcccctaggaccacatgcttcaaacatggtgttagagtaaaaatttagaaattatgcaactctaaatttgccatcaccccaagtacattacttgcatacattatattccatcctcgctccagtcttagctcaaaaggttttgatcctaggggcattctcggctttttgaggaatttcaatctccaattgaaccgaaagtgtcctccactaaattagagtgtcgttcggacataacacgtttttacgatgtctaccaacaaacaacataaattttgagtgttctctaacagattttgtcttagtatgtatagccatacagcagcaaacctaggtgcttcttaagctaatttagctattagcatgcttttcaaactattggttactgtcaacaaacaggattaacaaaatgcaagtcaaatcttgttcatagctagaattcaccacattgtcacctctaaccaacatataccgttaagctgtcaaaattatccttagcacgaaatggatgtaggaagtagaatatacacctgagtcacgaagtataactcgataggggctactggctaggcagagataatgatgagatatgagatccccaattctcaccgagcagactcatcgaccgtttacacatagtacttcggagtagagatattagcctaagctactgaattttccgtttgaccaatacaatatgaataccaacaccagctgtttgttaggatttgacgtttcaattcttcatatgtaggacatcgattgagcatcattaccaagcatatgtgtaacacaaattaggggcaatagtggagttgcagattattacccaaagtgatcttgggggcggggtcggagccggccgaagcggcgcgctcctcggcgtcgcgaagcacctgctgggtcagcgccaggcgcgccgacaccttcctgcccccgtcgtcgccggcctcagccgccgagcaccggaggcggaccagcgcgccccggcccacgccgagggcgagacccacggtgggggcaggcgacgaggggccatggaacaggagggaggagacctggcggaagccgagtcgcaggaaggtggtgctccgcatggcggtcgccattagccttcgtgtggaggacgccgagcgacggaaattgggggccacggctccacggcgaagctcgaagcaaggcaaggagagaggccgaggggaggtggagattgatttgggcctatgtgggctttccgctgtcatgtgtgttcgctaatgggcctacacaattcgaatgtgtgggccacaaggaatagaagagaaagcaaaaccaaagcaagtgcagggccaggaatgctgatgggcaatcgatcgctatagggatggggtagcaatagatctactcccctctctctccctccacccctccacatggtttcttttttttttggcaccgcattactttcctattttagtaaatttatacacctcaagtttacacatataaagtttagagaccaaaagtttataagtcaaaagtttatatatccgattcaaatttgaatttgaattcaaatatttttttatatatagtatttctatacatctaaagtttatacacctaaagtttattgacctaaagtttataagtcaaaagtttacatacccgtttcaaatttgaatttgaattatatcctattcaaatttgaatttgaattatatcctattcaaatttgaatttgaattcaaatattatatatatagtatttctatacatctaaaatttatacacctacagtttatggacccaaagtttataaattaaaagtttacatacccgattcaaatttgaattcaaatattttctatatatagtatttctatacatctaaaaggtgtattatacacctaaagtttatagacccaaagtttataagtcaaaagtttacgtacccgattcaaatttaaatttgaattcaatttttttatatatagtatttctatatataaatttttctaaccttttatttttttaaaaaaaattgtgtggtgtataagagaagaaggggaggaggaaggagggagaagagggaggagtatagggggagggggaaggggagccgaactgattacccagcgcgatcactgacgatcgatcgcccattagaaggcccgtgcagggcggttaagatcgttcgagtgtccaatcaaagagttggatatttaatcaggcatgctgcatgcactcctacaggttgagtaacgtccaaggttaaccacaaaaaggcgagatctcgcttttgtatagtaatggaaaaaaggcaatttgcataggttgctcgtgccaaacaaaaactgtctttactcaacaaatcaaagctacaaacacgaacgaaatcaacataaagttgggacaaagtcccccgtattcacacaaaagtaaaaatgcaggtcctgttttaaccacacaaatacagtaaaaaaaatggtcgtgtttgttttacctatgtaactacgctactgctctgattattacaaccatccaccgcgtctgtagcactcccattcacatcgctacagctactccccaaccccacagacccgttggcgatgctcccgccatctctgtggccgccggtgcggctgctgctgctgctgctgtagaagcacaccaccttgcacttcaccacgccggcgcaggcgacgtacacgtggaaccccggcgccaccatcatcttcacgcttgccggctccagcttcccggcgcgcccggcggccgcgtcctccatgaaccgcgagtcgaagcgcgcgccgcggtcgacgcgcaccacgggcagcggcgggtggacggaccgcgcgaggaggcgcaccccccacacgcccttggcggccaggaagaacgcctgcagcagcggctccggccaggcgcgggcgcgcgcccaaccgagggaggaaaccacctcgctcatcttggcgtcgcagaaccggctcaggccctcgctgtagtgcttggtaccgtggaggaggacctcctcccacgtcagcgccgcgatggagtggtacgccgcgaggttggcctcgcagcggcccgccgggtccgccgtgtgcacgtcgccctcggtgtcgagctcgaagtcggcgtggaacgcgcggttcaggaagctctcgaggttcgggccggggttcaccgggctgcggaggtgattggagagagcccgcgtgaggctccgcacggcggctcgcgctgtcgacaccgcccggaggaacgactcgacggggaaggcggcggccgtgggagtggggagcacgcgggcctcgaggcgcgcgagcttcatctccagctcggtgagggagtgcttcagccgcgtggtctcctccagcgcctcgtcccgcgtgcgcgtcgccgccgcgagccgccgcgagaggtcggccgcggccaggcgccactgctcgctctcccctccgtccccaccggacgccgacgtcggcgacggcgacgaccacggcgtggatcgtcgggtgagtgacacgaacagcgagcggatgaccgccccagggccaggcgacgccggcgcgtggagccgctgcttgaagcggcagtcagagcaggacaccgccgcgacgtacgccgcggggtccgctccgcctcctccttcgctcttcgctcgccgcggcgtattcttggcacccccgctccccccgcggtggttgtggagtggcgtcgcgacgtgcgcgtacttttcgtccaccttcgaggccgtcgtcttgccaccgacggcccgcctcgcgtcggatacctgattattacgccgcattgttgaagcgcaatccttgaaaaaacggagatgctaactagcgaggaagaggacgcttactgctgcggcggggaagggagaggaaggcgagggagaggagaccatggctggcgggcgatggatcgagctcgagctcggcgagctcgctctaccccctgcctgggcgcgctggccaactacaccaaggacaactccgtctggttgcgattagcggggagcgtggcgagtcaagtaggggttttctcgggttcagaggggcggtggtgcctgtgcctgccgtgtgctggtggcgacaggcgaggcgatggcgctgtggggcgcgatgcggggcggggcgatggtggtggtgtactggtgcggtggtgcctgcccgcgtgtgtgacgacgtccatttttttttgggttaacttcacgccctcacgggggtggaaggagtggcgggagtgggacactgcggacgcgggacatgaatgccggtcagttcggtcgctactgcgtttaatgccatgacccatctccatctctcgcccccttctttctttctcgtctattttttctccgcgacactcaaaaaagttctccatttttgcgagaagccgagagaatcaggctgtgatccaaagtttagatctaaatttcagtccttttttatcacatcaaactgtcatacacatataatttttcagtcacatcatctttaattttaataaaaatccaaactttacgctgaattaaacacagcctcagagaagaagttatgggattctggaaggagggaaaggtttgcacatcaactcgtgcttcatttgtctcgcgctagctaccgtatgtcgtttgtactgcgtgtcaaagaagtcaaccaaaagcccaatcaattctctagacataattatcttaaaaaaaattctctagacataaggctgtttagttggtgaaataaaaatttttgggtatcatattggacgtttgactggatgttggaaggggttttcggacatgaatgaaaaaattaatttcataactcgtctggaaaacgcgagaaaaatcttttgagcctaattaaatcgtcattattacatgtgagttaccgtagtacttatggctaatcatagactaattaggctcaaaaaattcatctcgcaatttacatggaaactgtgtaattagtttttatttttatctatatttaatgctatatatatatgtccaaaatttgatgtgatgtttttgcgaaaagtttttgggaactaaaccagagccataatagtactaagtactaaaactttttcctcgtagctaatcacaggagtagtattacagacgaatactgttttagaagctgtactcctagctaaattgagtacttgagacatgcgaagacgggatctataaactggccagccgtgatcctataggactatagtcacggtgagacattgctactacgtaccatcccagtggcatgagcaagaaaacaagcgtcatgagttcgtggagggacacattaagagcggttggcgagtcggttacatgcatcataaatccggagctccatcggtctggaccggccggccggccagccggcgctgtccgcttcaaccgctgaatgaattgaacgcgatccgtattccgcgtgacaagtgcgtggctcttcgttgtctctcctagtgaccgcgaacattgcaaggcgccggtcgaggtttaccgttctccatttgtcggttaattgtaccggagtcagcagcggtaacgacgtcaccggtgacaacggactatggtggtgacttcgcctcggcagatttcacgctcctcctgggagtccatcggcatcagatttgttcagacttctcacccaaataaaaaggaactcgttcagactttcaggctgccccagtgtgcagtggaaggagctcctctaacttagggtgtgtttagttcacgccaaaattagaagtttgattgaaattgaaacgatgtgatgaaaaagttgaaagtttatatgtgtaggaaagttttgatgtgatagaaaagttataaatttgcagaaaaagttagaaactaacctaggccttaaagttagagggacatgtgtccctgacaggtgagacccacacccacgagcccatatgtcagtgactgatgtcccactaacttaagtgagagaagcctcatccgtgtgcagtgcagttcaattcaagaccagagctctggcaaactgctgtcgagatgaaatcacccgtagactgctgttttcagcggttgttaccatgccagcaaacgagcgcacagttgaccaagtcaccgagaattaggactcgggaggatcttaaattggatattttaggacttgttagctttattccagtttttaatttcactaaattttaataaagtaacaaattaaataagacattatcattactatcttatcgaatttggtagttctaagagtttcatcttgaaataaacactgccaaaaatctagttaacgccaaaattttgaaaaggttaatcagagcaacgaagtaagcaagtccttataatttctggatatcgtttaatgttttattgtttccagtcaatcgttatactaactcttactccaataaaaaacactactatatagatagagtatactgtataaatagcatttgcatggctgatatacgtacaagaaaaagatcaacactggaatgaactagtatttaaaattgtcaaaaagttatccttgactagtggtctcatactacgatcaagccactcacagaatattacgcctacagtcactggaacggatacccttatctcaatcgggcggtaagccccatctcaatcgggcacagcgtccgtcacaggctagaagtcactgatgtgaagagttatctcaatcggacaaacggccgtcacggatgaatctatctcaatcggaccctaagtaaagcccgtcaccgataactctgacccagacgaccggtcaaactatagcccgtcacagatgacttacctcaatcgggccacaattagagcccgtcacagatgactactaacatttatcgggcctaaactagagcccgtcacagatgatactcatctcaatcggggctaaactagagcccgtcacagatgactgctgaccttaatctggcctaaattagagcccgtcacagatgactatcatctcaatcgggcatttagttatggcccgtcacagatgactataatcacaaaaaaaataaaatttgttttttggctagcctcaggcctttgctagccatgcccgctgcataaataacagaaacaaacacagatatccaatatccccagctccccagcatcacccattcatatacatatgcattcacatacacagacatcaatatatttcacacaaccacacatttacagccatctcatatttcacatccattcacatatttcacatccattcaaatatttatcatatttcacctgcaaaaccgagttaattagatcaaatatttatttagtaagtcttaacataaacatatgaaatatatacataaatataagcatcacatttacatcatcacagttgcataataagtgttcatcattgcctaaacataaaagttcaacattgttcatcattttagtttaagcctaaacatttatttggggttaattatttcgcagaggatgaagctggctatctcctcgcgaacctcctcaaagctggtaggcagagacttgattattgtgccctacattgtcataattccagattagttgatcgatcatatataagtgctaaaatgtagttagtctatcacaattgagaccaccgacctcaaactcagccaaagtcttcaccttatctctatacagaaggcgcatgttgtggcacacatagaatctgcactggtcacctatttgttgcttcaccgggaagtcctttttgtggatgagggtgtcatgtcctatcttcctgaggcctcctctttgcacgtattgggcccacgcttcatctatcactagttgaattggggtccaatcatatgtgttcttatcaattctggagttcaggtagtgacatgtactccacttaggtgctatgatcagaaggatccaatgggcactgcggcattaatatagtgaaagttaattaagtactgaaggaatgtgtcatgctgttgtgtatatttagataacacacttactattgattataggcgcacataatgtactccttgtcttggcgggaccacaaggtgtcgtagatgtagttgaccattccttgacggtcattctgaagatttgtgacagtgaccacttgtggatcaaggaaggcaacttccggtgcattcttctgacaccattgccaacttaacctacacacaggataaacgatcttgtaagcgagttaatccgattgttattaccagattgagttgggtgacaatacttacaaggagtagcacttaaggaggcttgtgtccaccgctcggagcatgtagaggtcgaatagatccttgaagtcgacgacgatatcatttgttggaccaaggaatggctttccatcatgctctccaaggatatcggtagctttattcggcttcctggcgttagatttctccatgtagtatgcgtgaaggtccttgcaagcggtgcccattgcggcaagcacgtcatctctaaccaatggcatgcctagatggaactcctgtggagcagcgtatttcttcttgacctctttgcccttagtctcttcctggcccatgcccagatctagcttccttggagctagaagcgaggactgcacctttcctccccttcctctcccctttgctttgggtttatcgagagtaattctctgaggggaagagtgtgccttcctgctctttttcattggtaggggttcatgaattgccttgctgtcagcctccgttcggtcctccccaaaatccgtgtcgtactgcaactgcacatcgtaagattgtgcatgacgatcttgagcaggaggggctgaaagagcaaaggcgggtctctttggtggacgaccgcctggtgcagtggttggcctcgctgtaaccctgatctcaatgaggtccttgggccattggatgaaggtaccacaggcatttcctagtgagaggacctcgtcgtttggtggatactttagtgggaataactcgtattccggcttcaccgagtcgacttgaacttttgcacagtcgcccctgagttgcgctccatgcactcttgtctttggggtcggcttgtacgcaagtcccttggctgctggaaccgtgaaggttggcatcaccataactgtgagggtgtagctcgttggttcctgcgatagattaatcattttttttagaatattatatatcatatggattcgttaagtctttcatgcattgtggatgaaacttttaccgttatgtggtcgacggcgctgtcgaccgatgttgctcttcgtgcgcagcagcagcggcggcctgggggttctgttgctcttctcggatctcttgcctaatcttggccctcatcgactcgagcttttcgtagaattcagatgtcagctcaactcttatcgacacctggatcttggcttcaaggcgtgcatctttcttcgccttgttggaagtccgcttcttgtactgccacgcatagtctggaaatccatacttccagggaacagaagacccaacgccccatgtccatccacggtgttccttgttgcccaacgctttcatgaggaggtcgtcctcgcgtctttgagagcaggcctcttgcgaggcttgttgatcggcaaccaactcctttgcattacaatttagtggggttaaataaactgcatgatcagaaacaatgcgaacatctagttggactacacacttactatagcttcgtatactcgttgatcttctggatttggcatgatgattgtgccatcatccttcttctggtacctggtcctggcccagttcctagcccgagggtgtgggatatcgccaaacacaagtggtgtgttcgattcctccgcttcttcatcctcacgctgccattcctctttcttaccggcatattcagcggtgccaaaccgatgcggatgctggttcttggtctagagcaagcgatatgcctcgctactagctctggactcgggggtcgacttcttcacatggaattcctcccagacctgttccgtgatccaaggaaatttctctcttggatctggattcgtcgggttgtagacgaactcgccgactagcttagtcttgaaattcttccaagcattgcccataaccttgaaagcagcccgcctaagacggtcctcatgctccgcagaataatcgaagctctccttgaacgttagccaagcaatgtccttctctgcggccggcacgagcttgatgtcatcttgcagaatactgaatttctgcctacctatgaccccgcagatagacctaaatcggctcaatattttctttggagatgtcggcaaccctacggcgtccatcgctgttatgcggaaccgttccttagggattttgttcccagtcctaggagtacgtgtccttgaggacccactagttgtcgtcgacattggttcgccttgctgagacatcgtctactttttttcaaaataacaaaaatacacaattcaatgctacaatctattacaatgaattgaatgtaacttataaataaatgaagcatataaataaactaaattgcacatctcacagtaatagaatgaattgaatgtcacatataaataaattaaacatataatcaaatcctaaaatcataaattcacctcataccatctattcatccacatatcatgcatctatcactaaattcattaatgcaccacattccatctattcatcaacatgtcatcaatcaaaaaaaccattcgttcaccacatatcatcaatccctaaaatcatctatcactaaaatcatctatcactaaattcattaatgcaccacatttcatctattcatcatcatgtcatcaatcaactaaaatcatctatcactaaattcatcccaacatccacattttatcccaacatccacatttcatcattcaccacatgcaggtagcagagggcggcgcgatggaggactcacctgaggtcggccgggggggctcagtggtggcggcgccgggctcggtgaagacggcgggctcggtgacggcggcggcgggctcggcgaaggaggagttcgcggcggcggcgccgggctcggtggagggcgtcgccggtctgtggagacgacgccgggctcggtggagacggcgccgggctcggtggcggcggcagcggtgacggtctcggtgccggtgccggtaagggaggacggcggcggcgaagtacgagttggcggcggcgctagggttctaaggaggcgggaaattgtagcgggacttagaaaaatttttgatccgatctgagaaaccctagttatagtagagtgatgagtcatctctatcgggcttggccgtagggcccgtcacagatgactcatcggtgacgggctccatactaatgcccgattgagatgacattcaggcccgtcacggatgactcatctgtgacgggccataagataatgcccgatagagatatctctatcgggctttaactaaggcccgtcaccgatgactatttttccatttttccaaacaagtctttatatttgtgcgtacaaaatatatagctgctgtataataattcattttatcagtcataatatattttcatattctaaatgatttcaaatcgaaatatggtgaacaacaaaattgtagaggttatcaagatctacaacttttattttagtcatttttctatataacttttttcccaacaacttgaaattgattttgaatatatgacaaatctaaacagcatttgtaaatactaaatgatttcaaatgggaatatggtcaaaaacaaagttgatcctctcatcaagatctacaacttttattttggtcatttgtctatataactttgtttccaacagcttgaaattgattttgaaaatatgacaaatctaaacagcatttgtaaatactaactgatttcaaatgggaaagccataaaaagcaaagttgtacgacttatcaagatctacaacttttattttggtcacttcttcatccgacaaagtgatagtatcaatgtttataaaattgacatatatgtgttgatgtttatgaaccagatgagagaaatgtgatttttgtgaataatataattatcactttgtcggatgaaaaagtgaccaaaagaaaagttgtagatcttgatgagaggatcaactttgttgttgaccatattcccatgtaaaatcatttcgtatttacaaatgctgtttagatttgtcatatattcaaaatcaatattaagctgttgggaaaaaaagttatatagaaaaatgacctaaataaaagttgtagatcttgatgagaggcgggcgctctgttcatggcgatatttacgttctaaatcatttggcaccctcaaattgtttatgacttatttagtcaattattctacctcagctcttttttttgttcgcacattttttatgacttggttggaaaaatggaaacttagtcatcggggattggtccttgttaaaccctcttagtgatttttcaattttttttgggcattattttattgctcggtacctgtggttttatccgtaacgggccgggggtcctttcttttggtcatttgtctttcgaaccctgcttcttctgtctttcgtgacatgccttttctcttggacgaatggcacatgcccattccccttttttttgaaaattttcagttatctacgttttaaaaattaatctccatgtgattttttcatcgcacgttaaaacgaaaaaaactctttagcataggattaatnccccctttccctttctttaaaatgcgacaatctatttttttttttggttttttaaaacctccctcttcccatttaaattttttttgtccaaaaccattatattttattcgcttattccttgttgccttttttccaaaactttaaatttttcccccctcttaatttgggc

SEQ ID NO: 53377 - DNA, 1964 bp, Oryza sativa
  unsure (1)..(1964): unsure at all n locations
gtagataataaaagtaagtcaagggagtggatgtgagcaatacaaagagagagcaacgtacagctgatacgggacctaagaagacttggatgaaaacttatggaagggttagcgaggtgtgctaaataacagcgagatgaagaaaattaattggaaaagatataaactaaggcgagtcgcaatagagtaatgcgtaagaaacgtgaatgtcatctcaatggggcattagaatggagcccgtcgcaaatgagtcatctgtagcgggccatcggggaaagccgaatttaaaatagattattctgnatgggacataaantaaggnnnatcaccgatgactcattttccatctttcatttgaagtttttgtatttgtgagtgcaaaatatatagctgctgtgtaataattcattttattagctataatacattttcggatactaaatgatttcaaatggaaatatggtcaacaacaaagttgatcctctcatcaagatctacaacttttcttttgttttggtcatttgtaataaaacaaaattagccatattaatgactacacatatcaagtctttgcaataaaacaataaaataaaatacttctttcattacaatagataagtacaaatgcatcggtcacaaggttatgccttccgtatgatctgaacgagtatatgccacaggctcttggggatcatcgtcaaggtcaatgtgaggtcttacatgaagattatggttgtattcttcttcatcgacgacgttgtcaactcctacaattcggcgctttccatccctcatgatgtgcatcctcttgtttgaagggtcttttatgtagaatatctgctcgacctgtttcgcaagtacaaatggttcatcggcgtatcccacctttgatagatctactaaagtgaaaccttccttgtcggctttgacaccagtgcgtagattcacccaacggcagcggaacaatggaaccttgaacttgacgtagtttagctcccagatctcctcaatgcggccgtagtatgtgtttgacccaacttaatcctggaacgcatctatacggacgccgctgttttgcactgtgcttttgtcatcttgtttgacggtgtaaaatgtgtatccatttatatcgtatccttgccatgtgtctacggtccaagacggttccatccccaacaactgtactgtctcatttgggacatccgtggacattgtcacatgattcttgaaccattcgttgaaccgagaattatgttctctgttaatccatgcatcattttgccccaagttctcatctcggattttcgctaagtgctcctcaaagtatgggccaacttctgccatatgctggagcacagcgtaatgagcctgcgcatacgacacttgatctggcctaattcttttccttccgattgtgccaacacctgacaaccttcccccgtgatgagacgcaggaactccgataggatcggcatcggacatgtaattgacacagaactcaatagcctcctcagtcgtgtaaccttcaatgatgctcccctcaggtttagctctagtacgaacgtatgacttcagaactcccatgtatctttcaaacggccacatttcccttagaaaagttgggccacatagttttgtttgcttcactagatgaacaaggagatgaaccattatatcaaagaaagacagtgggaaaaacatctccaggtgacagagggtattcacaatatcggtctgcaacccatctagatcttctggatctataaccttctgtccaattgcattgaagaaggagcacagacgttggatcgtgtgacgcactttcggtggtagaatgcctctgatagcaactggcaagatttgtgtgattagcacgtggcaatcgtgagacttcattccaacaagttttagatcgtccaatttaacatgggtnccgagntcggttatgcagtcaacaatgacac

SEQ ID NO: 53378 - DNA, 2368 bp, Oryza sativa
  unsure (1)..(2368): unsure at all n locations
gcgagcnttgnnattgatnacatgatanacattctnnnnnnnnnnnnnnnnnnnnnnnnnnnnnnnnnnnnnttcaagcatgataacactgcgatcttctcatcattcgacaatgtgtggcaggctggagggaggtacactctacctgtctctgcatctcgtatgggttggagttcactgcgaatattcatgtcctgtagatcaaggcgcgcgttcaacccgtcctttgtcttcctgggaatattcaacatcaggccaaccaaactctcacacacattcttttctacatgcatgagatcaatgcaatgtcagacatcaagatctttccagtaaggtagccgccaaaatatggattttttcttccacatacccttctcctttgtcttgctacgttttcttttcttcccaaactcattgcttatgtccttgaccatattgtggacctcatctccggacaaatctttgggagcaggctgaagttctctcttaccgttaaaaattttcttctttcttctaaatgcgtgacgtagcgggagccacctccgatgacccatgtataccatctttcgtgatttcttcagccaccggcttcatgtatgttccttgcaatcggagcatgccttctttccttttatagtttgtccggaaagattaccgagtgcagggtagtcattaatggtgcagaacaatagaactcttagcttgaagttttcctgaccatatgcatcccatgtttccacaccttctttccaaagaatctccagatcgtcgttaacaggctccaggaatacatcgatatcattgtcgggttgcctcggaccttgcattaacaagcacaacataatatatttccgtttaaagcataaccatggcgggaagttatagttcgcaataagaactggccaagtgctgtgaatactactcatgtcaccgaaaggatttatgccatccgtacacggacatatctcatgtttctagggtcgacagcaaagtctttgtgttttcgatcggtattcctccattcaatcgaatccgctgggtgtctaagcataccgtcattcgttctctccggggcgtgccaacgtactaacttcgcttcattggggttggcaaagattctcttgaaacgatcaatgataggtagataccacacaacctttgccggaccacccctctttgacttctttccttcgtcagcacttttctttcacttgtatcgagaagccttgcagacaggacaagcatccaagtccgcatattgcttgtggtacaatatgcagtcgtttggacaagcgtgaattctacggacctctaaccccagtggacacagaacatgctttgcttcgtatgtcttctcgggcaatgtattctcaacaggaagcatagccttcaaaattcctaaaagatctgtgaaactcttgtctgtccatacactacttgcctttagcttcattaggtccaaggtaactgacaacttagtgtgttttgctttgcatccagcgtatagaggcgtctcggaatcactgaccaacctgatgaacttcattccatctctctcattttgggctaggtcctcaacgtcacgtaacatgtcttgcagcagatcgtgatccacatcaaccatttcaccgcccaatggagaaggtataaacatgtcatgctcatcttcatcttcctgattatgcgcaccacttctgtctgctgctgctccacttcctgattcttgctctccatgcttcacccaacatgtatagccctccatgaatcctcgttgtatcagatgaccgtgtacgtcctctccgctatcaaacatattctcattcttgcaatctgcacatggagaacacatgtaatcactgtttcttcttttccgatcctcctccacggcgttcataaaatttattacgccctttctgtactccgtagaatgacgtttcaaatttttcgcatacatccaacttcaatcaattgctacaaaataaaaaaaacaaattacatgcacatcttataagatcagtattgcaaaagtaagacgttatgaaattgctcaattaatgattaatattactcacttgattgatccattttgatcacttttgggaattttctgttttccttggaaaaaagacaaaaaatcgccccctacagcctcccaccaaaatagtgaacagtgggatacaactacagtaggtggtggggggtatttatactgtgcaacaaatatctgtaacggccctaaaacaatcaactgtgacgggcatacaagtaatctctatcgggccttaataaaagcccctcaaaaagagtgtcatctgggacgggcattaaacttatctcaatcgggtctttagttggagccccgcaccgg

SEQ ID NO: 53379 - DNA, 48476 bp, Oryza sativa
  unsure (1)..(48476): unsure at all n locations
cccctataaccttaaaaaaaaaaaataaaattttnaaaaaaaatcaataatttttaaggnatatttatttttttaaaaaatattttttaannccattaaaaaaataaattttaatnnaaaaaaaaaaattttaattnanntttaataaaannntttaanaatnatttaatccggtacgggctttagttttatgccgatataccatggctgtgcgaccatatctcaatcgggcgaaacttcggcccaattgagattacttcctgtgacggcccgcaaattccagtcttgttatgggccgtcacagatggaaggatctgtactagtgagtacatcgtggcttgaagtggcaccaatttatgttatatactttagcctatgcaactttgtagacataaatcgagatcatacaaaataaagatttgttaaatacaattctaacctattccaactattatttctaggtcttattttttttcttttcgctacatctctcattcaacaccgtcatttttgctcggtgttgccaactgcatcgatcccctagttcacctaccatagtcctctcgtttcctttcccttatctccgatgccattctcacatcgcatccgcgtcctctttccttctctcgccactgatgccaaacctcaccaatcaatcgcatgcggccctttgaaccgagtccaagggagcggattttatagccgggagcaattatgtccacctacaacctaaattatgtaagagaagaaaattatgtagaacattcatttgtgtctatagctagcaaaaatagaacatgtgtgcaactgaaatccttaagccccatttgttttagattacgtagtgaattatgatcacagattatctataagaaatcaattaaaaatgttgacaaatgaacttaataaatatttttaaacgggtttaagtgttgcagaattttgataacctgtttaagggctaatttgatttgaggtctaaattaggcttaccaatatttagcaatttcaatagtgtgtagtgtctatttggtttgaagccaaattttgtcatgcctaagaaaataggtcatttcagtagtgaacttaagctattttggcttcaatccaaacataactttgtcttaccaaaattagtcatgccaaaatatggcattgacaaaatttagtaaggcctatttaggccacaaaccaaaccaaccctaagtatttccagaagacatatttgttttaagtgttgtgcaaatgatctgtttttcatgcaccgcctccgctctaaggctatctccaacaatgaaacccaaaatacaagacacatttcacgtttgcatagcgctacagtcaaagagttcaatacctatttttggtcttctccaacaataagacctaaaagagaacttttactgcaaataggtcttcaggagagagaatactcagatttaggttatgcttcttatagcacacaaaatgggtcttctgtataggtactctgttggaggctgaaatagtcctatcgaagacccattttagatttgggtgcccttataggtcacttgtagacagtctaatcgtcgtcttctcgggctcgaccatatgcatcatgattcatgcatgctctgccctgctgcataccatgaaaacaggaactgacagcggagggacgtgtgcagtgtgctgaagtatcggccggcacctacacctgcctctgcctgcttaattatcctagcttgcatgcacagcgatcgtacagagcattcatgtccgtcgttgaagctacagtaacgttccggccccggccaccgccaaggctagcgaagcgagccggagaagccgtgagccagtgagaccgatgggcaagcaggcgaggtcccgttcgaggaccaactgcatgcgatatcctaacgaatcatcggaattcaaacacacggttgcatgtgcgcagctggctggatccgaatttttgggtgttgatatgatccgaaatttagagtcggccgacgcggcatcagcggcgccatggctccgcgtacatgactccgccatgtgatatcaacgtcgggtatacaggagtatcgtcgtaatccaaccaccggagttaagtgtgtagggcggccaaaaggacgcaagttcgaccgtgccaaaaataggaaaataggaagaggggcttcaatgtgccgtcagtccactggcattctgggagatcgctctgaagcgagggccaccgttaccacacatcgagcgtacgcgagttgtgtggacctggactgcggttgcgatagctggttggaataaaagacggcatagatgccatttttcccaacggacacctataagaaggcacggataagaaaaataaaaagtatcggttctaaaaatgtccgaataataataaaaaaagctgctcgatgcgaagcttcgagcaaagaattttataccaagattgaatcacaaaatctcttagaaaattcatcgcaaatctaaattacacagaaaaattcatcacaaaagaccgaggttggagaagggtgcgatgggaggaccaccgccaaagggaaggcacactgccaccaccgtgtgcgtcgtgaggaggaggccgccccgagctcgtggcgaccggatatggactcctaaagctcgcaatggccaccttgaggttggagaaggagcccgttgtattagcgcgtgaggagctgacgaaagggcgccactaccgtgccaccatgagagagaggagagagaggtgggagagggggagggaggaggagaaggactgaaggagataaggacgggtgaagcgcgagagagagcgaacggataagaacaacatggctctctccctcccccatgcggctcggctcgatttataggttgcctttaaaaaaaccggcacttataatattttataagtattgattttttaattaacccaacgcctataatatataataggtgccgatacctatatcgttttttctcaagaaccgacacatatagttgttcaaaagtatcggttacatattttttttaacctatggagacgagtaaaacattatatgtgttggttttaactgttctaaacttgtaatacctatagtgccgacttgtatgtgtttttctgtaacagtgaatgttgtgagttataccactgagccaggccagtaggtttgaatcagatcagcagagtttaaagaactggatatttgcatgattgcatctgtatttttctccgtgaaaattttgttggggcaagcgaccaagatcacaattcacaattgggaaaaactccggcctaacccaaatctaccgctacagtagtagtatccccctcgaaaagtcgaagttgtcccggttaacagcaggatgtctccaccaccggatacagatcgatgagaattgagaccacatgccgcgggacgcacatccccattcccccacatgatttcacttaccattaactacgcaaagcaagcaaggttcttagcttcgctggctcgttcgtggaggaccactgtccactggccacaccgccaaagctagcaggtagtggtctccgggtgggcagaggccgagacgcggacaaacgcgacgacttcgccatacgtacgctgtggcgccgcctgccgttgttgccgttatactgtgtgcccagcgcttggatggagagggagagctgcaggcaacgtacacgcactgtcagcaaacaaacgcagctatactagccgcctagccagccgagcgaacgggcgcacggtacacgtacgagccccgtgtgtaaattgtaaaacttccgtgcggtttgcgagcgcctgcgtttacgtgcatgcgtgcgtggtgacaatgtaggcagtggactcgccagtgcggccgcctgggcgcgtgtgtaaattgtaaaacttccgtgcggccccgcgctccctttcgctcgcgccggtccaaatcgctagcgctccctctccgacaccagcagcgtcctgtgccgcagcgcacgcataccccggtgaagtccaaaaagcaagtgagctttttgtggagtgggggaacctccgttctccgattccaactcgcgtggagacgggcactgtgcaaccctcacaagtcgatcacatgatcgttcacatctactcgactactccatcagtgtccaggtgtgcatgccatcgtctttttctctaagtacagggtgcacggattgctcttttgacgacgttgcttaggccaggcctacatgtctcaagctcgcgaaatgattatagctgccaaggtcaatgaaagctgatggaagagtgttaatactcgtactaaaagaaatgtgggtcaactactttacgaaggaaatatgatcccaccccaaaaattttcatcgtgtcagatcgaacgtttcaatatctgcataaagtattaagtataggctaaaaaaataactaattgtacagactgcgactaatttgtgagatgaatcttttaaacctaattgctctatgatttgacaatgtgatgctacagtaaatatttgctaataacggattaatcatgcttaataaatttgtctcacagtttacaggcggaatctaaaatttgttttgttattagactatgtttaatactttacatatgtgtccgtatatccgacgtgacacgtcaaaatttttcactccgatataaacacccctatcacagtgcattttatcacgtcatgttggtacgtgcgcgctgacaccagaggccggaggattggagccattggaggagtacctgctacgatgtcaaagttcggatcatctgcgagagcttggtcgggcccaagctgtgccgatcacagtaggaacagttttacagtgtttgcacgatactgagatgtaccatcaacccccagttctcgacgtttttccttttaaaaaacaagcaccctttgattttggatttcaacaccgattggattgtgaccctgcgtctgaaagaagcgaagaggtggtgaaaccacggccatgtcttggagttcagcacagtgccacagtctgtctttggctgtggttagttcagcgcaaagtttgaattttggttgaaattaaagatgatgagactgaaaaattgtgtatgtataacaggttgatgtgatggaaaagaactgaagtttggatctaaactttagatctaaacacagcctttattcaggaatgcaggctgtttaatttcttgcttgcggtagaaacatgcagaaaaaaatgttccaaattcagagcagcttcatatctgtatgagcattattcaggaatgcagactgccatagcccatagactaccgacaggtaaaacaaaatactgctccgtgatgttattaagcaactagacacctgaaatctgaattcgatgatacacatttgaacatctccaagcacgaggagatatcgatccgtccaagtaccaacagtgcagtgtgcaccatatgcaggttggatatgcatattttgacaactatagacttggaaaacccgtttcagtggaacctgtgaaaaaacggtgcagatccttatgcttttttgaatccacaagtgtgctcaagctaagagatggaagcgtctctatgctcgactgagcggccatgtttttctccgtttcagaaggattggaattcggaggaggttgcaaagaaacagccaagcaaatggcaggagtccaggagatatcagtagcagatcctcgggttttctcactcgatgcagtgacatgtgtgtgcttcccatctgtgtactccaatcttaccaagatcagataaatattcgacgtgattcaaatttcgaagtaccaaaagaaaaaacttaacttgcaacatcacgtatagtgaccccagattggcattcatcgacacgaacgaacagtaatacagcccaagatgtgaagctgcggccctgctgcggcggttccccgtgggctggactaccagctgcaaggagataggaataagttcagatatcatccctcaactttacgtcgagtttgtatgacatccctaatcttcaataccagaaatcttcacccataaactatacaaaaccgtgtggttctcacagcagtatgattagggatgaagatttgaagagtgaagatttctggtattagggattagggatgtcatactgattcagcataaagttgagcgatgaaaggtgaacttattcccaaggagatacgcatgcaacgacgccaccacaaacgggccaccacaccaacggcccggcaattgcggcgttgcagtccccgcggcgcgggcgaatatgctctccgcaggacggcgatgccacttcttcggttatcgggtgggccctcacttcctccgccgaaagccacgcacacgctgcccataaaaaggcgacgctgttctcaaaacctcagaaaattcctatatcctctgttcgtcactgccttcctctccaagtccatccccttccccgatctaagatccatccgatccaggccatggcggcgaccatccagagcgtgaaggcccgccagatcttcgacagccgtggcaaccccaccgtcgaggtacgccgcgggtccagtttcgttctgtctagggcgtcgcggcgattgaatcgggtgctttcttagcgcgatgccgcgatcttggtctgttggttagagcggttcggattggagtttccgcgatcttggtctgttggttagagcggttcggattggagttcccgtagtagggtttgtttaatcactgtgtgcgatgtggctaaccggcttagagtcctgaattgtgtggtttgtgaattgtaaatgttgatgccccctgctccgatttggccatgcgaagggtggattgggctctgatcggtttatttctgtcggctcagtcggctttggctttgagttatgctcgatccctactcgatccaatctactgctgtgtacctagagattagttgcacgtcgaactgcgctttgattttggaatttgcgctatatctgcaacagatggttgctttgaacatattgccactgttagatatcgtgttgcttggtgcttttgttccaggatttcatgatatgagcatacagttgttacagaattcgtttgttttattggactaaatcaatagttttgaatggttttggcaactaaatggtcttactaaaatatgatgcttgtgttgccaggttgatatttgctgctcggatggaacatttgcgagggctgctgtgcctagcggtgcatctactggtgagttgtttgtttatcagcaacttcttttccctactgtggttctagccttgatgcatctggttaattgaaccaacttagtttttgatagtccttttcagcttatatcaactatatggaaagcttcgggtgacaattttattagttagaaagtgaactgatgctattttctgctacactataggtgtatatgaagctttggaattgagggatggtggctctgattacttgggaaagggtgtcctcaaggtttgtcctttaacacattcctgtcagaagatttcggttagctgttttctgcaattaatctatactatctttgatagctttgtgactttttgtatccactacttccgtgttgtcatctgtgcctaacatattgttattgttttttcatttgtgctgcatttttgtggttctttacaactagcacggatgattatttaattgcttatgcagctatgcactcacaatgcaggccttgtatattctatagtctatactaataaagattgtggaatgatcaccttagatgttttctatatgtagcgttgcacaagcaagtttcactttcatttcaccagctaatatattcaacattcattattcttagagctgtctctttctgaatgttttggtctgaatgacagaaagtgctattaatattttgtatttcattccaactactctgagatagtcattgtgtgcaagtgcaattgtatgacctactttacttagccccccctcttgcatcatgcgttgtgcgatcttttaaatttttaacatttctatggatgtctgccttcatctttacatgccgtttgttatttcaacaggctgttgacaatgtgaactctattattggaccagcattgattggcaaggtatgtgttccctaccatatttctgtgcatattacagtattaaattcatgtatgtttacatattctgttggctttgcaggaccctacagaacagactgtcattgacaacttcatggttcagcaactggatggaaccaaaaacgagtggggctggtgcaagcaaaaggtactgcagaattgttgtggatgttgtgttatgttgtagcgctgcatgacactgcactcatttaatagtgctaactgctatctgactataattttttgaaattcagcttggtgctaatgctatcctggctgtctcacttgctctatgcaaagccggagctattatcaagaaaattccgttgtatcaagtatgggagaactcgttttatatttttatatttgaatgcacacagtttgttctttccactaaccagttttcttataccattacgtgccttctatattgcagcacattgctaaccttgctggtaacaagcaacttgttttgcctgtgcctgctttcaatgtcatcaatggtggatcacatgctggaaacaagctagctatgcaggcaatgcctcaacaaaaatgcacatataataattcttctctagtgatttttccagagattgtagtttatgtttgaaattctgtacaggagttcatgatcctccctactggtgcttcatctttcaaggaggctatgaagatgggtgttgaagtataccataacttaaaggtcactttcttgacatttctttaaggaactggattgttgtgcaaaaattaacactcaatatatctcatgttctacagtctgttatcaagaagaagtatgggcaagatgctactaatgttggtgatgaaggtggttttgctccaaacattcaggttgttgtttgtttgtttgcacatgtctgtcatatgtactttcaaattcttttacacgtattacctgttatattttccctccaacactccaaagcatatttatctttttttcttgctttaatttatatgttgtttcggtttgcaacctagttgcagtctcttcaaaatgtgagctcagaaactatatttcagtaccataaaagtttgttaagagttttgtcctatttgtttcatactattattttggatatacaagagcatctctatatcatattgaattttgaactgtgtaagtaaggaatcgcattgtccaatctgctgttataaaatattagatattagctagtagtcaattctgaatttatatatttgccatctatggaattgtaggaaaacaaggagggccttgagcttttgaagactgcaattgaaaaggctggatacactggcaaggtttgttgagcatacaactggctaaattaatttgatggttatgggctaaggcacttcaatttctgacatttggtatggaatgttatttgtactgatatgccaggttgtcattgggatggatgttgctgcttcagagttctacactgaggaccaaacctatgatcttaacttcaaggaagaggtaaatgtcagttttttccccttgaaattttttgaagttttaatgcccccatttatgatgcttgtttccttgtttagaacaatgatggttcccagaagatatctggagatagcctgaagaatgtgtacaagtcatttgttagtgaatacccaattgtctcgatcgaagacccatttgatcaggatgactgggttcactatgctaagatgaccgaagaaattggagatcaagtgcagattgttggagatgatctccttgtcaccaacccaactgtatgttacttgctaatcatatgacttatatactgcttttttcagtttccttgttggcttcaatattcaaaccaatttgacttgcagagggtagccaaggcaattaaggacaaggcctgcaatgctcttctccttaaggtacatactgtttaaggttgtattcaaattagccatatcggtttgccagcgtaataatcttgtgacctgtttatatggtttaggttaaccaaattggatctgttactgagagcattgaggctgtcaagatgtcaaaacgtgctggctggggtgtgatgaccagtcacaggaggtatgcatatgctgttttttttatttactgttctgcgtcttgtatgtcctaccttctttcctgacttcaatatttaatttccttgatttggttgcagtggtgaaactgaggatacattcattgctgatctggcagttggtttatccacggtatatactttgcgtgccttctttagtgtgcttcaacaaatataggccgcttatcttttgaaagagcttgtgagatccgctcttaatggtgatgataacttggaaatgcatcaatgttttgtcatgaaacagggccagatcaagactggagctccttgcagatctgagcgccttgccaagtacaaccaggcaagaatatgttcaaccctcttttgctatacttctgtactgttggttgatgtgcaaaattacactagttctgctgctatactttgtacatgttgatttcagtgcgtttgtgtaaacttgcctggtgttggctaacgacacttttaatttttgaggttttggtgcatctaactaactcatatttcccctctttaaattggagcagcttcttaggatcgaggaggagcttggtgctgctgccgtctatgccggagccaaattccgtgcaccagtggagccctactagatgggaatagaaccacttcgtttccgtaaattttgtgaagattgtgagggtttgagcaataattccccacggtcagatgtgggtggacatgctcccacaaaacgcttaattttgatgttgcgtggcgcaagcgtgatttgaaggaacacaaatgattatattaaacgttataagcaaagttcaacaccatgtttggatctgacagcggcacccgcttctttgctaaggttgccctggctgccagctgacgctgatgcacccggaggcatgtatggttgtgtttcacgaaggtagctgtttagggaataaactgcgttacgctatctagggctttgtttttgttcgtttgatggcaagggaagactatttgcggtgcgaaacaggaaagcttattagaacataccttcgtttcaaaatgtttgacaccgttaactttttagtacgactttttagtacgtgtttgaccatttattttattaaaaaaaattaagtaattaataattacaatttgcggtgcggaacaggagggagtaattaataattaattgagggcgcgagttgcaccagtgctaaccagtgaccatttttacccaaaaaaaaagtatagtgtaaccagctaccatcatttttaccaaaaaaacatcgttacccttcttacttcttactgtatcctcattacccatctaagtttcaaataaaattctcttaaataatggcatcctcgttaccgatgtaaatttcaaataaaattttctatctatgattttattgcaccgttatattcgttgcaattaaatctgtacaataagatcttacataattatattatgatggaaaaaatatttatatttgtaaatcacttttattatatacgtacttttatcgtatacatacattacttttaaatttgattaaattacttcccgtacattcatactgctataaggtgattacttttattgttgtttttaatcaattccatcatttttgctgattaatttaatttatagatagtcatgtttttaaccctacaacggatttacttctaatatcatgacaaaattactttccttttaaaatccttttattttaagttactttttataatatatttaaataacttttagactttattaaatttaattttatatatctataagaagtaatttagtgaaatctaaaagtaatttagatatattacggccttgtttagatctaggggtgaaaagttttggcgtgtcacatcaaatatacatatacacatttgaaatattaaacgtagacaaaaacaaaacaaattacggattctgcctataaactgctagacgaatttattaactaattaatccattattagaatgtttactgtagcaccacattatcaaatcatagagcaattaggcttaaaagattcgtctccaatttacacgtaatatgtgtaattagtttttttttcatttatatttgatgctccatgcatgtgtccaaacattttatctgatagggtgaaaaattttgccagttgatctaaacatgccctatgaaagtaatttataatttttcatcaaaatataatcatgtgagatcttgttataaagatttaattgttacgaatacaacagtgtaatcggttcgtagattgtatgagtaatttaagagaaaatttttattgaagcatgaaaaattttgccagttgatctaaacatgccctatgaaagtaatttataatttttcatcaaaatataatcatgtgagatcttgttataaagatttaattgttacgaatacaacagtgtaatcggttcgtagattgtatgagtaatttaagagaaaatttttattgaagcataggttttctatttgcttgatggccttagtactacagttaagtaagattctccaattaacacatatctagataatagttgatggggtcgcttgttatgactaaatcaagagggctcttttcgattttacgattaattaaatattagttattgtaacttattaaaaaagaattttataaaaatgcactgttagaaagcatgttgaaaacgaggaaattgaagcatgttgaaaacgaggaaattgaagtttatagttcgagtatagaaatcatcgactcatcgtgtgtgtcgccaaatcctttgtctaagggggtgtttagatataaagttttggcgtgtcacatcaggtattatatacagggtgtcgcatagggtattcgggcactaataaaaaactaattacataatccgtcaataaatcacgagacgaatttattaatccgccattaacaaatgtttactgtagcaccacattatcaaatcatagagcaattaggtttaaaagattcgtctcgtaaattagtcacaatctgtataattagttatattttagcctagatttaatactttataaagatattaaaacgtttagtgtgacagggtaaaaaatgggatttaaacatgccctcagctgtcttccgctggaagacccatgggtctcccgtctgatccagactttacagggtccacccacgtggccacgtgctctcatctgctgacctcttcaattagcgaaaatgatttttgcgtaggaaggaatcgataatgaaaaggtccaggggccaccgggccacgaccccacaaggccacagggtccacgcctcagaatcttcctctgcacaattcgattctgtccgggtcttcctctgcacaattcgattcgaacaccaaggatatataagagccatggcgccaaggatcaccatcaagctgctgagctgcacacacactccgttctccaaaaatgctcaactccaccgtcgagctgatcgcgctctgggcgtcttcttccagcccgtcgctgctggcattctgcgtctctcatctcataatcgctctcctcctcctcgccggcagcggcgcaggcgctgccccggagatcagcagccgcgctgacggagatcgcagtttggaagctgatgcagtggtgcaagggagggaaatgaaccctggaggacacaagggtcccgttgccggcgtcaatggccgcgcggaagaatggctggtgcgagcaggcgacggggacaacgttgagacactggcgagcgaaaacggcagaagtgcggcacgagaggaagagcctgcagctacggatgcatcgcaagagaagcacggagacgacgtggaactggaagacgagcttatgctccgagccgaagagttcattcggcggatgaacagagtctggatggcagaaaatttgcgagttttgtgttgactgttgagttgttgctccttgggtattattaattgtactattagcacagattgctgcaggggcatttttagtccggaaggaaatgtcttttaaaataaaaatgacaggtgctaagggatcccacttacagccttaaaacgtctccatctctaaatatgacccttcaaatacccatttgatcagcctgcaaaataattagagcctgtttgaaaaacagggacttattttaagtacctgtcacatcggatgtttggatattaatttagagtattaaacatacactaattataaaacctattccataaccttagactaattcgcgagacaaatattttgagtctaattacatcatgatttgacaatgtgatgctacagtaaacttttcataattatagattaattaggcttaaaaaattcgtctagcagattagctctcatttatgaaattagtttttttattagtctatatttaatacttcaaattagcgtccaaacattcgatgtgacatggacttaaaaagttttagccccatctaaacacccccagccaaatttatcttcaacctaataatctttctattacgctctccaatctgacaatggatcccacatatcaatctttatatgtttttttcttccatccaaatctttccttcttcctccccttctctccacaacctctccactccataatctctatccacggaccatggttcaccactggcagcgctaagatgatggcggagtggccagcgccggagggggaggctgtcgaaggcgacgatgtaggtgaggcggccaacgccggagaaagagagaggtagtcaataggcatggcagacggagcggcaaagctttgccgctccagcgaccgcgcccggctgcggcagcggcatgaatggtagcgacactactgctactcgcgttggtaggggaggcgaggaaatcggcgaagggaatggacggagaccggcggtggtgacagacttggtgtgggcgtcgatgggtaggtagtcgaatagcggcggcgacggctccaccttgctccagaagatccccgtctctgacgtcagagagtccgcacactacctcttctcactctccttcttgagccggcagcactgcagttggttgtttttctttccgcacaacgacggggtggccgacgacaggaatcggcacgcggcaggcaagcggtagacgggaatcagcgtgggacgccgccacttgcagccttctcgatctgtcttgccccatgccatttgttgtgcacgactggtcagcgaggggatgggtttggccaaccagatggacaagccatccagctagcaagtctgttgaagctgtaaatttatctacactagctaaattttagcttagagagtagaatagagatgttgtttgagatgcttttataggatggaaagtataatggagaagcttggcccgtaaagataaagaacagtacaaggactaaccatggcaagagaaaaccgtcactactcaaacctttgtttttctctattaagattgatttagtatttatcttatatttcctacgaatgctttttacttcttatataaaaattgcttaaaatataagataaatatattttttaagtttttaataattaaaacttaattaatcatatcataactatcattctcattttcctcgcccccaaccttatctcaatatacaatgccagtccgccgcaccgttttgcggctaactaagcagtaagcacacatttgtacggtcaatcatggagctcctgctcctgtatgcgccgtgtgttattctcctcgtctcctccctgtaccttctccggctcttctctgacgctcgccgcaacctgccgccgggtccccgcccgctgccgctcgtcggcaacctcctcgagctcggtgccaagccacaccgctccctggcacgcctcgcggagcgccacggcccgctcatgacgctccgcctcggcgccgtcaccaccatcgtcgcgtcctcaccggacgccgcccgagacatcctccagcgccacgacgccgccttctcgacgcgccctgttccggacatcgtccgggcgtgcgggcacgacaggtttgccatgccctggctccctcccagcagcccccagtggcgcgccctccgcaaggtgtgctccgcggagcttttcgcgccgcgccgcctcgacgcgcagcagcgcctccgccgcgagaaggcgcgccggctcgtgtcgcacgtcgcgaggatggcgcgcgagggcgcgcccgtcgacgtccgccgcgtcgtgttcacgaccttgctgaacatgctctcctgcacgctgttctcggccgacctcgccgacctcgacgagggacgcgccggatcggcgggggagttagcggacacggtcgcagagttcgcgggcaccgtcggtgtcccgaacgtggtggactacttcccggcggtcgcggcgttcgacccgcagcggctgcggaggtggctgtcgagggtgttcacgcgactgttcgctgagttcgacgagcagatcgagcggcgcatgcgggagcgcgacgcgggtgagccgcccaagaacgacttcctggacgtgctgctcgactaccgcacgacggaggatggccggcagttcgaccggcaaacgctacggtcacggtttacggtataccggtatattaggccgagtttttttctttacttttccaactcatatgtctcgttatccgtatgcacgctttttaaattattgaatgttgtaattttacaaaaaatttctatacgaaagtggtttaaaaaattatattaattcttttttaaattatttatagctaatacttagttaattaaccattaataaaccaccaagttttcatgtgctccacctcccgaacactgttttagattgtgagttggcaatagcgttttagctcattctcattggtcagctctggtgctctccttatctccatctctgtttagggagcttatagttgctacaacttttttcagaatcggaagcttcctaaacggttcagcttttttttagattatgagaaactgtagttatataaaccagaaaatgaatagaagtcagaagctgataaacccagtttttctatgttttcaaaagctgctatcaactaattgtttcttagaattttaagctctccaaacagaccttaaccttaacgtgggtgtcattgcgactgcgatggccacggcaaacgagagagttgcactcttgaagtagtgtagctaaccactggtaagtgtaagtgcaaatatgaaattatctgacttatgtctgggtattttttggtagaatttgtttagcgcggggagtgatacaagcgcggtaactgtagaatgggcaatggctcagctgctacaaagcccatcatccatgatgaaagctcggaaggagcttactcgagtgattggctccaaaccagaaatcgacgaatccgacatcgacagcctcgagtaccttcaggccgtcgtgaaagagactttccggctccatcctcccgcgccgttgctgctctctcaccgagccgagacggacacagagatcggaggctacacggtgcccaagggcgcgaccgttatggtgaatatttgggcgattggccgagatagcaaggtgtggtttgagcctgacaagttcatcccggagaggttcctgcagaaagaggtggatttccgtggtcgcgacttcgagctgattccatttggctccggccgaaggatctgtcccgggttgccgctggctgttcgcatggtgcatctgatgctcgcatcgttgctgcaccggtttgagtggaggcttctgccggaggttgagaggaacggggtgaacatggaggagaaatttgggatcgtaatgacgttggctacgcccctccaagctattgctacaccaatttgactatgtataaaaaccgtacacaaaaattaccggccgatcaacacttgtttctgatgttcactgaccgaaccacctgaaatcagtaaggtcggaaatggtagaaaacccagttaaaaacagtggtgaaaataatatgggcatctttgcaaaaaagatgacaaatttcaggtaaatattattttgttactatttatccaaaaattgtcttttttactccaaaataaagttgagtttgaactttaaatttggtaaaaatatatttcacggttacacctaataattgttttaggaatttatagaaatttgagctccagttttcacttgtttgatactttttgctggatacatgcattccctatatacaattgtatcttgtgatcaaatatattaattaatctacaccggttattgaatattcacatagaaaaataaacatatatatttaggatggagatagtgatcgatactactagagtataattattgttgagcttgtttaatttgttgccctaatcaatcatatcaaattttgtattggcattaccaaatttcgactgtgttgtttttgtttgcttttatgcctttgccaaattttggtagagttttaagagaggaaccttaataaattttggtagcactgtatttagtttgttgcgttaccaaaatttggtacaccctccgtttcatactatagttttgagttttttcctagtcatttttttaaactttaaccaagtttataataaaatatagtaacattttcaatataaaaaaaataatattatcaataaatatttaatgttatatttgattgaaccaatttagtgttatagaaattgctaactttttctataaatttagtcatacttaaagaagtttaaaagaaagtcaaaacaatttataatatatatgaaatggaaagagcagtaccaaaatttattaaggttgtaagtgacgataaacaagcactttattttttggttaattggatcatagcattaaaaatatcctagtttggaaatatgtcattactgtttgtgtatttgtaacgatgccactgttacttgtttgtaatctcaatggtgccactgaaattcatatttcacatgtattagacgaaatcgccctcgtcttctacctctctcttccctcatcatttccccttactcttggtcttgtcctccacccgaatcccaccgccggcgatgcctccccgctgccctcatttttagttctactctcttccaatctcccccaacacagaacgataggtacataaaacaatcattggattgacagagttaggacccaactaataccgagaagtaatgagtagaactacataacatataccaaattcaacccatccttgggagcatctgaagaggatcaatcatttggaagacactctgttgctgatgctgctgctagagcatgaggtcatcaccatgcttaggcagtgcaggtgacctgatagggatggccggcggcagctacggcgccttgaattcgatgagcctactgccacatgtaccatgccccggcagatcggtaagggcgtcactgctcgtagcttgtccatctacggcagctagggcacgacatcaaggtcgtagacatgctgcacgcccttgcgcaccctaaggtcggcaacgaggagcacatcgggacgattgagggaaaaaatgaacatgtggacgcttcaggcgccaatgctcttgaccatggtggcaagcaggcaagggagcgggcattcatgttgacgacaacgacgttggagaggatcccagaggtatacttgcgagcgaggtcgtggaggtaggaggccttgcgaggggagaccctgatctggcggaggtcctgtgtggtgagctcaaggacagccttagggaggatgttgtgcttgccgccgaggagggagaggaagctatgaaaatcagaggtgcagaagcgttgaacctcgttagaggccgcacctttattaatatatggtgataacaaccatcaccgtggtttgcatccatatcacacgtgatctgttcagttggatagatgagactaacaacatcctaacaaagtctatcttatccaacctaacagacaccacacgcatgtatacaatatagttttacagcccccctcaatcacaaccttcctaggttgagattgtgcttaaaattttctaactgtctaacaggcaaagccttagtaaagccatcagcaacttgatctcctgtaggtacaaaatcaatctctaacaatttttgagatactctttctcgaacaaaatgatagtcaacttctatatgcttagttctggtatgaaaaacaggattagaagaaagatacttagctcctagattatcacaccacaactttgccataggtggactttgcacttgtaattctgtcaacaaagtttgtacccacatgatttctgctgtagcattagcaagagctttgtattctgattcagtactagacctggaaactgtagcttgcttccgtgcacaccaagataccaggttgtctcccagaaaaactgcaaaaccccctgttgatcttctatcatcaagagatcctgcccagtctgcatctgaataagcactaacaagcatagacttggacttgcatagcttcaacccaagtttagtacaatgtttcaaatatcttaagattctcttaactgcaacccaatgaatagtggttggtgcatgaaggaactgacaaaccttgttaactggaaaagcaatgtctggtctagtcaaggttagatactggagagcaccaactacacttctataatttgttgcatccaaaggccctagtaagtcaccctcatgagcagataatttctcactagtagacaatggtgtacttactggtttgcaatcaaacatatttacccttctcaagagatcacaggcatacttgtcctgtgtaaggattattccattaggtatcttatttacctctataccaaggaagtaatgaagatctcccagatccttcaaggcaaactcctttttcaaatcctgcagaagagctgacactgcctcctgtcttgagctagtgactattatatcatcaacataaataagaacaaatataattagtcctcctctattgtaaaagaacagagaagtatctccttttgatccttgaaaacccagatcagtttcttactaagtctagaataccaagcccttggagcttgctttagcccataaagagctttatcaagcttgcacacttactctggaaaggacttatcctcatatcctggtggttgtttcatgtatacatcctcttcaaggaaaccatgaagaaaagcattctgtacatctagttgtctcatacaccaccccatagacatagcaatagacagaacaatcctaatagtagcagccttaactactggactgaaagtgtcttcataatctataccttagcaactaggcgagcatcttgttttcttttaattttatagacccacttacagtctataacatttctaccttgcctaggtggaactaagtgccaagtttcattattcatcaaagcatcatactctatatccatagcctttttccaatttgtatttttcaaggcatcagttaaattttctggctcatcagtcacagtaagaaaagtattcttgtatttaactgtgccatcagtgtatgcctctctgcagacgagtggttgggcgagatggcgctggaatcacttcctcccctgtcgcaaacggctcgcctgcggaactgtgtgatggcgacataacatcatgatggctggtaggcagggcggtgtcaggaccggagtgactcggcgtggagttgtcagcagaggtaggcgccatcacatgaggagaggcgggaaagtgtaccacatccggagacgtggcagcgctagaatggctggcggcagcatctgatgcaggcggcgatcccgacgccgattcttttgcagctgcactgaattccggatggatttcttcggccggatcttctgtggcatatgaaggatcgtctggttcatcattttctgcagaaacaggctgcacattgcttccaaaaaactgatcagcagggttagcaggaatattagccatattgtcatctaactgttgttccccaggattaggtgctggatttagaagatgtgaaggaagcaacaaaatttctgaacgaagtctagcgccggcatttgtgtggagttttgcaaagggaaaatttgtttcatcaaagacaacatcacgggatatataaacacgacctgtggaaggatcgagacacttgaatcctttatcgagtgtactgtaccctaagaaggtgcattgttttgacctgaattggagtttgtgtgtgttgtaaggtctcatatgtggccaacaagcacaaccaaatactcgaagagaagtataatctggggttttattaaacaagcgctcaagaggtgtgctaaactggaggagttttgtaggagttctgttgataagatatacagcggcttggaaagcctcgtcccaaaatttcaagggcatggaggaatatgcaagaagtgtgagaccaacttctactatatgtctatgcttccgttcagctgagccattttgttgatgagtgtgtgggcaagagacatgatgtgtgatacctatctttgtaaagaaggagtgaagtttttcatattcacctccccagtcggattgcatggctattattttcctattgaacaggcgttcaacaagagcttggaactcatgaaatttttgaacaacttcagacttatgcttaatcaaataaagccaagtaaatttgctaaaatcatcaataaaactcacataatattgtttgcccccaacagaggtgagggcaggacaccaaacatcagaataaataagttccaaaggataacttgacatactagaagatctagaatatggccattgatgacttttaccctgttgacatgcatcacaaaccgattgtttatttgactcatctaaacacggaagattatttctgctaatgactttctccacaattggagaggaaggatgacccagacgactgtgccatctctcaaaggacggcttgatggctccaaaggcttcttttagatgacgagggcgttcatgagatgatgtagatggaagggcatagaggcgccctcggcatggccccctaagcagaagcttcttcgtggccagatccttgagattaaaatatttagagtaaagttccatgtaagcagaattatcaaaaacaagtctattagcagaaacaagattcttatttgaattaggaacatatagaatattgcgaagatgaatgtcacagttcggggttttaacagtagaatgaccaatatgactaatttccatacttgcaccgcttgcggtgtgaacttgatcttgccccttgtagcggtcacgaactgtgagcttgtccagttcgcggtcacatggtcagtcgcaccggtgtcgacgtaccaatttgtatcaatcccataggaagttgctgatcctgcatatttttcatcgggaacaaaatcttcatcgtaacgataccagcaattaattaccgtgtgtcccctcttgtagcagagttgacacttgggtatgttgtcgacacctcccggtggacgcgcgccgccattgttgccgcgccccctgccacggttggcgccattgttgttgttgccacgaccacgtccgtttccagcattgtcgccgcgttgctgtcctccaccaccgccacgtcctcggttcgccagatttgcagatgcatctccaccgtgacgaagcgcgagacgctgctcaaaactgagcagctgggagtacgcctctcccagggtcatgaagtccttgccgacgatggtggagatgactggttcatacgtgtcgtcgaggccggcgatgatgtacaagacgagatcatcatcatcgacgactttgccagcagccgtcatctcatcagcaagagtcttcatcttggaaacatactcgttgatggagagagtgcccttctttgtgttggagagggcgatgcgggtgttgatgaagcgcgccctcgagacggaggagtacatctcctccagcatttgccatgccgctgtagccgtgttgcaggtggccacttgcgccagaacgtccctggctagagtggagagcaggaaccctagaacctgctaatcggttgcaatccaatcatcaaattctggattacgagccgtgacttctttttctcccttgtcgcctgctgtcgtcgtgatcagggcgttggggactttggtagtgccggtgagatgcccctcaaggcgggctcttcgcacaacagccataacctgcgctttccaaagcacatggtttgatttggagagtttctccgagatcgcgtttccaccgagagggttcctggccgccgtcttcgacgaactcaccatgagttggattagatgcgatttggtggatggaagggctctgataccatgtgaaaatcagaggtgcagaagcgttgaacctcgttagaggccgcacctttgttaatatatggtgataacaaccatcaccgtggtttacatccatattacacgtgatctgttcagttggatagatgagactaacaacatcctaacaaactctatcttatccaacctaacagacaccacacgaaggtatacaatatagttttacagaagcgggagtagacggaggcggcggccttgaaggtaagtaccgacaaagggaaagaaggatgaaggaaagagaaaatgacaatttggtcccaaacattttgtaaattcatctaagaggtaagtactgacatactccctccgtcccataatacaagggattttgactttttggttgcgctatttgattactcgtcttattaaaaaaatttgtgcaaatataaaaaatgaaaagttgtgcttaaagtactttggataataaagtaagtcacaaataaaataaataataattgtaaatttttttaataagacgaatggttatatgtgtaaaatgataatggtacgattccaattaaatgactatatcagaaaaccctctctcgttggctcaaaatcaaacacgttgcacatctttggcgtgtcttgccatctcttccagtacacactctatatgggagtagatatactagcagattagcaggagtatccaccctagcatacgagtatcgttccgaccctgcacacgttttgtacggtcaatcatggagctcctcctcttgtgtacgccgagcgttattctccttctctcctccctgtacctcctccgtctcttcgtcgacgcccgccgcaacctgccgccgggtccccgcccgcagccgctcatcggcaacattctcgacctcgggttccagccgcaccggtccctcgcgcgccttggggggcgctatggcccgctcatgacgctccgcctcggcaccgtcaccaccgtcgtcgccttctccccgggcgccggccgcgacattcttcagcgccacgacgccggcttctccgcgcgctccgtgccggacgccggccgcgcgtgcgggcacgacggcttctccatgggcatgctcccgcccagcagcgccctgtggcgcgcgctccgcagggtgtgcgccgcggagcttttcgcgccgcgcagcctcgacgcgcaccagcgccttcggcgggacaaggtgcgccagctcgtgtcccacgtcgcgcgcctggcgcgcgacggcgcggccgtcgacgtcggccgcgccgcgttcacggcttccttgaacttgctctcaagcaccattttctccgccgacctcgcggatttcggcgacgcccgagctgagtcgtcggtgggggacttaagggacttgatctcggagttcaccatcgtcgtcggggtgccgaacgtgtcggacttcttcccggccgtcgcgccgctcgacccgcagcgtctgcggaggcgggtggcgagggtgttcgagcggctgcaggccgtgttcgacgggcacatcgaacggcgcctgcgggaccgcgctgccggggagccgcccaagaacgatttcctggacgctttgctcgactaccgcagcccggaggatggccggggttttgatcggccaacgctacagtttctgtttacggtgcgtgctactgaattattcattgggattttagagtatgtgatatgtccatgtagtaatctcgttgcaccaaaactctaattaaattatcgaagtatacaacatgattgccggggttactttctgcaggatttggttagcgcgggaagtgatacaagcgcagtaactgtagaatgggcaatggctcagctgctccagaacccaccagcaatggcgaaagctcgtgaggagcttgctcgagtgattggctccaaacaagaaattgaggaatccgacattagccagctcaagtacctcgaagccgtcgtgaaggagacattacggcttcatcctccggcgccatttctgcttcctcaccaagccgaaacgaccacacaggttggtggctacacggtgcccaagggcacccgtgttctggtgaatgtttgggcgattggtcgggacagcaaggtgtggtctgaccctgacaagttcatgccggagaggttcctgcagagcgaggtggacctgcgtggccgtgacttcgaactgattccatttggctctggtcgaaggatctgtccggggttgccgctggctgttcgcatggtgtacctgatgctcgcgtcgttgctgcaccggtttgagtggaggcttctaccggaggtcgagaagaacggggtggacatggcggagaagttcgggatgatactagagttggctacgccactccgggctgttgctataccagtttaataagctgatcatcaccatatgctaccttgctacatacaatccgttatctttaggaatggaacacttcactggtaaataaaatcatatactagtacaattctgttgtttatgtctgaaagagagatcaaataggggtgcctgtacggtagtactaaatgccagcagctatctaactgagaaagtcttgagttagtcgttcttctatagtggcttgattgtccttcaccattttattctggtagtcgttcttctagtggctttgtttactgcacgtaggttaccacaagatcaacatccctatatggggcgtgtggctggttgtgctaacttgttatttctgttgtggtacctgcactcctttcttttctttcttttttttctctccgccacttacggagtaataaacctggacggcgccgttcctttgcaggcccatcgaaatcgacatacggtcattggcgcgctaaagttgaaattggagaatagcacatcagcaatccaaagtacctataggtatcgtgaaacagacttcacgccttgattgtccttcaccattttattctggaaagctacggagattcacagctgagaaagcggctgacttccatggcatggcagagactttgagcatcatatccatttggtttcaacagggggattctccttgggatgccattaattgagtggaggcttccaatagcagagagagtttctttttcaaaagataatacatcccgtatatagtaacagcaatttattggactaagactctaaagaggacgatcaagaaaaactaaatattggatacatggatgcacacgcgaaatgtacgggtgctacatgtggtgtcaggagggaacgaaaggaggacgattccactttaacagtagtagtggtattgccaacgaatcttctagccatgaacaaacctcttttttttttttgagggatgaacaaaccaaatattagtgtcacgaacagtcagatgtgggcagggtacacctaatgggtggcgatgggggtagcgatcgatccccctccccctctccctccctccaccgcaccgcattattttcctattttagtaaatttatgcacctaaagtttatacacctcaagtttacacatctaaatttagagaccaaaagtttatatatccgattcaaatttgaatttgaattcaaatattttatatatatagtatttctatacatctaaagtttatagacctaaagtttatacacccgtttcaaatttgaatttgaattcaaatattttctatatatagtatttctatacacctaaagtttataagtcaaaagtttacatacctgattcaaatttgaatttgaattatatctgattcaaatttgaatttgaattcaaatattatatatatatagtatttctatacatataaagtttatacacctaaagtttatagacccaaagtttataagtcaaaagtttacatacccgattcaaatttgaatttgaattcaaattttatatatatatatatatatatatatatatatatatttctatacataaatttttctaactttttgttttttaaaaagatttatggagatgtgtaaacttgaggtgtacaaactttaggtgcacaaatttactaaaataaaaaagtaacacggtgccaacaaagaaaaccaggtggagagaggggatcaaaatctgatcgcccagggatcgctaggtagcattctcgcgtcgacgggccattttagacgattaggctggcctactggcccaggaacaggccttgttttatgaggccatcttcattgggccttggcatgtcatgcagcccaacagatacatatcccctatttggactgaatcctaatcttcaactggcccatgagatcagacggcctgcacgggacttgcacacagttgcacctcgagtcctcggcggcggcggcggcgcaccgcttgcctcgcgtggcccggtggctggtggcttaggaacaaaccaaggggattttgcgggtggacgcgtgtaacgcgtgacgcgtagccgcggtcggctgtacgcagcgacacgcgtgcatccgcgcgttgtaacgtactagtccatccgtccaaaattatgagagattattttctatttagtattaattaaggaagatgaaaaagcggataaatggacatatggaaggactttctccgtcccataaaaaacgaatctaaaaccggatgtaacatattacagtactacgaatctaaatatatgtgtgtccaaattcatagtgtaatagaatatgtcacattcagtactagaatgggacggagggagtatacattggaacattcaacgaactacaaaatgtactttagagaataaagtattgttttggcaggtttagaatgaacttaaaaaaatctgacatgagtttgtcagagcatatttttccaccacatctactcaaattttaaacattcctcccaaaattaaacagcactactcctgcttgtcagatgagttgatagaatcccctatagttagagacaaaccaaggggccattgtcccttataatcttggatagagggagtagtacgttggctttttccaccgcgcggcggagggactagtacgttggctttttccacccagaaaaactacccaaccgtatcccgtggaaacggaataagtgggtaacgcttcgttattatctatttgtcttctctttcccagtcttcgtcttcctcatccgcctctcctattccgccctcctttttccctttcccttctctctgttgcagagagctcctctatgcatgcatggcgacggcgaagcaggcccccgaaaacgaatcccctccccctcctcctcactgttggatctaccccgagtgcacgttggttacaaggtcatgttgcctcctcctccgtctcaagcttttgaggcatggacacccactacatctaggctcccatggcggaagggggcaaccaggaagtagggaggctgtcgggaaggatgttgaccaacgtgggcttctcgaactcctagacgcgttgctgatggtgatggaggggcatgaccatgaagcttctagatgtagagctttcattggcggcgacgcgatggtgagccatcatatgctcattgtcggagtgtgtgcaggtacatgatgtattatccatagccgataccccgtaggtatggtacatgtggtatcatcactgatatctaggtatcagacctagtacctgtaggtaccatgcttagtacatgtggtaccatgactgatacccataggtatcaaacctgatacatggtacctgcgaggtatcaagtatcatggctagctgcgaggcatcaggtatcatggctggctacgaggtattaggtatcatggttggttgcgaggtatggctaactacgaggtatcaagtacatgccctctttcctcttctcctttcccctcgactcgatccttgttccctactactcctcttctcccttccactcggctcgatccttgttccctactattgccgcaaccgaggtcactctctgtatcggaagcatggttcaagacgtggggggagcgataccaaggatcttggaggaagagggcattggtgctctggcctgctgcgacagtgctctgcccatgaggtatcacgcgcgagactgaggaggatctggctgaggaaagcaacgaggaatcatgtggacaataggtgacgcggttggaaagatctattaatttatcgagtgtctaattatcccatgactttagttttgcacggcatcccgtgcgctagctgccctcttttccaccgcgcggcatatttccgcagaggagatatacgatgctgtttctttcatatatatttaaactcggtttattttagtatgttcttcaaattgttaaattatgtgttttgtattaaatttttttatatataagttatcttaaaatatcaaataatttttatattttaactttataataattaaaattaattaatcatgtgctaatagttttctttcctaactaatttcatccttatttttctctagaagagaataccaccatagtacgctagtctcattctcatactccctccatttcaggttataagatgttttgatattggttaaaatcaaactgtttcaaatttgactaagtttatagataatataataatatttatatttatcaaattagttttattaaattaataattaaatatattttataataaatttatcttgagtcgaaaatattacttatttttttctataaacttggttaaatatgaataaaaagtagtttgactttaacaaaaatcaaaacatcttataacctgaaacgaacgagggagtagtcaatttgctaattgtttttgtaaggacgaaatctgctgtgaatgatgagagaggctaaattgtgaatcatctgcgaagtggcttcaagccttcgatttcaacagattaaaattaacgtgccatctgcaccaacccaaccaaaatatatagcagtacgacgaaacgaagagacaacaaatccgttccccaaatggcaatattagtgttagtcaatttttaattagttagcctcatccggaaatccaccgcgccggcaagcccaagccccatggcccccaggtcccagttacttggcgtcgttggcgaccagcacaacgcgaggccacgcgcgcgcagcagcagccgcccacgcgaagcaaagcaaagccaaacccatggataaacgaaacgaataaacacgatcccccgtccagtacgattccattctgtccccgatcccgtcacgtctcctggaaacaccccacccgcttctcgtctcctcgtctcctcgttcgtctctcgcctcgtcttccccgtcctccgcgcgattccccaaccctccccgaagccgcagtccaccgcaagtcgcctgcctcctccgccccgcgccccctccccccgtgcgccggcgatcgccggtgcccgccaggtcggtggagtctattgctctctctctctctctctctccccccattccttccgcgccgctttcgtgctgattttttttagctttggatgaacgagttttcgttttggtgttaggcgttattgggatgagaaatctagggtttggaacggcggtgtgcggaggtgggttgggtgttggtgggaagaggtttggctagaagttagctcaactggttgttaagtagatagccgtgaggtccgtgcgggacaccgaattgctttccgtggaggcgacacagacgatgtgaatggtgatatgtactgcgcgattacgtttcggctgcagttgattgatcaattcgtcaacatttctgagcaaaatccgtttcatcattaggaatgaattcatttggcatcacattgctgctgcctctggaaatggaggcactaccctggttggcatctagtgcatgtataggataagttcgtttttagccttattatccatggtgccttttcggtttacctgcgttaagcttgttcataattttgtttaggctcagattgtatgaaaaaggtagctgtatatagacgtacaagtaagagcgttagctcagtttcttcttagctcccatacttgtgagtttttacacacatacattttgttgtacttgctggaaattgctggtatgcaaagtgtgattcattgaattccttttggttttggtgacaggttatttcttgtggcatggcaaggatacatattggtcttggcttgttctttcatgaatgatgtccttccgttcgaaggacagaaatgtgcaaccacgatttaattggccatggagaagcgaatcaccattatcagcacaactgctcattgatattccacctgaaatagagttatcggactacagaaggttgccaggttcaggaagcgagagcccatctggacttctccatggtgaaggcttcaaggacgaaccaattgctgacttggatattttctttgaaaggctttatgaatatttctgtgcaaaagggctacgatgcattgttaccaaatggataattgagatgcttaacgtactttttatggtatgctgtattgggttctttttcttaattgttgattggaatgccctcggccatttgaaatgtggtgtagaggcactcgaatccggggaaaaaccatgtgatctaatgcaagtcgttaagcataatccattagttccattcacatttcctaaaatgatcactattggatcaatggttatattgacaacttacggtcttatcaacttcctcaagtttttcgtgcaactcagaagtacattgaatattcgtgacttctactgtaacaggtaacatttctgattaatatgtgtgtttatagctcagtgcaatcatcaatgactgaatccaccttctcttttctttttgtgtagtctgaaaattacagatcttgagatccaaaccatctcatggcccaaaataattgagaaggttgtcctgctacagaaatctcagaaactttgtgttgtaagggacctctcggagcatgatattatcatgagaataatgaggaaagaaaattacttgattgggatggtcaataaaggcattatctcatttccaattcgtccttgggtacctggagctggaccaactgtcaaatcccatttgcaaaacaggagaaaccatctgatactcccgaaagccctagaatggacattaaattggtgcatcttccaaagtatgtttgataggtaaggaagtctgtagctctgttacttttaactagctaacattggattattcggccaaagtattttgataacatttgtttggcaaatactctgctgtcaacataatgaatctaggtatctttttcttccacattaatcctgcgtttgggagaaagcgggtgaagacacccttaagttgtcatgtaataacacttaattgcacaagagagtgcaaatgtccctaccaatctttatcattctcttttgttatacattatgttcaatctgtgtggaatacagaattgttgatgttatgcataattgtctctagctagctggttactaaattctaaacatcttaactcaagctttactgctttactgattttctgatgacttcatagagatatcgagtaatttagatattcaatctgtgtaaaagctggatgcttttcttcacccccatctattcccatcaaacagctcttatgtggattttgcacaatagcacctaaagacgtatttgtgctaagataccctcccagcttccagtttgtacaacatccgctgaaaccttctagcaagagctcgcacatcgcattgggatgttccacgatttttttgtgtgtgtagttttaacctctaaaactatactgaaagccaatatcattttcttctgcagtaaattctgtgttcggaaagattttctaacaagcccagctgtgttaaagaagcgacttgtatttgtgggcatttcaatgcttatcctttcaccctgccttgtaatattcccattagtgtacctcattctgagacatgctgaagaaatttataatcaccccagtacagcttcatctagaagatggtcaaacttatcaaggtggatttttagagagtataatgaggtaccttcttttgcagagatattattactattatgatgcagtcattgtcctgtccagtatttcttctaaatgcctgccatgtgcttactgtattatattaactgcaagctctgccatttgttgaggcctatagatactatcatgctatgcaatcagccttgtttttcttcgtctaaagctcagttgcttacaataatttcaggtagatcatttcttcagacataggatgaacaacagcgctgtgcactctttaaattacctgaagcaatttccaactccactgatttctataatggcaaaattcatatcttttgtttctggtggtttggctggtgctcttataatcattggatttctgggtgaatctgttcttgagggccatgtaagttatttcttccactttttctcatttgctattacacatttacacatgtcttattgacctactaaatctcacatacattcatatcttctgaagatctttggaagaaatctattctggtatactattgtttttggaacaatagctgccataagtcgaaaagtagtggctgatgaacttcaagtaattgacccagaaggcgctatgtgcaatgttgtccaacaaacgcattatatgcctaagaggtggcgtggtaaagaggacagtgaagtggtgcgaagagaattcgaaacactatttcaggtattttatcagttcgagagaattttgcatataccatatataatcaattagatatttagtgttctgtatactgtactacttggctttggaacttcaaccatcaccatcatcaaattttctagttatttgtgattctgctctttatttttttgtcattgaaagaactgcgcaaatgctctgggctgatgtccacataatcttatttgaacaaaattgtacaaatgcaaggtgcgcacacaaaagtacacgaaaaaaaggtggtttggcaaagagttgactgagagaattgtgcaatgtgcatataccgtactgaatcaactaatcaacatacttacttgtcctatgtgctgtacaatttggctttggaatgtcaccannnnnnnnnnnnnnnnnnnnnnnnnnnnnnngtctttctttattgagagaactatgaaaggttgtatgttgatctcaacagaatgttattcaacaaaattgtacaagtgcaatgcccaccttagagaagtacatgaaaaagtgacggcccaactaagttacatcgcagtaacgctgacaatcgtaaactcatttgatattaaagttgttcgtggccactgggtgattcagcagttgcatttttaaatgagtctcacttgcttattttgctaggtgaatctggaaataatagtgttcaaattctctgatagaactaatgacaaagcttggcattttctagttgttttatattgctttcagttaaagcgctatatctgaagatgaaaagaaaatgagtttctctttgtttaagtgctttgcagtctagatatcagtaccttacatttgtatcttggttgatttacgtttaatactctattgtccatatcatattgctctgaattttaactaagtaattttacaaatgcagtttaccatagtaatgctgcttgaagagatggcctccattttcatctctccttacttgctcatctttgaggtaccaaaggtaatgttctgaacttgctcaacaacagtgttttttctaaagttctttgacagtgaactccttttattatacagcgtgttgatgatattctgcgattcatctcagacttcacgatttatgtagatggggtgggagatgtgtgcaggttctctcttgatgtttcttaagaaatgaattttgttatcatatattgccactgggtttttaaaacatttaacatcatttattctctgtgtttcaatagcctaagcttgtttgacttcagaagacatggaaatagaaactatgcttcaccatttgatgcacttaaaacgcttaggagctcccaagggaaaatggagaaatcatttttaaggtacatttaatttcaagtttgaattacttcatgtgtttcttactagctattatattgtactcatattgttattaaaaagatatcttaagggccatcatttgtttattgaaatggctttggtgtactttagtagttcttggctctgaggttgtactgtggtatgatttgcacgctattgttatttcatactcttgttcaaactaggggggtattttagttctatgaacattttacgaggaaatgtgttagtttgtctatgtagtttgcccatgtcaacagcatagtgcatatggtctagactgtacaagtcaacattaactatggatatatgatgaaaatatttctcagaaaatcacaacaaatgtgtttccagcatttaattgaatttaccagagtattatttgagtatactgttttgtccataaatatggccaaagctgaacacttgaccatgatacttttttgggtgtcttcttgtcagcactatagactctgtagaatataggcactacggtgctgccctcgtcacatcatattccaagaaagcgacatccatttttggtttagtactttagtccaccatgtacattgcattttcaagagtgaataacagaataagcaaagttgtactccaagtttcacttgaggcttaatttggtccttgacgtttcagtccgtccatattagaccattagtccttcatgttttcattttagttcaaactcatcgttggacccacttgtgaagacatatagctaaatctaattagcatctctcttgataaatgactattattccctaatttcacatgtataagaaaaaggaaaagaaaaagacaaatatgtactatttggccagtgaacctgtttctcaagacccctccaatacccaatggttgtgtgctgtttttttttttctgttgaaatttgtgtacaatgagttctcttagataagggatattttgtaatagaaatgttgacttattattggctaatcaagtgggtgcaagtatgatttcgaaccaaaacgaatacttagaggacctgtgtggacaaaatagaacttaaaggaccaaattgagcctctggtggaactttagggactagattagctatccacccaacttccaactgtatgcaatgtgccctgctgttgtcctacaggcctaatggatactggccactttgtactatgtatagttaggaggttttagttagtcacaagtgttgcagccaagggtagatccaggcgtaggacacaacgcccttgtaattggttgttaccaattgcaaaattcgaagatacaaatggcctagcttaatacaagctagctcagcccaaggtttaatgctaaaaataggtctaattctattatatgattgtttacagttttcaaagtgtgtatccatcatgggaaccaaatgcagaaggcaaacaattcttaactaacctccaaaagttcaaggaaaagcaaatacggcagcaggctcttgcccaatatcaagcaatggaagcatcaggctttgtggcaagcaccagaggtcacagggatgatatcttccaccaactactccctagtgatatccatacccgtgctgaggccatctcacctgctgtttacaatttgggcccgttaggattgcttgacacagatcaaagaagtcatccatatattctggattggtactacgtctgccatccacctcacttggatagaaccgaggctccttatttcaacgaagtgttccctgagaccagtgagaacacaggttcagcagcatttaaagcatctgaaattgaagaagcaaggggctgggactctgatatggttcccccgcctcgagcagatcgcgatgagtggaactttaaccatgaaagggttcgaagccatatggatgcatcgacatcaagcaatttgtttcatcatgctccagtagaacaccatgataccaaaggaaatattatcgattggtgggatcaagcacctgaacattctactggtcaacaaggaagttttctggagcctccggaatttggaaatcgatatgttgctggtaaccgttccagttatcactctggtgatgtgtctgatggaagtgtggaagagcttgagcgaagctataacagaagtagcagcagctggagaagacctcaagatttgtccactacaaggtatatggacgactctgacattgaggaagggttgaatcttccttttgctgatctcccgcagaaggatgaagatgctcgacatggcacatctgatactaatgaccccacgccagtcggccttcctgtaagaataattcctagaagcagtgaccctgtttagactgaaaagctctcagatacgtatgtttgtgcatggttgtaaatatctgtgtgaaccacgtcacaaacttcaccaaaactggcaaacgccgcaaattcatttgtacagaaccacatattacctcactgtatagtcttctccctgccctcctagggattgtggagcaggggaagaaccattcttttgcagcacgaaatgcatggatccagttgttgcctcgtttcattttttttcctgcactatgttaatcaatttatgcagtgattagccattgccgcattacagaccttgcaaccatgaaagtactgtcaacttcaagtactatcgctgttcctgtagtaacttgtacagttctacctgatggctctacaggagtacagcataaagcaatcaggacatgcagttgatccagtgattgatcagcaacccaagctgtatgaaggaatccgatgctgggggccattaccttggtcgtccagacgggcaagggtcgaggcagagggaagcgtctagccgtctaccttgcttgccaggcacttgacagttcttgccaactggagctgtcatttttaaggcactaacagaaagaaaaaaaagtatttgtgagtatgtacactcttggggccagacaggacgccagcagctctagtttcattgtcgagatcgaagccaggaaaagggtcgtcctctgaaaacgatgccgtttcgatatgcagattggtaggagtaggtctagcacgcggcacgcaacaataccgacatagtccagaccaaacccctgcagcaattggagtagcagaaaggctggttggaccagctgagatccgggcccagaaaacacaagcagaaggaaaggggaccctgatgagcagcattgccatctactgctattcattgttcttcgcccaatgcttcacgtccggataaacttgcaatgaattcgagcttcgagtccggtcatgatttttcttttcattttttcagtcttcttaccggctgattctgatcgagctcgcaaatcgtcatttcaccaaattgccaacttggctagcttcgatcataaatcggctaatccgtggcggtttcccgcacgttttgctccctatggacgctacatccacccgtcgtccttggaggattcacgtgacaaggaaccctacggctcacccccaaaaatcaatccccaattagttttggtacgaacttgagctacctacatcatgcccatctccgacggaaaagagggaaacggaaactaaaaaggttacaggtcgttttcttccgttgagctactaccacgcacagctgccccgaaagcaaaaccgagatcgtatcgtctcgacgtttcgttggcaccaaggcatgcacacgcctcggtttggttcagctcgattcgatcggtggcagttggcggtaggtcggcagttgttgggtttctcctcgatcgcttcgtaataaaacctgcaggcaaagaacgttcagaaaccggtaagccggttcgttccgcacggcgtgacatggtccggttaaaaattctaagcgagcgtcagcgtcgtcctcgtcgcgcaaggaattaaacccacggacttcgtgtgcatcctggtgcgttgataagaggagaaacggccataattccaacgatgatagcaaggcaccgcccggtccgtgcgagtacgtggttaaatacttaagccgcgcgcggtgatgcgaggtgtgagcaattgtgatattttccccctctttaattgttgtttcttttcacggggacaaaagccgtgagcacatatgtcacgcatggacacctaagtggccattggactctctcaaaacgactttttaatgaggctgtagcaatgtcaaatggttttatacgcatggacagtgaagctttgtcggcaaatacattgaaaacggttacttcttcgtggtaaagcgacgttcgtacaaagggtttttgacatggatgaggattggagcacagttctttagttcaacctaagcatgttgaatcggctgtcatattccgttgattaatcgttcttgttgcctcacttcgtttaatttagactttagatgattctagttggtaatatttttagtgttctcggatttctcttgtctggccacatggcagcgcttttggacaacttgtaaacaagtggttacaattacaatcagcagtgataaaagtaaattattcagttgccacaggatatgtaaagattgcgtgtgtggaatgagttacgttaatatttatgggccgctaatacaccagttactaggctcctataacaatcaggcaaaaacagttcacagaaaacatgcccccatttgcattgcatacaacaggtgcctgaagggatcaaatgagaattgacactagttgcatttgcaggtcaaacatgatagttccttttagttaaacatcattaagtagcacttatgtacaaaccctatttacattcatcttctatctgtctatttccatgtaaaagatgcatgacccaccaacgcgtccctttaaacctccaagctgttaattaccgacaagcagcctttttcatttctactatatacacgtgacaactaataaatcctaaaaaaagagcataaaaaaatctactcaatttacaaactaacccatggaccgcccccatatttacacaagcatgccatcggatcggacacgtcatctgtactcacgagcaggatcttatgaggccaaggctgaagaggttcttcttgacgaggctccccagcgagaacagcccgccgccgccgccggggccggcggcgtcgccttccgccgagcaaaggcgcggccaccgctcctcgtccacccggaggctctccgtgccgatcctctgtatcacctcgtcgatcgtcttgggatcggcggggcggccggccacgtcggtgacgtggaagacgttcatggccatgtcgtcccttgtcgtgatctcggcgtgcgtcaccgagaggccgttctcccggaacacgcgcgtcacgtaggcgagcagcccgcggcggtcggagatgcggagctcgagccgcacgccctgcacacagaaaaaagatcgcgtcagacggacgggcaccgcgcgcgctggctgggatttcggccgaacacatggggggtgtagtggaaagtcgggcaagaacgaaagtgacttcgcggcttggtgctgcgaagtgggcacagcacagcacggccgcgatcggtggcgtggcatggagggaaagcaaaggagatactactgctactccatcacgtacctcggatgcgcgcctctcgattgccgcttgcaagcatcggatcacatgctgcctctcggcctccgagctgattggccgcccgtccgaacgccgtatgtagaactcctgcaagcggtgaagccaagcaaacatagctcaggttaagctagtacacatgtatacccaaaaaaaatgcaacttttaatccaacatcgcgaagcagaacacacgaggcaaatagcaactattccatcagcctcaccaaattcgaaatcataatttccatcgacgatggggccgacataggaatagcagtgaaatcaaacaaaaaaagaagggaaacggtaaacgtcattagaaagcaaaagcgaggtaaaagaatttgggaaaaaaatgacagaagacgattcgcctaacacaaccacccaaagaaacatctagattcgtgagaggaagccagctcaaccaaagagaagaacagagtagaggggaattggtaacaccgaacccaaaattaacaatgagacttggggaaattggaccaaccaaaacaaatcttgaaagctggatgatggggagaaacagctggaaggctcacctgctgcgcgtgatcgccgtcggtgtcgaacgtgccgtggtacaccacgtaatccaagtccgtcaaggtgcagaccacgtcgaagagcagcttcggcctgtcgcggcagctcacggtcaccaccgagtaccctctctccccccaatcctgcaccgccaccgccgtcatcggcgcggcgccgcggctgtcggcctccccgtcctctttcagcagctggtggagcctccggtccaggtttccggccgccgacggatcagccaggaccgtcctcgcgcagcgcgcgccgccgcggaggacgtgcctgaggcgggactcgatgcgcctgacccgggccgcgtcgtcgatcggcgcgcccgtctcctcgtcgcggacgaacaccagcgctgcgacgcggccgccgtgcgtccacgccctggcctcgacggtgttacaccggaggtcgtgcagcacggcgaacacctccgaaaggaggcccgggcggtcggcgcagacgagctcgagcagggtgagcccctccgcggcggggccgcccgccgccgcccgcggcaatgcttccgcggacagcgacgactcgaggcgcgccagtagcgcgtccgcgtcggccaccttcctccccgcggcgtccgtgacgtggaacacgtccatgaaccaccgcccgtcgtcggacgagatgtaccccttgcggacgcacaccccgtgctccgacagcgccgccaccgcctccagcagcatcccgtgcttccgcgcgctgtgcacctgcaccagcgtcgccgtcgcgcacaccccgctgtccaccaccaccctgtaccacaccgcgcccgcgcgcaacaacaacagcaccctcaccacccgttcgatcgatgatcccaaaccggaacacaccacaacagcaacagcaacgagaacccttacctcggggtgttcatgtgccgcacgaagagctcatacacctcggagggatggtaccgctccatcgcctctgccgctgccgctgccgcttcagtttgcccgcctcccgcaacggtttcttcccaataaatttccttcgagacggcgaagaagttttttttttccgctcggcggagtggaacaggttcggtcgggcggagagcggttcaaaatcgggcgaggaattggaaacggtgggtttttggctgccgctgcgctgcggttggctgtgccgatgctcccttgtgaggtggccgcgccgggcgggggggttgggttgggttgggtttggctcagtcagcgcccgtctaaaatgggggcaaaagattggcgcggtttcggcgttggctccctgcgagtcaaatggcggtcgcgggagaggactgggcgagtggaattgtatgcagtcgcggggttggactttggaccgaactcggctgcctggaacggggaattctttgggagatgtggtggtatgggagagggtggcgtgtggaaagtttttgtagcgttcggacaggggaaagcggctcgattggggaagagagacagcttcactggcccatccctggtggccacctgtcacccacttttcccttttcagattgttctttcttgtgttcagctgctaccttgtttgccaaaccagtggagtgtttacatgtaatttatagatataagtagggaaaatagaggttctgctattatgctctcttcctcttgtttattaccttaagctaacatgaccataaatacaaaccctaaatagcacatccttgtaagtagcaaattagaattttgttatcgtttactttgtatagctgaacaggtacacgttcgtttctacttcttgtggctgcaaccccaactcggcagtaaccgattaaagagaaaagccgcggccttcacgaaacgatcgcaaaatacgcaggcaaaggcagcaccaccgactggccgctcgcgttatacacacaccgcgtacgtacgcttctaggtggagacggaatacaacacgcggggatctgattcacacctgccacgcacagcttgcacgcacgcgagcgatatcaggatgatgatggccgatccacgcgactggtccgctcccaccgaaccgtgggggccgcgttaccggttaaggcgcgtcactgtgtcagtgatggcccagttccaccgcttgccttcttgcttgccatccaagccactgcctggatggtgaatcaccgacttatgctcataacgtgcgcacactcacccctatgaactcacacatgtataccctatccctataagcacctccggaagactgggctggcatatcttgaaattgatgaagtcaccacagacgcctcgctgtcgacgggtacgtcgcctaccactgaaagaataattagccgtaaatgagagcctgtttagttcgggaacaattttttttttcatgccacattacatatacggatatatatttaaagtattaaacgtaggctaatgtatggtttaattcccaactttttctttaaacttctaacttttccatcacattaaaactttcctacacacacaaacttaacttttccatcacatcgttccaatttcaatcaaacttccaattttagcgtgaactaaatacatcctaataacaaaacaaattacagattctgtctgaaaactgcgagatgaatttattaagtctaattaatctatcattagtaaatgtttattgtagcactacattgtcaaatcatgtagcaattaggtttaaaagatttatctcgcaaattacacgtaatttgtgtaattaatttttttaatctatatttaatactttatgtatgtgtcgaaacattcgatgtgacatagattgtttgtgaagtgaagtaaacagggcctaagctgtcaaggcaaaaacaaggttaagctagttcactctctttggaaagtggaaactccatcatctgggaattggggtacgttcactgtagtaggagactaggagcagtagatatgcggaggttctatggacactgttactacgaaaaattagctgaaacgtgagtgacggaagacaaaaggggtaagattgttacgagctgatgaaacgaatcctgagtacagaatatactctctatttattctctttgatgttgattagtttaaaatgaactaaacaatatcgtaaaactagaaacagagagagtagataggatggacggaaaagaaataccagtaagactcaactgaaaatacaggagctagtcatgtgaaattggaagtggtatagtagctagtatagatcctaaaaattcacggctttcttagctgtgaagggaggccatggagcagctgataggagagatctagaatctaaatctcataattaaagccgtttaagtatccaacagtggatctatggaaatgatgttgtcctttcagcacatgcctttttcccccaagttttcttcgatcgtcctgcagcttgttattaagttagctgtaccaggttgtgaatctttcaggctagcccagttcgtatcaatgtgacatttcttccggagttagaggcgtccattttccatgcttcggcggccatctgtgtggtacgcttgcatagatgcatgtgaaaggattggaattgctgtgttccttgtaactgatgtacgaaaagcacgtgcctgcagcaaggacgattggacgagccctctcttggccaatagtaactccgagattttgggcgcgtgattaacttcagactttcagagaaacatgcatatagatctcggtgagaccagggttttctttttctttttaatacggagtagtatatcgaaacaagccaataaaacgggcataatggcaccgcgcgatcgcgtcgccgcccctgatccgggtcggtgccaatctccaagaattcccgaaacgaaattgcaacggcgacggcgacgcggcacgattggtggcgtcacgggaccgcgggaggagtggcgttggcccttgggcctcgcgtacggccggcggacacatggagaagtgcgtccccccgcgtccgcatgtgcccgggttgctctgagagagacggcagcctacgcgtgtccaacccgacgcggccacgtgagccaactagaacgcgcgggcatggagcggtggcacatgtgccgcgcgcgcagcggcaccagcacagcagccgccccatgtgggtgggggtacggtcgcgcaaacaccggtgcgcccgccagatcccgcggtgaaaccaaggtggaagacggcgcacgggacaacaacgccccgcacgttggggcgccgcgcccggttctcaccctcaccctctcgatccctttccgccccgcgcgcggttcggcgggtggccgcgctcccgcgcatgtggcgccgtcgcgcgccgtgtccccccaacccacccacgactgccacgagccccagagcccgtggccggtacccatgtgcgcttgttttacggtgcggcgttttgccggtttacacggtacactagcccacgacacagtaccactactccagcactcaaacaaaactactacttcctccgtcttaaaatatagactcaacacgatctctaatatgctactttgactaacaatatctatatagaagtaagatgttttaagaaaaagagttacatattacgatagttttttttaatgacaaatctagtaacatcaattttacgtgattattattttttatttttcactattaatagttaaagttgaaattgtttaacttatacacggtatactagcccacgacacagtaccactagtccagcactcaagcaaaactccattctgattaaggaatcagatacgtgccaggtttaccaatgattccggggacggcggggagactcctcactgcatcactaccagtaatccagtactgcacaccgcgagtccgcgacactcaggatctctatcaaggaatcagatacgagcccaggttacgaatgattctggggataagcaggccgctggaacctccccaatctaggaggacagcgacacggacgggctacttttgcttcagttctccgagtcatcagcctgccaaatagattagtgaagggaaggtaccaccttccttggatgctttgttttagagaaagcttaattgcagtgttagcacgaggtccgattcgtgttacctttcggttacgtggtaatgtcggcaagctggacgaacaacgctacttgaccagctttaccagacttttagtttaaccaaaggacgttctcgtagccaagtaatcaaagggaagtcatgtgtgagtcaccggatgcagttggtgattgctgttcaccaaactctctcctatatgttgttagaataaatgggctatgcccaatttatcctattgaatctcagatgcccataataagtgttaagaataataataccacctcaggatttaagcgaggaatatctcaacctaaatagggagttattggaggctccctgttgactggttgaggtgggggttggaaagccacacgcgcgcgcgccgggccgagggagaggcgtggcgtgcgtcacatcacgtcgctactcttttgcaaccactaacccacgttcctccgcaacagcgcgtccacgatcccacgttcctacgactgatagataaggacgcgtccacgatcccacgtttccacgactgcctctctcctaatagataaggaggccgatagggggatcctctagagtcgacctgcaggcnngtnnaaaaggggtttcaaatcaagccctg

SEQ ID NO: 53380 - DNA, 1253 bp, Oryza sativa
ggcaccgacaccgcggcgggaaggacgtgggcgggcctgtttccggtgggcctacctgtcggtgcagtgggcgggccgcgtgggggtgggattgaatgcgcgatgggccgtgggccagggacgctgcaggtgggcccgcgtcgtactactatttgtttatccgcgctgggtggagatctttccgttttggcccttcggcaaatccatattccacaccacattgctgccatatacgaggtggtgtttgacatatacggagtacgaagttgaggatgaagttataaaacgagaaagctgattaattatctcttaatactataaatttaaaaataaatttatttgataagtattatattcgtctaaaaaatatatgaatctaaaactagatatgatattttctagtataatatatctagacagcaatgtttagccgtttgaaaaacgtgccaaaaaatcaatgtaaaatcatcttaatcatttacagcaataatgcgatatttggaggacggattcgcagagaccctggatccaaccatttttggtctaagatttggccgctgatcagtttgtaattagtttaatccgaacgtacggttgtctgattaattcctcttctccgaccggctcgctcacacgcacaaacacggcacactccactcactccactagcccccaacactgctactctcggtgctcccctcccctccccgcgctagctgtatgccgcctttataacgcggcgaggcagccagcttcccccaagcccagagcgacgcctcctcctcctcgcagctccgcgagatccacccggagcccggcaatcccaggcgaggtaagatcccctcctccattgccgtcgcgcttgctcttcttctgtgtcggtgctagtttggtgtggatctatagctcagttttgtttggctcgttcgttcgtttggttgatggtttatagtgattcgttttcatggggacgatggttaatttagtttagtttgcgttcagctcgggggacacagatccgggttttgattcgagctagcgtgcggggtttccgcgtgtggtcgggggtgttttaatgcacgcgcttgattggtgtgggttggttgtttccatgtttgttcagacaaggggagatttgcttgctagggaagatggaaataatcgatttttgcgtgcaatggaatgcatataattttttccttttttttggggcattgttcaattggtgtcactgatgggcagatccagtgtct

SEQ ID NO: 53381 - DNA, 2140 bp, Oryza sativa
  unsure (1)..(2140): unsure at all n locations
aaaaagataaggaaaagaaaaacacccaagtggttcttaacctggctaccttttttacctttgcctttgtgtgcggcatctgaattgaatttgttgatcttgtgcgggtgcaggtttcggggtctaaaatgtgttcggtatcttttccgtttttcttccctggtatatgaactattaagcacgttcggtttttctttcatttaacaccttgaattttcgttggtcaaatgtgcaaactttcaatgttgacgggtcaatgagaatttattgtagttagatcacgaaatcgcatcattggattgtcatcaaaatagtttgatagtttcataattttttttcacgtgtaagttgtagctgtgaacttcacgtcataattttgtatgaaccaaaaaatatataaatgtaaaaaaatgaggaataacaacttaaggcggccgcattaattttttatttaaattaggaattgaaagttcaattttgtagcggatactccctccgtcccataatataagggattttgaatttttacttgtactgtttgaccactcgtcttattaaaaaaatttgcgcaaatataaaaaacgaaaagttgtgcttaaagcactttggataataaagtaagtcaaaaaaaataattccaaaattttttgaataagatgagtggtcaaacagtataagtaacaactcaaaatcccttatattatagaactgagggagtacttaacatggttaaatctatctaataatttcttaactcccctacgaagcttaggtgtagtgataagaaaaatcgagaaggattggtacaagttaacaacttaatcaatagattgtgcatatagcaaacaagtctatataataacacaaagagaaagaaagaagacccattttagttgatagtggtattattacccaaaaattaaaaatacgttcaatttagacctacttttataagcatcatgccagctacagctacagtcacagcctctttcatccctttttctttcttccaaaaaacgctcacctgtagtgatggatctatgtgaaagttgtgaggtcgaatgtcgaatgaccctacagcttcttcacattcattcttgagtactaaatttttcatggaaatccattcaaatctacacaaataatcccactgaaatatttaataataataatcgatctcacaaagtaactttatctaataatttattgactccgccactgaatttaagtgtagtgataaaaaatcgagaagaaggtttggtgcaaattaacaacttaaacatgaaattaaattgtacatgtagcaaccaacctttataataacacaaaaaaaaccattttagttgaaagtggtattgctaaaagagttaaaagtatttcaatttagagcaacatgccagctacggctacagtcacaacccctttatcctttttctttcttccaaaatacaaacgcttaccttacagtgatggatctatgtcaaagctgtggggtccgttgaccccatagtttcttaccatcatcgtttagagtttcttaaattttctatatttatccgttgaaatttacacaaataatcccactaaaatatatagtaatgataatcgatgtcacagagtaaatttgctggctctgccactactcacctgtaaccccccaactatgccaccaaacacacataactcatcgcctcatcatcgtcatctatctccgcatgagaccgcatccttatcccaccacgtccccctcgcgctcacgcgcacagcaacaaagaaaaaaaaaaaaacccgtcccttttccctcgccgccccaccgctcccccaccccacgtgtcgccggcccatcggcggcggcgcctgcgtgggccgtgtggcccaccctgcggccccttcccgaaaacggaacgccccccccctcctcccctctccacgtcactgcgcggtgggcccgcgcgtgcgtccaagaagcgtgacgtaagcagtgacagaatccgcgccgcctctcggggcgcccacgtgtcgtggtcaaacggtcagcgcggggcgggggctcgcatcgcatctgctccacgtgtgcgctatnnnnnnnnnnnnnnnnnnnnnnnnnnnnnnnnnnnnnnnnnnnnnnnnnnnnnnnnnn

SEQ ID NO: 53382 - DNA, 2255 bp, Oryza sativa
cgccgctgcgccggccttcccatcgccgtccccatcatcgccgagatcgacctctacaagttcgatccatggcagcttccccgtacgataatcctcctcctccatcctcccaatcatcaccaccatcaacgccgtcgtgaattgattgattgatttggtttgatttgttggtgttgtgtagggatggcgctgtacggagagaaggagtggtacttcttctccccgcgagaccgcaagtacccgaacgggtcgcggccgaaccgcgccgccgggtcggggtactggaaggcgaccggcgccgacaagccggtgggctcgccgaagccggtggcgatcaagaaggccctcgtcttctacgccggcaaggcgcccaagggcgagaagaccaagtggatcatgcacgagtaccgcctcgccgacgtcgaccgctccgcccgcaagaagaacagcctcagggtaagcaaaaaccacacccaagattccatcactaaattcattactaaatctgtgttcatcgtgattattgattaatttagtcacctaattattcgcccaaaaccgcagctcgattcgaacagctggtggtacttctagatggatactactatttagatatttgatatatttattttgcaacttgtttaatcagctcatttcgctttcgaaatgaattgggaggataagcttagcgtggcccacggctttgggccgcagaaattaattggagacgttggctcatctcatctctagggccgcacctacgtggtgcaacttgcgcagccacgatcgaatcgttcgagcgtgaaacccattgccgtcaccacctcgcctcatccctttcagggaccaatcggtttttagccctacgcgccctgcgatcgcgacgcccacgatagctaaatcccgaaagcaaataagcagtaatcggacagcgactcgaccgggattagttaaacaatggcttgattaattagatgctggaatttggagccttctgataagtttagggcctgtttggcacagctccagctccagcttcaccccttctggagctggagctcagccaaacagtttcggctccaccaaaacggggagtggagctgggtggagctttctcacaaaatgaactagagttgtggagttgggtttaggcagctccacaactccactccaaactcaactcctggagttaaatttaggagttggagctgtaccaaacaggcccttagttttgcacttggtactttaatttttttttgagtgagtgtaaatttgtttctaaactttgtttatgaatttgttttgtattggtgcagttggatgattgggtgctgtgccggatttacaacaagaagggcgggctggagaagccgccggccgcggcggtggcggcggcggggatggtgagcagcggcggcggcgtccagaggaagccgatggtgggggtgaacgcggcggtgagctccccgccggagcagaagccggtggtggcggggccggcgttcccggacctggcggcgtactacgaccggccgtcggactcgatgccgcggctgcacgccgactcgagctgctcggagcaggtgctgtcgccggagttcgcgtgcgaggtgcagagccagcccaagatcagcgagtgggagcgcaccttcgccaccgtcgggcccatcaaccccgccgcctccatcctcgaccccgccggctccggcggcctcggcggcctcggcggcggcggcagcgaccccctcctccaggacatcctcatgtactggggcaagccattctagacgaccaaaaaaaaaaaaaaacaaccgcattggcagcaatggtgtcactgaacaccgtgcaggctagctagcttcatggccggtgaactttgactcaggcgagccgccggagttgactcaaagataattaaaagaagtgttttaagtggattggattggattagacagaggagatgaggactcgagaaaggcggcgatgagaccgtggttggggggaccctggcctggactgaacgacgacgaggcagcagcagaaagatggtgcaattgcatcgggtggcatgtcagtgtgtgtgtatagtggcatgtacatagtacatggtgattgattcggtatacagggggctagctttctgtttctgtttcttcattggttaattattactcccattataaggtcttcttcagggttgctagcttaattaattaattaattagcccagtggttgaagtgtaagtcaaaattca

SEQ ID NO: 53383 - DNA, 1136 bp, Oryza sativa
cgacaaagtttgataaataatctctaatcgcgtagacggcgccggcgccggcgatggcgtcgccgggcgggaaggggctggtcgcgtgcaacgcggccatctcccgctgctcgcgcgcggggctgcaccggcgggcgctggcgctgttcaccgagatgcgcgcgcggggactccgcgccacgagtacaccctcccgccgatcctcaactccgccgcgctgctccgcgccccgcccgcggcggcgctccacgcgctcctcctccgcgcggggctcgcgtcgcacctccatgtcgccaacgccctcgtcgacgcctacgccaagctgtcccgcctcggagccgcgcgggcggtgttcgaccaaatgccgcgccgggacgtggtcacctggacctccctcgtcaccgggctcgcccgcgccggatcccacggcctggccgttcgcgcctaccgcgacatggtcgccgctggggtcgccacccgacgagttcgccgtctcgggcaggctcagctcgtgcgccggctcgaccgcacttgagctgggccggtcggtgcacgccgcggcggtccggtccgggcacgagccgttcctttcggtcggcaactcgctcgtgtccatgtacgccaagaccggctcgctccgcgacgcgcgcacggtgttcgacgcgatgcgctcccggtgcgccatcacgtggacggcgctgatcgtcgggtacgcgcagaacggccggggcagggagtccctcgccgtctacgccgacatggcccgctccggctgcaggcgggactacgtcaccttcgtcggcctgctcttcgcctgcagccacgccgggctgctcgacgccggccgcgcccacttccagtccatgcaatccgagcacggcatctccccggggccggaccactacgcctgcatggtcgacctgctcggccgcgccggccgcctcggcgaggccgtcgacctgctcgaccggagcccggcggccgagctggacgccacggtctggaaggccctcctcgccgcgtgccggactcaccggaacgcggcgctcgccgagcgcgcggccgggatggtgtggaggctggatccgacggacgccatgccgtacgtcatgctgtccaacctctactcgcgggcg

SEQ ID NO: 53384 - DNA, 1218 bp, Oryza sativa
ttgttcaggacaagcatagtgaatacttgtgaactatcaattacacgctgaaacatcctgcagcattacttgcagtgagaatgtcaaaacaaggtacatgtgataatttcaaaatgttccagccaattcacgataatctaaagtagaatggaaagttgaatctagaataattataacatgatggtgtcaccatgaccatccgatacagtttccttgtcttaattcagtaattcttaagagagcacatgttgtcagatagatgttttcagaaagtgtaaaaataggtataaagctgaggtgaacatacagggcaactaaaactacagagatcgactagttgcttcctttcccatatggtaccgacaacaaattatttcagaggtgttatgtagtcgttagaatagagctaacgcaaggtgcgaagccaaaatctcggcaaattatctagcaagaaaatattgtaaagaacagatgacctattattaacctcatttacattaaaaaaagtggatagccacagttagattaaattagtttaaactgattggccatacctttggaaccacaaagcttgctctaacgtctctccaatatgacaagttaccaggtacatacattgtgtcattggattgcagttcattatttgaaacatctccactgggagcagacgcatcaccttttcctgtacgtagaaattatcgatttggtcatttggtgagacctacgactagttaatcaatcaagttcatgaattatgttttccacaaaaaacacatgtatcttatgaggattgaaagaaatatatattatttttaataacacaatgaaagaaactgccacggtgccaccaccacataactcaaaagttatccatttgcattccataaagctcgcatccaatgatccactttacattgtctttttatactaatactaagaaaataagaaatgccaaacacatgtaatatgctaatttagcagtgtaagctagaatacaaaacaagcaatcagaaaccttcagagaaaaaaatcatataaatatcagatttcgatcatttctacgaccaaataagcatagcaaaccattttacaccaattgcaccatacttgcaccagaaacatttcaatctccaaagatatcccaatcgtaaatacgtcgaattcgttcattaccagcacaaaatttacccccaaacgtcatgaaacattacggctaag

SEQ ID NO: 53385 - DNA, 955 bp, Oryza sativa
tcatttgtttggagcacagtttagaacaacttacaaagtaatttgtaccacagacttcacaagcattttgatagccataccaatacggattagtatgtttagttatggtaggaatggttttctatgtaaattgagctgtctttatgattctgatataagtaacaaatgtggaaatcctatacttagccatggcaatgcattactagaagcaagcaaactgtatcaccatgtataagtagtcttctaaaagtccatttgaggtgggctaatttgatatgaaaaacccaggaaataaagtgcaacaaatatctctatatataaatagtaaaaactactagtagcacaatgtgtgtccacgcacaaatcatgatttaattatgcaaaaggaagaaatataaaacgatgtacaataggaaataaagtgcacctctttagtaattgtttggcagtaatccctggtgcggttgaagatcataatgcggttgcggtcaatcgtgtcgcgcgcagcaatgagaccaaacacattgatcggccactgtaagccccctcttattccctttattttgaccgagatgatctgcagagtgtgacggactgaaatatgtctcggcatagagtcgtccttacggtgtgtatagcgcatgggtggtataggcgctgcatgtagcgagtatcaatcaaccaaagaatacatacagtagataatgcaatcctaacaaagtagtgatcaaccctaaagaacccaatccaatcaattcctatgtactcccaatgaattactatcaatatgctatcaaggagtatataatataaaaggaatcaaagaatgtatcaatgaattactgacagattgtgtcgtagggaccgaagatggcggaccaacggtattcccagtcctcgcggtactcgcgagccttgacgcccggtgtgtcggaccagtcttcgttggggtact

SEQ ID NO: 53386 - DNA, 2379 bp, Oryza sativa
  unsure (1)..(2379): unsure at all n locations
atctaaagtttagagacccaaagtttataaatcaaaagtttatatatccgattcaaatttgaatttaaattcaaatatttttatataaagtatttctatacatctaaagtttatatacctaaagtttatagacccaaagtttataagtcaaaagtttttatacccgattcaaatttgaatttgaattcaaatattttttatatatagtatttctatacacctaaagtttataaacccaaagtttataagtcaaaagtttacatacccgattcaaatttgaatttgaattcaattttttttatatatagtatttctatacatctaaagtttatacacctaaagtttatagacccaaagtttataagtcaaaagtttacatacccgattcaaatttaaatttgaattcaaatattagtttataatgttttgcttgtgtgctttgtttgtcgcgtaggtcggccgtttcgtcgatccgcggtttctcgaagacgttgctgaggtctcatcagttcgagagcagggcaagtcatgcaatacgtttgatcatattgtacccaatttacaaatatcccacatttctattaaatgttgcattcttttacaatatcatgtgggatgggtcctactactcagccatatattgatttccttatgccattgataacttgggtattaaaatgactagatgttggtttaggaaatgcttagccatgcttagttcaactagtacacaaatgggggtcacattattacatagactctgactattggcatagctttagattggtgccaccgcaagggtgtcagttaattaaatattctgaatggcgggctgtgagtgcatggttttgcttgtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgaggtgttcggttgtccagctgccggattcaccgcggtgcaagaggggaccgcccactgccttttgaggggtgggggtgaaaccttagcgtggtgtggatggttaggggaggtttatgtggagggtcttgtcacaatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttttactgctttcaactactgttttgaaatgcctgctttatgcaaaagaacccctagcttcctttggttatatcctgcatcatacctcctcttccggtatgacttgctgagtacagtgggtagtactcagtcttgctctcttttcccccacaccagagttgaagttcttcttagttggagccgtctcagagaggttggtttcgtcgctgccgtcaaggtttgcctgtggagtggagtcgcccgctgctgaagtcaagcttcccggtttagctcgctttaatctttcccgctgcatttgtaatcttttatatttttgtaagatgtgggtctgtatgtcaacaattgtcgtttgtgtaccctggctggtcctggacagggatttaatgcacattcagcttagaaattctggttcgagaatttctgggtgtgacaaatagataccttgatgacccggtcaaaacttggccatggcaaattaaatcccaactttgaagggatggaatggccaatcatggacggccggtgagtgagaagaggatggtgccttgcccttgtcatgctctgatcatgcagttggcctctggaccaatggagaaaatgcattgccatggaaaggagatgagaagggtgtggtacactagtagtagttcagaggacggccggcattgatgccatggaggagccctcaatgatcaggcactcgtgtgcgaagaagaaaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53387 - DNA, 1024 bp, Oryza sativa
agccaacaaggttttgacaaaaaggtactattgacgatccttcaatttttgccctttaaagggatataagatttgcaatggattattggtatctttaacgggtatatgatttttactacccttttggtcttataaattgcattactaccaagtagagtcgttatactgagaccatattgccgttcctgtttgtttgacagaaaatgccatactggaatcatggaagaacaggagttggtagaaactaaccttcccaagacataaggcaagaacttcactgaagtcaagccatacaagtagttcccaagagagaaaggtaataggggactaagccgcagcagagtaacaaccttaaatccattttcacctattgctttgtcaattgccagaaacttcttgtttccttcaaccaatttgagaattcgctctctggcaaagtatctagcaataagaaaggccactgctgcagctagctgcacagttggcaaagcacaataagaaaatgcagctgaaggcagagttaacaacagaatgctgttgatgtggatttacttactgtcccgctgattgagacaataactgtaccagtaatactaccaaacaatagacctgctgacattgttaatggtatcgctggaatcgcaaggacctgaattcaaagaaaatcatagtattattatgaaggtgaagttccaatccagatgtcaagaatatatgacaaaagcctgtacaaatggttgacagggctaaatgtagatcgttagtttatttcagagttcaccaatatcaaacaaagaaagaaatggatgccctccatcaagaagtggctttatccaaaacaaaagtgcctattgcctactcactcatattcaaacattttggcacaacaaatttacaaagtgtgtgtgtgtgtgtgtgtgtgtgtgtgtgtgtgtgtgtaactgaaaggcaaaaatatcagccttacactatcactgtaattgactagctagtttaggtgaaaattatagaaacgaagacactg

SEQ ID NO: 53388 - DNA, 1315 bp, Oryza sativa
tagcacaaagagtatcaaaaaagaactccttttcactatagttgaagtttgtacaggaggtttacaactacaacattgccatcagattgcttgctagcttgacatttccccaatgaattcaacctttttgtctgatgtgtaaaacttcttaactacatcattcatacttggtctttggttcctttctttctccaaacacgacgtaccacctccagcatcaacgccacctgtgagtaaacgaagctaccattcaacctacgatccaccaagctgattacccatgtccgatcaccaatcttcaacccttccctgatcttccacaccaactgtctcatcgcaatctccgcatcaccaacgctatccgtggccaaatccgccattctggcccctctaaccagctccagaagcacgacaccgtagctgtacacgtcaaccttttcggttatcggaagactcgaaacccattccggagccatgtaccctctggtccctctgatgctaaacgaggcgggatcatcgagatccctcctctgttgcatcttcgcgagcccgaaatcgctgatcttgggctcgaaatcctcgtcgagaagtatgttctctggcttaacgtcgcagtggatgatccagtcgaggcactcatggtggagataggccaaacctttggccacaccaacggcaatgttgtacctttggttccaattgagagtctccttggcgccaaacagccacgtggcgagcgacccgttgtccacgtactcgtacacaagcagccgccgccggcggtggcgctccgagcagacgccgcggattctcaccaggttcatgtggttgatccggccgatgacgctcacctcggtctcgaactcgtcgtccccacgctgcggcgtcgcggccttgagcttcttgacggccacggcgcggtcgtcgccggcgccggcgaggacgcccctgtacacggagccgtaccggccatgaccgatcacgtccttgaagttcttggttgccttcctgagctcgccgtaggtgaaccgccggaaatggtcggtgaccaccctgtacccttcctccgccgcccattgctccgacgtcgccggccggctcctcgccgtgaaccaccacccgaaggcgatgaagcagagctccacggcgaagaacgccgagaggaacccgtagtagtagcgccacgacgacgtgtccggggaggcggccgagaaggagaggagaacctcctctgttcgcgcggcgtcgcaggcgagattaacggcggcggcggcggccggggcggcggtgtaggtgtctgactccgccaccaagt

SEQ ID NO: 53389 - DNA, 1105 bp, Oryza sativa
cgaggcacgccgccttgcatccgtcgacggagatggaggagaagaggttgaggtcggagccccagaagtctgtttgcggcagccgcgcgaagcccatctccggccggccaccgccgccgccgcaggtgaggttgaacgtcggccggcagcccttgccgcggtcgccggcgtcggcgggaacgtagcctggagggcacgagcatgccggccgcggcgtgtacacgcagaggccgttccagccgcagaggccatggatgccgcacggctgggagaaggccatccaagaaaccgaccaccccccgtcggcgtcgcgcaggctgtacagccggaggttgccgtcgtggtccagcgtcagccgccgccacgtgacgccgccggcggcggcgcccgtgtcggacgcgacgaacgtggtgttgtcgctggcgaggaacctgccggcgtcgtcgagcacgccccggcggctggcgttgtaggagatcctgccgttggcccagctgctggcgtcggggtccggccagtagatgttggagatgtccgggccgtcgtacgccagcgagaggaggtagcggtcgtcgaaccggagcgcgtagtggctcgtcgggtggagcacgtccgtcgtggacagcctcgccgtcgccgtcaccggctgccccggcagcagcgtgtcggtcgggtagtcgaagctctgccacaacacgtccccgccatggcttgtcacgacgaggttgccggagtccgtcagctccgcggcggcggcggcgccggagctcgagttggtctgccacaccggcgtgccgtcgtagtcggcgagcacgaggcggccgtctcgccgcagcgtgagcttcgaccccgcgccgtgcaccggccggtcgcggttggccgtccaggcgacggtccggccggcggaggcggcgaaccagatggagacggtgaagacggtggaggagaggttgtagaagccgaacgcgaagacgccattggaggacacgaggatgtcggaggcgcgttccgcggagagcgattcacctctttgaaggcggctgccgccatgagccggagaaagaagaagaagagcagagaacaagaacgcgaggagcatgatcaa

SEQ ID NO: 53390 - DNA, 1708 bp, Oryza sativa
  unsure (1)..(1708): unsure at all n locations
nnnnnnnnnnnnnnnnnnnnnnnnnnnnnnnnnnnnnnnnnnnnnnnnnnnnnnccactttgtgcacgcggagcaatgtggacatataatggaataaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgatcgcggcgtggcagtcgccgcacacccggaggttcttgtacacgcggatgggcgcggcggctggcacggcgaggaggccgaacgcgacggcgagcctttcgccgtggtgagccagcccccataattgtcacactaaaaccattcagaaaagtactcatgattaccctgacaggacgtgcaagcggttttgcagcttgttctaccatgctcagagccactgcaaagaaaatccgtgaggactgggatgctcgtggattatttacaatctaaatcataccataaatgtatggtaaggggagacaaaggaaacaggaaaaccttttccaccaaagctgtgaccaaccagcacccgtggggttagcctgagctgcactatctgttgcattttggattaattagcataaggtgacagataaatgggaaaaaggctgaggtgaactgaaagctactaagatataaaataacaagaaatgaaagcccagtcccaggaaaaccttttggacaatgacatggcctccaaaatatatctttgactatgtttttctgttataatatgtacaataaataaaaacatttttacttttattatagtatcttgtaagacaaatatatatatattgtttagtgcctttaaactaaatattttaaaagttattgataatcaaagttacaaacgtttgacctaaaccttgtcctactaaggctgtgttctaaactcccatttcccaacttctatctcctcattttttgcgtgcacgctatccaaactgttaaacattatgttttttgtaaaaagtttctataggaaagttactttaaaaaaaatcatattaattcattnttaaagtttgttttagctaatatttaattaatcatgcgctaatctgccgtttcgttggaaaccttcactcacaaactcagcctaagctaactgacatgtgcatggcggcaaaaaaggtatgcaaagttctcaagcattttgagttctaaccattctctcaatgcaacaaaggcatataacacaactacccaagcacatgcatatatattttgtgattccatatattgatatttgatatcagtgccacagacatatttaactcagtgtgtagataatagaagctaagacagaaatagcagtaagacgaaaacacaaaccagctttagaacatcaagagcagttgaggcaacagtatgcggtcctcttttcttaattgacgctgaatctccatggcaacgcaaatcaaccaagaggaactgcatgaggaaaaggcaggtacagtttctttctttatgctgtgaaataagtcagattgcgagcagaattttagataaagtaacctgccacatcggaaattcctgagccagcctctttgcaaaagatccttcaaatcaacacagttaattaattttgtgattaaatgcatttatacagccaaaacagctttaaaatg

SEQ ID NO: 53391 - DNA, 935 bp, Oryza sativa
atctatatatatctcgccgatgtgttggaagcatatgcatctctgggtagcacgcacagtgcggcatgctgccgacggcgagcacgtcacgtggcacctgccggcctccgccgcagaggtggcggcggcggaatcctcctcggccctgctgtgtcggcgcgggcggtgctacccattacctcttgccggctgtgtccattttttttctctctcaatacgtcatcgacaatatcggtagggacacaactatatgtgttacgggtgcatgctaaaaaacccgattcagaaatttttttaatgattcgtctatatttaccatatatatactatatatcattcaattcaaatttaaatacatatattaatctaaactcaatcagtaaaacaagtttaaacttgatcaataaaacaaacgagtggcatatccttctatttcgttttagctcctgagtgtcgactagggtgaatttctttgacctattgagtattgacagtcaggggatgttctgccgacattcacgtaaattatttggaggccacatctcatcttcatctttattgttcaggtacaacggctcctcctgtacgtagccaacttcctcttctcagttctcactcaccaacgagagaaaaaagaaaagaaaaaagcaaaaaaaaaaaagatgggttgcttcccatgtgatgtgcgtattctgaacgattcgtctgcaactgcatcgtcagctcgggtcgatcgatggatggatgtacggttcatatctgacgtgtgatggattcgagcatcactgacgaatcctctcaccggggtcaaccacagatcgccgtgtcggagcggggcccacctggcagccacagcacagtgaggggatggatgagcagaacgccgtgagagttcagagaaacatccatggagcccccacatgacgctcacatgg

SEQ ID NO: 53392 - DNA, 1518 bp, Oryza sativa
ggtaaaaaaaaaagccgaccgtaaataaaataaataaatcgccgactgcaaaaaaaaaaaaagccatccggaaaaacagatttggtatatgtccgtctcttttatccttcttttttttcccatttttctttttttccatctgctttttttcgttcttttttccatccatctttttttcgccgttctttccggttattttgccatcgcctttttatttttattcttttttcccgtccctattttttattcatattttttttggcacgcggaagggtgtgcgcacttgcttagaattcttttttttcatctactcggttttccatcggtgggccgaaccctaacaccacccgcacatcgatcaaccttctcatgctttccgtcctccaatttattataaaaatcaattctccactacccatcatcattttccacatattttttcttttcagctccgctttaattcaccatattcatattcaatctctatttagaagtcaccgtttatatcccacagttttgtggattcgctccaattttgataaaaatgaaaagaggagatcgagtgatccaaaagccctcaaccaattttaggagatcaagaaagatttgaccggatttgataggaggatcggtcctagcatcatactacacggactgtattccggaggttgaagatggcattcaactatgcgagctaggcctacattctacttgtagagtaggttcaagagaagcaggctaagcacagggaggcggtgggctagaccgagactgaaaaggaaggagcaacttgtgtttttgaccgaaaataaagagtataatgtttttctagtcgaattaaaaattcaaaagcttcgagttcgaggcctctacgtgggcctgcggcccaaccaggcccgtcgtccatcccctctccatcagtcattccaaggtcaacccaaaccctacctggtccgcgagtgcggtggcgatggcgacattctccgatgcgccgcccggggacgcggcggccggcgagaagatcttcaggaccaagtgcgcgtactgccatgccgtcgacaaggccgccggccacaagcatggtgagccaccgaaccacctaatgcatatagctcagtgttcgtccggttggaggattgttagattgtggaggtttctgcatcgttttactgctctgatgcgtgatggcagggtttccaggttgccatcagatagttggtttgtgtaatatatgctacttagatcttacagctagcacgtgtctgtcgctgatgtttgatttttgaaatcaccatgaatcatacgagggacatgcgttgaccatcttgctggatttgctggttagctggtaatatgcatttaagctctctgagctcttctctctcgatgtagtatactcagggccaggtgtacatatgctagttttaatggtaattctaatgatcctatacatctttggcggttatatagtcttcgtttatcggctagtctgtgaaatgtcaattattaggccctgtt

SEQ ID NO: 53393 - DNA, 2011 bp, Oryza sativa
agattaacaagcaaaatggtctccacttgtccatgtttccgatgcaagattacatgtgtgcgtccaactaggaagattcttccaaagctaaaacaatttgtgcgagaccaactagtaagtttttttttctaagaaacacagcataaacgcagccatacaggcatccagaacacgcacacttacccctatgaatgtacactctactcatacgaacacctccagaagattgcatgccttgttctagtatttcttccattgcgtcgttaggtccacacttgctcaaacgcatagtaattttttttcaaaaagaaagaaaaaataaatttgaaataaatggcacggtcgcagcagatgtctgaagaatttcgttaggaatttgggatcagagaaaggacattagaaggccctaatttgttttgagtgctagctgctgcttatgacgttcacttcgctttgctcctgtttgtgaagagtgtgattccaagagacccatcctgtaagagaataaaaagtgacacaagacggcaggcccactaaaattatgacagatcccttcaagccacacagatcacatgattgcagtactggcagcaccaggcaagtaacacaagtggtcgagtacccatattaccccaacctaaggaatcctatgttctactactactacaagcacaaaaaacatgacaggaaaaacaactgcagaggggaaaaattgccggagaagggagggtagaggagagcttgtagaaacaggacaaatgacaatcacaaaaacaggagacaattttgtcccagttgactatgcccagcaacaggggctttggataccaggcagtgtgcatctggatcatgctaagcactctatgcagggggaggaaattgtaaacaagctcacctgcccactgatcgatccattttgaaggagacatccccagatggacagatctatgccaatgtcaaagcatgtagggcaggtgagccatggaactttgcagagtacgagagcagccaatgagataaacatagtaaagattcatcttttagccatatatgaagcctcaggcccctcctccagctctctacttcagtatatttcatgggacatatattctaagtgggcaaaaattgatttgaattgagttcctatattgacttagtttggtcaaacatttgcctaatcttcattgctcacctgttagttggatagggatggagggcagactggcaagatggtggtccttgcttagcatatgctaccactgtatttcccccaaagctatttataactgacagcttcttcttggcagacctttaattcaacacaaagaagcaaatataatatatacttgcatagctgtcatggagagaagcagctaaggaatagaggacaaggctgaggcccattccagcctatgccatggtggaatttattagctaagatattattgtggagcagcaaaaccaaccaaaagtgaattccaactcagcctttccagccaatgccagatgcacagctcctcagcctttgcaacatccagctacatgccactttgataaatgagatttgagtactaaactaatgatgagtcaagctacttggaaactttacaaaaacctttgattgccacaaaactgttatcattaaggtagtaagaggaagaaagaggaagaagaaaagggagaacatagtagaagggcaaaaggaacaggtgaatacttcttagtatctaggtacttccttgagagggagcatgggcattgcagcacttggggatgaacctgaaggtgagggtgatccaatatgagcaccactacgagaggagaatccaatttcatcaacaccatcctgctgaagttggtcttccctgatcatagtgcggaaagatatggaaccacgcttcgttgaagtatctgagttccgttcaatttctcgaaagctctggttggctacaagcgatgcaccttcatagtagtaatcatcataaggaaccatctctgttatttccctctg

SEQ ID NO: 53394 - DNA, 1432 bp, Oryza sativa
gtcggtcggttcaatgcgcacgtgtggggggcggacgtagttttgtctttgagggttcatggggagaggggtgggagacaggctgtctccagttgtcttgcggctcggtgggcgccgagcctccagccttggccggccccaccccgagccgacgtggaacaagcccggggtgtgtaatcgctgggtgtacacgcccccatatcgattccattccaccacagctgctgatggtggctcttcttctcttcgccggcgaccggcagaccgatatcggagatgatgaagtgcgacggtcgtgatttctattgtagctgttgataggaggcaaatgggttcttctcctatggcgcaacatagttgtgtttcttttttcttttcttcgccggcgacttatatcggagatgatgaagtgcaccgatcatgcttttttggttgtagcggttgatatgaaacaaaagggctcttctcctccggcgcggcgtagttgtgttttttttattttcttcgccggcgatcgatgttggagatgctgaagtgtaccggtcgtgcttttatagttgtagctgttgataggaaaagaaaggggatcattgacatggtgacgtgtgtagcattatatatcacggagcaatcatgccatgatttaattgtgggttgtggactgtgtgaaagaaaattagagggaaaggaaaggaagggatggataatctttatggcaatcttgtgtttgatacttatggtgagattgaaaatgtacaataagagaccaaagaggcgatggagaagaagggcatgttctcctgagctccttggttattgattcagactcgtttgatcctatttaaataacagggatgtgctagcgtctttggatactgatttcaacggctcaatagttatatctatgtcatatgtatttatcatgtgtgtttcacgtatccaataccaaagtatcactctttattcattaaataatattaataaaaatgacttagatattattctattcatgtagatgctaataaaatatatatatttaaaaagttagctaatcttgtatatctaaacgttcatccctactttatattaattctttcttctctcgtgaagatatatcgtcctttttttttagcttttggatgattcatcaaggatataaattatctcttgatctcttctgcccaaaaaccatactatataatccaattatttataatcttttgataattgatctaagtatgaaacatataagcacatgagagaaatttaagtagtaagaaagaaaatttcacaccatatatctaccaacttatcacattattctttcgttgtaatgcgcgaaaagctaaaaacccatctagcactagtaagttgacatggcacatggttttgaaagaaaatgtttgtgttattaaaattgtctaagattttt

SEQ ID NO: 53395 - DNA, 1005 bp, Oryza sativa
gggggcacgtgccggacacagagtgggcgctgcagcactaggcgccggaggggaggggagatggggctggctcaccacggcgagaggctcgccgtcgcgttcggcctcctcgccgtgccagccgccgcgcccatccgcgtgtacaagaacctccgggtgtgcggcgactgccacgccgcgatcaagatggtcgccgaggtgtacggcagggagatcatactgagagactccaactgcttccatcacatgaaggatggttcatgttcttgtggagattactggtaactggagcttagtacgattgtgttgtctttgaccatttttggttgattcactctataggcaattaggcatgtgcataagagagagaaccagcattgcattccaacgagcatctgggagtcctttgaaaaattgcttgaatttctagtagatcagattgcatcaaagatgacagtgatgatgtacaatgggctagtatgctagtatcagaaggccgcattttactagagaatcctaccattctattcatcgatctcctttacagcatcctgcaaataacatagttaagaacagttagaattggctttcgaaaaagagaaattgaaacccaaagtgaccactaacgaaataagcatatgttcaaatactgccgaatcccatttgttcagtatgtgtgatagatcatagcaagtcaatacctttgcaagtcgtgttacatatgtagcagcaatggctgtgaataatagcccgatgcccagtgtcagtagctggctgtttcctcccaaaccgatctctgactcatcttgctgtcaaaatgagagccattcatgtttgacgtaaaaaaagcagcagtaagaaccatatgttatgatttcaatagtcaagccaccagataagcatttcaaggatagcatgtgttctgctgctatgcaattatgcaaatagagaaggaagacaagcaagatcattcggtaatgacatgaaaaatctctcctcacccca

SEQ ID NO: 53396 - DNA, 2051 bp, Oryza sativa
  unsure (1)..(2051): unsure at all n locations
tattttaagcatttttttatttttgttaatttgcactcttattttgagactgagttggaggaagtagtgcattagattgattatgaattactactgaccatgagtatatggggaatgttgtgaagttataataattatatttaacgataaatctaaatagaccaatttttaaaagttgattcgaaatgttcaaatactccgtatgtcccataataagtttatttttagcttattttatctgttccaaaataaatttatttttaaagtaatcattacatcggagtttgtgaaagtaggacatacttgtattgagagtaaataaaacgaataatagttgcattgggatttgataaagaatgaggattatagtttttttattttatattagtatgtgtgtgatgattgaaaaataaacatatttcgaaacggaggaagtacatattagtaagtaaaattaaaatttgttgactgcacatattagaaaatgccacttccttttgatgaaaaggagtaaatggtttacttgtgataaatactgatgcagtgaaattcattaagtcaaggataatacaatgtactccctccggttctataataattgacgctttagacaaggttaaggtcaaacttttataactttgagcattaataactttaaaaatatttagtttaaagaaactagaacaacatagatttgtctttcaaagcactataataaaagtaaacatgcacttatttattgtgtatattataatagaaaaataaggttaaagatatattttgtaaatcgtatcattgtttaaaacgttaattaaaatgaaaccggaggtgacatttatattacaacctgaaatcactggagccggtctgtcggtccggtcaataccaacaagcggtgcaacatgggagggattgactacttcagatcggatgcttttattcagttttgccgcacgttttcatgctttttaattcgttggacgcttgtttttttaatcattttttttgtatgaatggaattattcagacattctccgcctaaatgaaacgaatatgccttttggtgtgtggttaggtattgccgcccatgttagtggctactactgtagtcttttgtcacatcactggacaaggcaaaactctctacggtcttggatgatgctgcactagctaggtgatcatacctaaaaaaaacgtactctggagtgtgtttgcagcaaaatatgttaaatatgtacattcaattttttgttattggcaaaaaaaaaacaacaaggtgctccgaaatcaacatgaaccactttgaagaaaattttattaaaatgattttcctactgaaaaaacaaatttaaaaactcacagaatatgcttagtatttatttaaattattaatccgaataattgaagttacttgaatcgggttgaactaattaatttctagacactcagagtgtgtttggataatgggaaatggagagtggaattagaattgggaaatgaataaagggttaggactaaatggaagatggagaatgaatggttagaatttaaagataccttttgatgggtgggaaatcatttcccaatcccattatacaaataatgcctcaagagactatgcagtattaacaatggtttgaccctcctgagaggtttgaccccgccgcctcagctttacgttgctcacgtaccggccagaaatatcacagcacacacacacggttaacttttttcccgcgcgaaatctctcgaagtgaaacatcccaagcaaaaatccgatcgattcggcgagctagcaggtcaactcgccatggctgacctcccatgcatatatatacgcgtattacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggagcaggagcggtgcaggtacaggggcgtgcgacgacgacggtggggnaagtgggtgtcggagatccggg

SEQ ID NO: 53397 - DNA, 1785 bp, Oryza sativa
cgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaatcacgcagtgacaaaatagcaaaaaacaaaaattaagattggtattaattggctgatgcaataataaagttcaaaaaacactgataagcaattgagaagatgctgtgttgaccatgcttgcggccaggaacgcgccagtagccgatagctgtgacgtcaagagtgactgaaagttccataaccaaagtggggttcccatcgatgatttttgcctttccatttggtcatttgtttctatcagaattcatttctgtcatatagaacagctgctgaaacacttccactatctgcaacttacatactctccataacacgaatttgacgttgctgaaatttcaattttcaaatttattcgctgcattcatcgcagacttggcagtaattctggtattacatggcctggttgtgaatgtactgcaggtaacatctgctcacgtcaaaaccggtagactctcgagtgtagaccaactcttcagagagtatgacaacggcaacaacgcagtaattgtagttactctcgccaagaacagaacaaagtccaggcctccagggcattcagaaacgttgaatagttgcacacttgcactgaaagtctgaaatttacctgcagttctgtcagaaagtccactatcattttttttcaacccttttgagttcctgtgtcttcctttcacacagtagtttaattccatagccgttgctgtgactgtgaattaatgaattactaatcaatagggggattagacgagtagtgaggacaagtactgaaacgaacgcgggtattggcacgaaataaaaaggcgttcgtgagtgagtgcaggattgtggcgcatctgaagtatctgcttctcactgtcgcaatctgaatctccctacctttgtgcctgacgcgtttagcttaatcttgtgcaatacacgtttgactagaaaagcaaaacattttaatgatttaatctctcgggcaatagttgtactacttgccacttaagccttgcttgaacagtcacttagagagtgaagtacagtaaatatcagtaatcacacaccatgaacacaggactgagcattatgaaaactcggtcaaatgagccaaggcaattatctcaatttcggatttttatgtggcacatagaaaattgatggaagcatgtaattccagtaattattcacagcccacaccgttctatcaccagtactccataatatttgttcaagtaatacagaggacaaagacgaccacatgaaactactactaggactgttcaattaccctggccagtgaccgggcgagattattcccaattatgtacaaaccaagcacgtcaattgtgccaaactatgctagcaagcaagaattttcacgagccatcttcctttggcttttgactcagttctgcgtactggcctcccatcagcttcaatatctcagtccataggcaagaaggatctgttgcaagggagtcgcttatcaggcctgagctacaggaagtgacatgccagtatccttgatcaatctcgctcaacaactggtcgtaatcccaggcagagtacccaacatagaagtttaagtcctcaggcttaaccgcgc

SEQ ID NO: 53398 - DNA, 991 bp, Oryza sativa
acccgatattaataatatagtaagcaactattgtataaattagctattacattagttatagatgatttggagccagtagttagctaatactattaaacttgctctcacgcagatctggaccgcactctccaccctccctcgtggcccgtgcgcgcgcgcgcgcgcgcgtgcgtagcgtacggcgcatttcctcggcaccttccccaacttggccctgtacgacgttgttgactgcctgcggttacggtatggacgcgggtgccgagctgcctgtgggttggtgggtgggggtgggtcgctcgtatcgatcttgtcctcgattttatttggggggttaacttgccccgacgatgcgtgcgcggtgcgccccgcctgcctctctcgcccaagtggcctccgcctagttggcacgcggccggcgcgggagcccatggacgggccatgcccatgccatgcatgcgccaccccaacccaagggccagttgggagtgatttccttttggacattttgacttgacctgtgtgggcaaggttcagttaatcagttcgatttcttcgcacgtatttcgcgtgcatgtggatacatatatacgttcctgcgcaggacttttctttgccgaaatcttacatggttttatcgtttttattaccggtttgtttcgatttgcaaggtgcggctttagttgtgcatgctagaaaacgagtgtacagggcgaaacttcagcttcattgagaattgggatgacgccatgggattctttggccaagtgcgtaacgtaagtgatgatatgcacatgcatggatgtggtcagctcgatcgaagcaagaagccagcgtcgggtcatctggtcgctagttttgtttgcactttgcacacggcttcatcattgtctcgtggccttcgttttctattatactcataaatgggatgagtttcctgttcggttgatgatcatgttctgttttcagcgatcgtgttctcttccgttcc

SEQ ID NO: 53399 - DNA, 1994 bp, Oryza sativa
  unsure (1)..(1994): unsure at all n locations
atgtgcagagtgagcagcaggatggggtattttcttagtagtgaggttagcatcgagatctacaaatgtatagctgagcagtagacctgagcattgcacgggtggcacctgagatctctaaataaaatgtctgaaactctcaaagtcttaggggaagaagtgtatatatatacacacaaagtcagacgattatgataatatgatattagatcgcgacagtggagcatacatacatatacaggtggattaattgtttaactatatatatatatatatatatatatatatatatatatatatatatatatatatatatatatatatatatatatatatatatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacaagagatctaattaatatacacttgtatgtatttgaatcggagaaatataaatgtagagcatgtgtactcacaggaaatttgaacttccgcctaagtcattctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgagccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtctgtgtccctgatcctcgctccgatcatctctctaccggtggcgctcatctccatgtacagccgatggaacttgtacatttgtgtgggtagggactgcagcagctcaggcttgacaagcggtttaccgagttcgtacatgtatttcacttccgccttttcgattggtgcgactcctagcaattgatccgtagttagaccgtnnnnnnnnnnnnnnnnnnnnnnnnnnnnnnnnnnnnnnnnnnnnnnnnnnnnnnnnnnnnnnnnn

SEQ ID NO: 53400 - DNA, 3083 bp, Oryza sativa
acatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaacggtcaccaacggctcgatctcctggtttggttgctctccaagctgagggactggtttggactttccagaagatgctttcttcagcattcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgctggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgctgcttgtcgcccagggaggatgatgtaccgcctgcgccatagaataatggcatggcatgtgtctcgtagatgcgtctcaccgtctcctccagggtaatccagctcgaggtcctcgtatgcgccttcgaccaactcaacttcgaccttggagtatcctgctggaatcggcctgcagtggtaagtacctgaagggtccgttgggatggccatgcccgacgccaccttcatgttgtgagagagtatttattagtaatcaacatatataagcagcaactagcggaatggctaaatcttacctttattgataagttcttgaaaggaatatgcagctcacatggtgtccgctgagtgatgtcatcaacgggacaggtcgattcgtccagtgtttgcatggcgtccatgctctgtgatcctaactgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcgaaacgtgccctgagaggaggcttccactgcatctgttagtcgtcgcgcagcctcttgtatctgatagccgaagaccagtgagccatcagctaggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgtttaagtactggtttggatcctcgttcccctcttcttcattccagtactggctgcttccctccgcgattgtatcgtacaatatctgttccttatcgcggtcagccatctgttgatacaagaaacatctgctaagtcacgagacatttatgttttaacaatctaagtcatgtatgctaagtgtaattgtcgtacattagaaccctacacaaccttacgtgctaagtctaattacaaatcgtgatataagctaagtctaggtgacgtatattatacaaccctagctagtaaataattatatactaaatctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctatttacaaataaagtaatattatattaaaactcaaataatattacatgctaagactaaaatagtaatgtatgctaagtgtttcgtgcgtatatgctaagtctaattaagactacaatagtcaattgttaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaa

SEQ ID NO: 53401 - DNA, 930 bp, Oryza sativa
  unsure (1)..(930): unsure at all n locations
aggggatcgtccccacgctagacggaggggcttgcgctcacacctctcgccgaagcttcaaggccatgagacgagagcttctggccgctgttcccacgcatgaggtggtccggaaggcgcgctagtcagaggtgaatctcacattcgaccagagcgaccatccgacggtgctctctcgggggggggggggggagttggccctgttggtctccccgaccatctacaatgtcaagataaagcgtgtgctggtggatggcggggccagtctgagcatcatctccccggctgcctttgacgcgctcaaagccccggggatgaagctccagccgtcgctcccaatcattggcgttactccggggcacacgtggccgcttggccacgtagagcttccggtgaccttcggcgactccaccaacttccgcaccgagcggatcgacttcgatgtggcggatctcaatcatccctacaacgcggttctgggcagacccgcattggtgaagttcatggccgccacccactacgcctacctncagatgaagatgccgggtcctgctggtcccatcaccatttttggtgatgtcaaggtcgccctcgcctgcgcggagcagcgcgcagacaacctggcggtggccacggagccacaggcccccgaggcctctgcgtcccgcgcttccaagaagcgcctcacctcggctgacgaggtgccagtcaaggaaatcccccttggcaacgatccgtccaagaccgccaagattggcggaaccttggacgccaaataggaaggcgcgctcgtcttcttcctgcgggcaaattctgacgttttcgcatggaagccgtcggatatgcccggggtctccagggaggtgatcgagcaccgccttgccgtgcggccggatgcgcgacctgtccggcagaaggtgcggcgtcaag

SEQ ID NO: 53402 - DNA, 836 bp, Oryza sativa
  unsure (1)..(836): unsure at all n locations
gccgcccccgccgctttcaacactcccccaccgccacagcccccgatccggctgtgctgcggcggcgacggccgtggagcggtgtacggcatcatcccaccacgctcttatctcacacaggtttcttggtttttatatttttttcacacaagaaagagagagagcactagacacggtctggctacttatataccttggagcaaaacagcaaatcaccaatcaagctaaaccaatactgagatggtcatcacacaagttgacaacttactcaattacacttgccatttgtaacggtggtttttgcaacttggagcaagtggtttagggtcacttgtgagagttggggtcctttgggatggtgttttttctagcatcagggacaacaattaaaccgcaggtgatatgtacgtatgctgctctgtcgccatgtaatgtcatatagtcataatggtgtagactgaggctgtatagaatatgcgcttcttctgttatgagtccgagtgtctcagactgtttatcgatagattgcaggagccaaccgagctatgttaaggtaccctgttcagatctacggatgtagttgtgaaagctatcttctgagctaagttaatccaccatcagtctgcgcgctgtgcccatatactggccatactatgcatagttagctcagtcagattcatctagtagaattagactcgatagctnacagcccaataccattctaacttatgatgccatatgtttgagcctatgaattagcatgccaacgttcagtgaggcaggnnnnnnnnnnnnnnnnnnnnnnnnnnnnnnnnnnnnnnnnnnnnnnnnnnnnn

SEQ ID NO: 53403 - DNA, 846 bp, Oryza sativa
agcgccacgctcctcttcacgaggcggccctcctcccacactcacccctggggggggggggggcgggttgtagggcctacatagcgagtctccggaatgtccagaaaaccccgaagtttcgccccaaccttacgaagaagtatgatggtagcatcaatccctccgagttcctccagatctacaccacggttatcgtggcggcagggggtgacgaccgggtcatggcgaattactttcccatggccctcaagggtcaggcgcgtggctggttgatgacccagccccccgactccattcactcctgggaggacctgtgccagcagtaaatcacgaacttccagggcacgtatcctcgcccgggggaagagacggacctacacgctgtacggcggaaggatgatgagtccctccgttcgtacatacagcgcttctgtcaggtccgcaacactattccgtgcattccagcccacgcggttgtatatgcattccggaacggcgtgcgacataatcgcatgctggagaaaatcgcctccaaggagcccaagaccactgccaagctcttcgagctggcggacaaggtggcccggaaggaggaggcgtgggcctggaactctcccggcaccggtgcggcggccgcggctacccccgagtctgtcccccgctctaagcggcctgataggagaggcaaaaggaaaccagcccgctccgatgacgagggccatgtccttgcagcagacaggcccacgcgggccccgtgcaaaggaaaggcccccggcgataagccgagccccactgttccctctggcgagggccagtcggcggacaagtggtgctcggtacacaaca

SEQ ID NO: 53404 - DNA, 942 bp, Oryza sativa
  unsure (1)..(942): unsure at all n locations
nnnnnnnnnnnnnnnnnnnnnnnnnnnnnnnnnnnnnnnnnnnnnnnnnnnnnnnnnnnnnnaaaaaaaattgacaatattgaaattgccagtatactataaagtagaagaaaagaacaacaggaatacgactaaggagggtcctaattcacaagaccaacaactcatttggacatcaaggtacttcaaagtaatatctacctgttcaataaactgaatgtatcttgtaacgccagttttgaattgagttccacctccagggaagacaagatagtcaccagattttgttacccagttttggtccttcttatactccaccaatttagggtgaggaacattgttgtaccaaatctggatttggaaatgaaatgagatggcttcaaatagtcagttaatggcatcttaaccataagatattcatgtaactatcataaatacacacactgcactcactgccttgaaagttgaaagcctataaaacgatactagtggttaaaatagtatatgcacaaaaggaaatttagccacattaaaggatcactaagcacaatctgcttgacacccaacattacagctcttatctggcattctctattctgcctcacgacagtagcttcctaaaacagaagataacagagaatgttcttagagtgtaatgaacactaaggaatattatatacgaaaaatggaaaagagtatcaacagccagagccactttccctccctcaccgacggaggcaagcgcgcgaggtcctcaccatgtcacggctgcgcggccacggcacgggcgaccggtacccggagggcacccgcaccaggcacctgggccgcggcgccacggggcagtggcgctcccggtgctccatgtggcgcctcgagcgcagcgccttgatcgccctcatgttgtcgaggcacgggatgtagtccgccgacgacacccct

SEQ ID NO: 53405 - DNA, 2691 bp, Oryza sativa
  unsure (1)..(2691): unsure at all n locations
nnnnnnnnnnnnnnnnnnnnnnnnnnnnnnnnnnnnnnnnnnnnnnnnnnnnnataacagagaatgttcttagagtgtaatgaacactaaggaatattatatacgaaaaatggaaaagagtatcaacagccagagccactttccctccctcaccgacggaggcaagcgcggaggtcctcaccatgtcacggctgcgcggccacggcacgggcgaccggtacccggagggcacccgcaccaggcacctgggccgcggcgccacggggcagtggcgctcccggtgctccatgtggcgcctcgagcgcagcgccttgatcgccctcatgttgtcgaggcacgggatgtagtccgccgacgacacccctctccccggcctgcaagtctcccacctcaccttcgccgccggctcgtccccgccaccgccgccgtcgtcatccgccactccctccgtggcggcggcgcccttatccgcatcgagccgtggcgactcgctacttccaccaccttcccctgctgcagcgtcggcgttgacggcggcggcggtgtcgtctggtcgcgatgcggtctcttcggctttttcggttgcgtcggcgctctccccggcttcggcgccgccggcgacgaccgcgggaggcgcgagcgtcctagtagggcggtgaggcgggaggagaggacggagagggattgcgcggaggggtcgaggaagagaaaggcgagggcgaggagcgcggatacgaggaggaagagcgacagcgagaggaggaagggccgccgcttgcgctggtcggaggtgggcacggccatcgtcgctgctccctcctcctccgccgccgtgaagagatgccggagaggcggagagagatcgaagacggtggtgccgatggtggtggtggtggtggttggtcacttgttcactcggttggtcggtcggttggttgggcgggtgggaggacggagtcaggggggaagtggagcgtcgcggccacggcgggttgcgtggttggccttggccggccgncgncggcggcggcggtgacggtgacggtgggtgcaggtcgttttcgacggtggtgatgagccttcttccccttcgattttggtatagttcgttgttgcagagctagtgcgatatctgattttgttatgatttgttgcagctagtgcgatatgccggtatcccgtcgagtccttggcgggttatctgactctgacgaaacgtgattattccattctggttatcggtaatgacgcactgaggaaagcggtaatgcaactatacccgttttgccagaactcattcaaccctctcgtctacgccaatcaccgagtcaaaaaacattcacctggatttcagttacagactagtaaaaacattcacggacttcagtaacagacgtacggagaagtatacaccctccgtctaaaaaaaccgtatatatattataggacaataaatctgaacagatgtatattcagattcatgtattaagatgtgtcacacccagtactagattagttttttatgggatagtaatagaatgtgtcacatccagttctaaattagttttttatgggacggagagagtagggcttacagctacatggtattgcaccagaaaacgaaaaaaatgtagcctctccgaatcgatggagggcacatgccgatcgatgtgagagcatcgccaacaatttttcttaagtcctcctcatcttaaaattaaggaatttcattttacaaagtaattccaacagttctcctaatcgtctactcaagaattagaatttcctttcctgtaaaaatcgctatttcacaatttaagcatcacatctactcaagaagttccctttcccgtgaaaatcgctcacaagttgggcgtcacgctcgctcctaatcgatcgtgcaccggggaggatgaggcgatcgtgcgacacatcaggatgcaacaaagatttatgttagtagtttagggtgtcccatatttttatttcagggagtcaagttttaggttatgagaaccataattttaagtcctaaatgcccatcaaagaatcctgcaataagattattgaattggaatttaggggaactgtgggccatgctctgaatgcagtgataaggtagagccgtagttgtattcaagtgatacttgcttaaggtgtgaagagggagattaccattaaacttcagtaacaacacctaaacaactaaaccctgtacatgtttctgggggagaaaaaacaaccaaaattacaacagacaaaggatgaaaaactctatctgatctgtgcctgcactcgctgctgacgctggttctccttcagcttctccctgggtgacagtttgtcaccgatcagcgtgaccttccaacagtctgcttggaggatgaaaactgacccagcttttggcacaactgcaggttcaaactttgtaattaagccacaaagatatgcagataatatctatagaatcgaatgtctccatgcaaacagagattgataacaccagccgatggactgactgacaagagtatttcaggtgtctcgagcaagaagcgttcaggttgctggatggaaatttcaagtgcgtagccctcagagcaatacataagctttcataacagagcannnnnnnnnnnnnnnnnnnnnnnnnnnnnnnnnnnnnnnnnnnnnnnnnnnnnnnnnnnnnnnnnn

SEQ ID NO: 53406 - DNA, 703 bp, Oryza sativa
gtctgccgcatggttggcgacgtcggagttgggcgaggaatacgacgcggtgtgggatcgcctcaggggcctgcggagcctaggcctcacgggggcgatggtctttggcgattacttccgccgccgcatcgcacccctccaggaatgatcccgtggagcgtgggaatacactggtcccaacgaccccatgcggacgcatgtgggcgagcgctgggactggggtgaggaggacacgaagagggtgattcggcgggtgctgggcctagactccaccgagccaacactaatccctgatgggattcttcccctctgctgcgaccgctggtgagagctcactagtgaactgggtaccgttgtctgtaatgatacggttgggcactccgaatcgagacgtgatgcccctgatgaacttaagagcagaatgcttgtcgattttgacgactgggtaggcctcgggccacttggtgaatttatcaatggcgacgtacaagtgctgatacccgccttgagccgccttgaacggtctaaggatgtctagcccccagactgcgaaaggccaagatagtggaatgacctgtaagatttgggccggctggtgggtctgcttggcgtggaactggcatgccttgcaccgctggacccattcttgggcatcttgtaatgcagtcggccaataaaaaccttgccggaaggcttttccgac

SEQ ID NO: 53407 - DNA, 1539 bp, Oryza sativa
  unsure (1)..(1539): unsure at all n locations
nnnnnnnnnnnnnnnnnnnnnnnnnnnnnnnnnnnnnncggcataaagcattttctgggcctgcggataccgggttttcacatctcgaagtgcctcgctgacgaagtagacaggccgctgcacctttcgggggggccggttcgtgctgtcaagggctggtaactcggggcgcacctgttcggaggtcctggggggatcccagactgcctcgggatcatcaagctcagggccacctgccaaagcctccgctcctcccttgggggcctcggggccctcctgggggctagaagctttgggcgctagaccttcgggggacgaggggccatcgcaagccggagggccctctcgttcgccttcctcatgctcaactactagggcggcactcaccacatggggggtcgcggccaagtagagtagcaatggttcctccggtcccgaggctaccaagatgagggggaagtgaggtaagctttcagctgattgagagcttgctcagcttcctccgtccatacaaacggcccggagcgcttgaggagcttgaataggggcagcgccctctcacccagcctcgatataaaccgactcagggcagccatgcatccagtgacgcactgcacatccctaagcttgctggggggcgcatcctctctatcgcacgtattttctcaggatttgcttctatgcctcgggaagagactagaaaaccgagaagtttgcctgccggcacaccgaacacacacttatcggggttcagctttacgcgcgtggacctaagactatcgaaagttttggctaggtcctatagcaacgtgtcctggtggcgcgtctttaccaccagatcatcgacatacgcctctacattgcgccctatctgattacttaaagtaatacgagtcatgcgctgaaaagtagggcctgcattcttcaacccaaaaggcatagttgtataacaaaaggtgcccacaggagtaataaaggcggtttttttcctcatcttccctagccatacgaatctgatggtacccagagtatgcatctagaaaacacaaaaggtcgcaccccgcagtggagtcgactatttgatctatgcgtggcagagggaagggatctttggggcatgccttgttgaggtcggtgtagtcgatgcacatccgtagcttgccattggccttcgggaccaccaccgggtttgccagccactccggatggatttcctcgcgaatgaaatcagcctccaggagccgcgccacttcctccttgatgaaggcctgccgctccggggcttgacgccgcaccttctgccggacaggtcgcgcatccggccgcacggcaaggcggtgctcgatcacctccctggagaccccgggcatatccgacggcttccatgcgaaaacgtcagaatttgcccgcaggaagaagacgagcgcgccttcctatttggcgtccaaggttccgccaatcttggcggtcttggacggatcgnnnnnnnnnnnnnnnnnnnnnnnnnnnnnnnnnnnnnnnnnnnnnnnnnnnnnnnnn

SEQ ID NO: 53408 - DNA, 859 bp, Oryza sativa
  unsure (1)..(859): unsure at all n locations
nnnnnnnnnnnnnnnnnnnnnnnnnnnnnnnnnnnnnnnnnnnnnnnnnnnnnnnnnnnnnnatgaccaagttggccacgtcgtccagccagcgctaaacaggagtctccggctccgggtttaccgggggatgccgtagaagggcgcctgctgcctgaagcgtgccttggggcgaaccgccgtctccatagtcgagacggcgtcgtgccccgacgcatcgcggcctccctccgccagggggcggagagagagccgaaccacccgaacgagtgggatcctccctcggcgaaggttcgcagcggggaggagttggagaaccatggcgacggtgacgaggacctcggttctcgctggaatccccactcccggacggggtgggggtaaatgccaccgcctcctcctctacttccaggacctcgaccatggtcggctaaggcctggagaaacttgggacggaagaaagcgacttcctctcggaacgcccaaccgccccctacctggcgcgccagctgtcgagggaagatcctcaatagcggggagtcatgggaccccccccccctttcgtgagttcggccgggggcggaggcctgcctctcggaaatcactcgctcgtccctaagattaccggcaagcttgcacgtagtcggattatacaggttcgggctgttatggagcataacaccctactcctgtgtttgggattatggatgagttttacaagggtttcttcactccagagagcgcacttgcttcctctcttcttgagttcagattttctgggagtcgtcccctcatctcagtgggaagggtcctccttttatagcttaaggggggtaccgagctcgaattcgccctatag

SEQ ID NO: 53409 - DNA, 1190 bp, Oryza sativa
catccatgcattgaacttagatgtgtatgtcaaatctaagatttcgaaataggaaaatgcatatgctagattctatgtggttgcatgtttcctcgctgttagattttaatctaatggctaggaagtcgtcttcaaccttacaccaagggagagggggactagggaaggcaagaacataaaagggagggtagcttaccgatgcagccaactagctccttaactatcctttcatctttccccattgttcgtgacaccagactccaatgaagaatttacagatgagggttaggattttaggataggggaaagagggcagattccttacgctttgagggatttccagggaggcggcagactagcactgcgtgacggacaaggacaggcggcgaggccagatgaagctagagggggatggttgatggggttagcggcagggcattatatctagagtggttaggaggcaagggcatctcgatggcgcaagccaccggagatggagaagacaggcaggatgaaagctagctctcgctgcccaactgagaaagaggaggaggaggagaggggagaaggaggtggaggagactagtggtaggtctcaccagcagtagtgtggctgggagggtaacacgctagctcaggcataggagacatatgttcgagtggtgcgcatgtgaaagataggaagaggaagagagataagataatgtgggtagggtaccacagttgcacaaatcttaatgtggtctggatcgtctaaaagctactaaatttatgggtattatcatgtgactaaaagctatacaatccctcataaataacgtacgtcaagcaaatacctactacatccctcataaataacgtacgtcaagcaaatacctactacatccattctagaatgtttcaacttagattgctatgtccagatttgtaggttgtaatatttcaggacgaaggacgaagtatagccattagagatctcatatccaattagtgtacccttctcttcttacacccaacgcttgtatattgggatcctctctctaagtatgtagtagaaaataggtactatataatattatatatctagtaagagggtaggtagttagacaattttggcagctcatcatcgatatctagtgccatacaacacacaactaatttactgtaaactactatatctatatgtatat

SEQ ID NO: 53410 - DNA, 1778 bp, Oryza sativa
  unsure (1)..(1778): unsure at all n locations
ccttgtcgtagcgagggcggcgtcgacggcgctgccgaaggtgcccagccagtgccgcttcccgcggttgggctcgcggatctccgagacccacttgccccaccggcgctgccgcacgccgcggtagctgcccggtccccgtttcgctcgccgagacgcccgggcacgggcaccgccggcggcgtcaggctcaggcgtgtcgccgttcttcgcgcgagcttgcttcttcttcctggccgcgctgcacgtgaacaagacgatgataaacatgtcaaccacaccaaaaaaaaaaagcaaaaaaagaaagcaaaacgacgcactcacagcacgaaatggattttctaagttttgtttgcagcaatttgtatcatgctgattgttctgtctggaatttactcaacgtcgactctgctttgcccagctaaaacctttgatggttctgtctgccttgcaaatttgcaacagagaacaaactcctaaaatttaacgctttgtttgagctttggaactattcaggccaatccctgttccatttcttagtgatcaatcctcagttcctcacctatctctacggtggaaatttatctagaaatgtaacggacataatagcaattactccatccgttctaaaatataaacatttttagcacagtcacatgtcaaacatttttaactttgatcattaataacaaaaaaaattaaaaagatcaatcatataaaattgatgttaccggatctatcatcaaacaaactatcgtaatatacaactctttttatttaaaacatcttacttttataaatattgttggtcaaagtagcatatctaagaccgtgctagagtccaaaaatacttctattttaggatggagggagtagcaaacatgaaatagaaaattaatccgcgattatttttttcagaaccaaagttgtaataacgcacaatctcaacatgtttcccctcctacgaacacatctatagttccaaaagaaacggtcaaaattttttaacttctaaaaaaaaaacctatcccctctaatttctccacaaaacgttcaaaaaaactctttgcaggtacactctcctatcctacgaaacaccgttatccaattccaatccttgggttacactaaaaatcctgcaccattgcaccatcacatcgcaagcatccacacatttcagacattcagttaggaccaaatgtctgacgctacctgcgatgatatttctgcctgcacaatagcggctaaaccacccgtatttctgaacgcgcaaacaaagtactgaatcacgccgccaaaattaagctcttacctcgacgacgccggcggcggcggcggcatcgctggcgccttcgtctccacctccatccccacgtctccttcccccgccgccatcgatcctcgcgaccgaccaacacaaaaatccacaccggccgcggctcttctcctgctcaatctaactcctcaagaaaaaaaacctgagacacaacgagatcgagaaacatgtgactacgcaacccacattgccagcgacgagaagatcgagagggtacccccaatatccatacttggtgcgcaaggcaaagaggggaaaggttcgagcggatggcggcgcgctccagaacgaacggcttcttcagttcttcttctccactccactctccggagacacgggtaaggcgcgcctctgtgacatggcaggtgggcccnnnnnnnnnnnnnnnnnnnnnnnnnnnnnnnnnnnnnnnnnnnnnnnnnnnnnnnnnnnnnnnnnnnnn

SEQ ID NO: 53411 - DNA, 1112 bp, Oryza sativa
tccaaacagtcccgcagtcttgggtttttcctctgtcgtgtacttgtgtcaatgacggtgggcacaatgtaaacaccgggtccacatgtcataggtagacccctcttcttcatgttctgttgatgaggccccgggtttgttgggatgaacgcttctttgctggtggaccgtggaactggtccatatgtagctgtccgtgacggccatgtgaacatttgttgggtcggcccggcccagcctggcctgaattttcctaagcttgggccttgacttttttgtgtaaggaataacttgtcaacgaatctaattctcatcctttaacagaaaaaccagatacaactagatacaacaagtccctcaactattaaaaaccagtgcaaatgaggtccctcgctgatttggacagcggttttgactgacgtggtgactacgtagctaatttgactcggtcttcatctaacgtggcattgacgtggcaattcgatccagaaaaataataaagccgtgggaccccatatcaatttcacatgcaaattaataaaaaaatggtgggggtccacgtgggccccaccgtctatccgcagggtggcgttacttgtcgcgccgaagtcacattggccaagggagagtagctgcatcatgttgcagctgccgaagagaccagcaatcgcgtcctcctcgaagccgaaggttttgcaaggtgaggctggtgaggcacctgaacggggccgggtaagcgtcgaagagtgactggaagcgttgtccgaagaggcgcctctgttcgagggtcgcggcgccggcagcgacccgatcggtccacatgtccatctcaaggctctccaggctgctgttgctgccgtcaaggaggaggtcgtcgacggcgcgggcgacggcgtgcagcaggtaaggctccgcgatgaggaagctgagggacacgctcttgatggctctctccgcgcttggagccaacaaccaccttgtcgcgttagcatacgccgacatgatccggtgtctgtcgtccgacgaggaggagtcgccatggtcatgcggcatgaagtctgcgacatcgatgtcaagcctatgggagagcagatgagggacgcgcctctacc

SEQ ID NO: 53412 - DNA, 1666 bp, Oryza sativa
  unsure (1)..(1666): unsure at all n locations
nnnnnnnnnnnnnnnnnnnnnnnnnnnnnnnnnnnnnnnnnnnnnnnnnnnnnnnnnnnnnnnnnnnnnnnnnatccgtacacttttacatcttaccaatgatgtattcatctatcctataccaatgatctaaattttctccactccctctccgcgtcgcaccttcccgttccccgttccctgttcccctctgcccgcgtccctctcccgtctcgctctcctctctctctgaggtttttccttgcatttaaaaagatagtgtctgcctctgtgccactaaaaagttcgagcctccctctctgtcatcgtcgaactttatcgtgtcctccacaccattccgtatgtttttggtcgtaacggtgggtaacggcgtagccaaattacttagttgcccttaggcttgagaggccatttggtccaatatgctctctcctagcactctcctctctctcccctcagatgcagcaacaacaaaggagcgggaggggagaagacggcggtggcagcatcgctgcgacgatgacgatgacggcggcgacgacagtgctgggcgaccccgctgctctcatcgttcccgtccacggccgtcaccgggtgtgtccccacccgtgcaggcccggaaggtggatgacgacgaggcgctccttcgcgtgccccctcctcctcctctccgccccaaccccgtcgctgtcctttcgccgcgggcctagctccgcgtctctcatcgccgcgagcgccgacgctgcctcgtcgaatgcctcctccccccgcctacaccaccgaccgttacgacggccatgagacggtgcaggcagaggcgcagcgccgccgccgcgggggtcgacttggccatggggctagctgctggtggtggtcgcggtcgggccgctgcgaggatcggagggtatgggcgtagtggtcgccttggcgtcacggggaggagggggaaggagtggtggtggtggggaggagaggagaggagaggaggaagaggattgaagagaaggggttaacgatgatcggtgagcagccgcgcggtgagggcgacagcgagcagcgagctacgaggcacggtgagacggcggcatgacgctaatatctcaacggagagagggggatcgagggagaagagagagggagagtgattgaaagggcatgcagcgatatttttcctgtctgaacccacatgtcagagctgccaaacggttaaacccaaacagaacagtgacaggatggtgtggagggcatgataatggcacaatggcagacaccatcttttaatggcacacatgtcagagctgccaaacggttaaatctaaacagaacagtgacaggatggtgtggagggcatgataatggcacagtggcagacactattttttagggtgtgtttggttcttggtcaagattggatgggatacggcggtccatattttgctagatatggcggtccagtattttgtttggttgtgtgaatatggcgatccaattttttgtttggttgtagggacaaaggtggatttggtgatccaattttttgtttggttggaggaagtatggtggatttgtaggtgtggtcacctctcacttgagatggtgaatatacctcatcaaattaatacataatacacatnnnnnnnnnnnnnnnnnnnnnnnnnnnnnnnnn

SEQ ID NO: 53413 - DNA, 741 bp, Oryza sativa
acgcgcatgcatggctccattatcgattcgaatatcttgccgccattgggaagattaaaattcaccttgttggtcaagaagaagttgaaggtgatgacctcgacgatgcccttggagttcatgaagaggctgagcgagacagcgtcgcggagtgggatctcaaggtacagcgacgacaccatgacgccgacgagcttcccgacccaggcgaggaacatgacgacctgcagcctgccccagtgcatgcgccacacgtcggtgctgagcccggtcatggcgtagtagagcggcaggatcaggccggacaccatcgcctcgatcttctcgccgagcgccgtgccgagcggcgggccgtcggggatggccagccccagcatcagcgcgccgtggaacgagttcgtcccgatgacgtcgctgtagaagccgacgaggaggacgacgaggaggaagacgaacacgtaggtctcctccaccggcttgcccggcggcgtgcgctcgatcacccgcagcgcgacggggcgcaccacgaacagtatgaacgcggcgagcaccgccagcgagaggaacgcccagatcgacgtggcgggcgacacgaggaacgcctcggcgaggatgtacaccaccatgatgatccacgcgatgccgtccgtggtcatcgacgccgacatggcgatgcggccgaggtccgagttgaggaggctcagctccgacaggatcggcgacagcaccgcgaacgacgtg

SEQ ID NO: 53414 - DNA, 856 bp, Oryza sativa
tatgtttgttcaatccctgttgggtgatcatagggtggatgtcgataatgatactcttaaaacaatgttgaggacctagcttacaacgagaaagaccatgagaagtttatcggttggtgagtaattccgagacacttttatatgctggatgtgtgcgaaacacacaaagttatctgcaaccttggatatgatccagcttaaggcaagtaattgatagagaaacaaaagtttcatccgttaggggtcctaaaagattccgacaaagacgatgtcagttaatactactttaaaaggcactcactagtggtggtggcagtgaatctataactgtcaccatatcactacttttgcagtttttataaattagcccatgatattttttgatgttatggggagcgtatcctatgcacatagaccctcacgtaatacacaccgtgtacaccaactaaaaattatcacaaaactctagaaaaaattatacatgtacttccaatagtattacatctatgtgcaaagttgcatcttcaaatttattctatatagagagtaaaaaaagataaaattttgacagaatgacaaccttaaaactgtcatattttttctgttctaaaatataatgaatttgatgttaagattttacccctaggtgtaatagtattgaaaaacatgcaaatttttttagatttttttatgacatttgttagttggtgtgcacgtgtgtacacatgagatcttgtgtgcataggatatgttgccgatattgatggtgttagtatttattacaaacaactaactaccacatatttaaataggcaaccaagtaatactaacatatttgattaaaaatgtatcttgt

SEQ ID NO: 53415 - DNA, 1799 bp, Oryza sativa
tctgcaaattaatattgacattgcaaaagttagtggcctgaacatttgcacttgatgtactgaatttttcaagatgctgttaattatcaaaccaggtggcaactaggtacgtcatatggtatcagggagtcatctttgaatgaggggagatgatcctctgggttccactggtcatcaccagctgttgcaaacatctacagcgccatattgtgttaaaacacaccatatttaagaattaaaatagtctagagtaattggaagcacttactgcaaaatcttgatttaagaaatgtctccagcctacaaaatcagttcctccaaatctctgtatctcatccgctgctaatacttgaactgcaacattgaatgtttcttcttgcatttgagtgtctagccgaatagcctgttgtatgtcatgtaggcttaatgacatagggacaggttgggagatgtgaacccagattttcctgttaaatgtgatatctttacaattagtggtgaaagaaaggaacatttcaggtaggtggcttacattagagcttctgcataagcgattgaagttgtatatgtgtataaatcatcaagtgtttcagataggtggcttacttaagagcttctgcatcagtgattgaaattgcatatgtgtataaatcatcaagtgccttctggtcatgcctgacgaaagagtgttgcttgctcagaaatggtgatttcaccgaatggcttggtttaatcgacctctttggccgatcgaataggatatcagaaggaccgccgataattctcctcttggatttaggtgggagctttgtacatgcgtactcctcacgcatgaaaattctcgccccactcgtctctttcaacatagagtccggagagagttaactaagtgtagtttgttggtaacctatatcagacagaacagtaagagtgacacatattatgtgcatgtggttggttatgaatgaaaatcaaaaactgacacaggcttgtgggtatcattacctccattcgaagagggagttttgtgcactgcattaccttctccggatttgtcagaggcatctactgactttgagattggctgatctggggtacgtgatagaaagttgagttcgtgttctttgtcagagtcttcagccacattggagatgtcatgacctggggtacatgccaccatgtttgcttctgcgatatcttgtgttattcctagattaaagcttgggggctcgatgtcagacctggcatcgtaggtacgatccacatggatagcctgtgtacagatatatcaacaattcttatggaaaaatggattctttttatattgaatagattgacaaactacatgagattgcacctctattgcacccgtatgatggccaagattgtatttttcatcatgtttgtttcgcagctgaaacccaaaaaaaatgtcaatagtctgaagtttctgcacaagggaaatttcaacaagaatactctaccggcaggagagttgattttaccttcatctttccatacgcggggaaaggattccggttcttgagaattacatccctctcaatgaattctgctatcatggagtcattgtacacgccaatccttggaatgttttcctgctcgggagtgtccgtcccgaaatccagattgtccagataaaaaagctgagcagtataaattatagcatgtgaaaagatgttgcgggtatattagaaagtaaaaggcaaataattcgaacgaataataggataatctcacctgaggtagtataatgcagccattgatgtaaccaatgcttt

SEQ ID NO: 53416 - DNA, 1449 bp, Oryza sativa
gcacctggtgtaaattttttcttgtactacctttttacccttgatgccacttgtttttttggaatttgatactgcagaaccaggtagctgcttccgctgatgcatctttcttgcttgagcagcatgaaggactctagtgaaaacagaactagagccaccaccacctgaaacattcgcacctgctgcaggactgcaaaggtgctgcaaatgcaaaaacataaccaaaacaaattagtaagagatacgatcaaaaaaagactcaaagattaggaaaaaaaaatccatcaatggctgccgcgagcttcgacggcgccggcgttggggcgctcggcgtgcacgcggcacattggggcgctcctctccggcagcctgcagcctgacactgctataccgtaccaatgtcgggttggtgctgttcatcgtcgccatggccggcaccacattcactgcaaaataacagatgaatatggcaacaaaccttggaactggagttctccatgctagacctttcaacgttatctgcaacgcagccgccggcgaggctactaatctgagtttagatgggttaagaactctcaaaacgcaaagaacggttttagatcgataatgttctgctcgacgggataatcatcctgctttctcgctttggataagcaaactgaagagcgaaaaaaccaccctgaaatatatctggtcagctgtctccgaacaaaattctatctacaacaaactcaggaatcttgattcaattttcgaatctgctacagaacagaaacaatcttgttgaccccgagggaaaaaaatacgggtaaaagaaaacgggtaaaagtattcgattcaataaacccgttaatagtcattaccattatctgggcaaacgaattgaattggtggcggacagggagggagtagctactcccggtagtagtatataattttcctatatatatatatatatatatatatatatatatatatatatatatatatatatatatctaaaaaataactattgcaacaaatgaaattatcaaatcctcaaaaaaaatttatcacaatcctaagtttctaataagagaaaattgcactttacataagataaaatataccttgtttcgttgtacaccagatttagcacgtactttctccttacaccagagttcattgttttagttaagtttcactcaacatcagggtactttatcaaatatataggattttcatgatatttcataaattttgaataaatcctcatgaaacaatggtataaattcaaaaaggttttataatttttaatcatatttcacacgatttttctttaatatagagttcactagtgaaagtatcagtaaacccattgcagagtaaaacaatatacgcattacccggcgcaattaatatatgcacaatttactcttctcataactcaaacaaagtagtcctaatctt

SEQ ID NO: 53417 - DNA, 1757 bp, Oryza sativa
  unsure (1)..(1757): unsure at all n locations
acttaaataatgatattaaagatcttaatatggctagatgctgatctacataatatatgttatcaaacaaaaacacgacttcatttcttgttttggatgttaatcaatcttattttgttgaaccagttttgcagcagcacttgttgataaaccattatgggtaatgaatgttgttccggtcggtcagcccgatactttgccagttattttcaacagaggccttattggggtatatcatgattggtgtgaatctttcaacacgtacccacggacctatgatctccttcacatgagctatcttcttggaagtcttacaaataggtatgcagcgaggccttgaaatatttactacttttgctccattacctcataatcatctagggtgatctttgcatctttattttaggtgtgacatcatggaggtagcagctgaaatagacaggatattgagacctgacagatggtttgtgttgagagacaccacagaaatgataaaaaagatgcggccagttctcaagtccctgcactacgaaactgtagttgtcaaacagcaatttcttgttgctaaaaagggtttctggcgttctggcaagtgagcctcctgatcagaatgacgctcaaatgttttcagggtagtcatcaacagcaaacaattcaattgattctttacatccctattgattagttctttatacagaagacagagtttgatcaaaccaaggattaggcatgttgattctacaaaatacttatacagaacagttagttcgacaaaaatacatatacacatcttgtttatggggggccattacagtaataggcttaggctagtccactagtgctcacaagtttgtaatcatattattattcttttacattcagaaacagatacttttcaggaaaacattatgctctttcacgaatacatcctctgtccaaaaaaaatcaaactttggctatgaatctgaacaagaaaatcaaactttggctatgaatctgaacaagattcatagctagagttcaattctttttggtacggagagagtatatgtgatctgcttgcttcgatccgtgatgcaatgtaagctttgggccatttctgtctcgctgaatggaggctagtgtacccctggtgtaacgtaccactgcttaaaactctgaagcgcgtgtggtactttttacctcgcacgcgtacacgcggcagggcgtgtcggtcgctgagtgcccggctcagcacctggtcaaagatcgccggccgggacccctccggcccacgttttccgccggcgggaagagacatcagttaaagcagtgcgcacgcacgcacgtaaggagtacgtacttacgatggtacgaacgtacgcctgccgcccgcccgtacatgcatgcacataggaacccaaaacaaaaattatcgaaagtttaatacatattagttaacatgctataattcagctagaattaaataatccacccagggtactataaagcctagcactagtacaaatccgagcataccaatcgatttatatgtgacggaggtggcccgttacaataaagttattcatctttgtcaggttgtaaaaagccccatcgcaaagacactgagttagggctaggccagtcaccgatgactctcatcggttacggggattggttgcagctcattcaaggtaatcggtgaatgatcgatacgataccctannnnnnnnnnnnnnnnnnnnnnnnnnnnnnnnnnnnnnnnnnnnnnnnnnnnn

SEQ ID NO: 53418 - DNA, 948 bp, Oryza sativa
aaatttttttagatttttttatgacatttgttagttggtgtgcacgtgtgtacacatgagatcttgtgtgcataggatatgttgccgatattgatggtgttagtatttattacaaacaactaactaccacatatttaaataggcaaccaagtaatactaacatatttgattaaaaatgtatcttgtctatggcatattatgatatttttttttactcatagctagcaaaacatgtgcattttgatagtgcgtgtttattatactaccactctaccaataggtacgtataattatcatatatatatatatatatatatatatatatatatatatatatatatatatatatatatatataacactcactgtcacgggacgatttaagtaacgatcgatctgtacatatatacatgcctgtatgtataacgaccgtgcgagagtacgtacagttgcgcgagttgcccaccgtacgtgtattacgtaacgtatacgcgcgtacgtgatcgatctatcgccgcgctggatccacctgcatgcgtaccgttttctcagcgcgtacaaaccattattttactagtttgtcacaattactagctagcttgctctgtttggcctacctctcttatatctaacctacaagtgcagctatagttctagctcgcatagccgacggtcgtctcagtctcgtgtcccatgtcaaaatcgattctcaccatcaaatccggtcgaatctttatcaatcttctaattaagattggttgatgatttttgatacactcgatcttctctttctgtttttatcaaaatcgaagtgaatccataaaactcaggataaaaaaaaggtgaatagagattaaattcggtgaattaaaacggaattgaaaggagaaaaattgagagcagtggagaattaacttttacaattaattgagagaaggaacacatggg

SEQ ID NO: 53419 - DNA, 1144 bp, Oryza sativa
aattttattatagcatatagttcttattgaaaaacttgagttcaaaagggtagaatcaaattagtaaacctatcagctaattctatcaaagaaagcacaagcagccaaaggtcagtgaggttagaagctaacatcgagagactggtagcagcagaacccaacatttgtgcacttaatgttttttcgcttttactgcagttttagtatataacagaataaactttatgccccaagcaataagtaaagaaccagaaggtgagaacagtaataacataaccaaaaagatggtggaatccatacggtgtgcttttggtaagctctgtgatatactctttccacatctcatgcattggcttgtagaggtcaaacctgcaagggcaagccacatatgtaaaaagtacataatgtccaaaggtactatattatgtgaagattcaatcaaacatgtaaagtgtagtttaatcattaccctaaagggattccattttatcaaaagaaaaccatgataaggaaattatgactgaggacaagaaaaggagtcaatctatgcacttattcggaacaagacttacttgcggagtgtctcaggtaaatcaaatgacccacatttcttatgttgcttaagtgacatgtgcctttttgatcgctttgaatgaattaacaaagattttgcctgtgcatcaactaatctaggacccctgtgaacatagttatccagcagaatccctttttccagctttaactttttggctcccttggtaatttttccagcatctccacctttctgaattatgtcataaacaacattgtgcacaacatccatactgtccaaatcctacaacaatgaagtacactacaataaatatcataagttatttcctcatgcctaaatttaatttttgaaacccacacacggagaataggtaccgaaatgcttctttggagcaaattatcatgtggagcaaatgaaagttcagagtatacaggattggtttctccacctacaaagttaaatgtacatgtcaaacagccacacacagaactcacagatctatgtatgttagagcctaagaaggcacctgaggaagcagaagaactggagattgctagacctgagatcagaagcagtgttagaaaaaatggc

SEQ ID NO: 53420 - DNA, 817 bp, Oryza sativa
  unsure (1)..(817): unsure at all n locations
aagttcacatcactaatcaaaatttctaaacactgcaaatcccatatacaagtacaaatttgaataaaaggcgtcacagatataacaatagtatcttataacatcatagccaactaatttaacaagcaagttcaaaatgagcaaatattaccaccagtgccggaggaaggaaaaaaatttaggtgtggcctatgaattaccacggaagttagcacagaacgaaaaatctcaatgcacgtcattatacgacacaatatcatctcaataagtctacattaagcatggcaaacaagaactactcacaagttcatgattcatcatccatttgcaaacaagtgtagatagaagaataggttctcagaaaatatctcatcttctcaagattcatgttttcaacaacacatcacatataggaactacagtactaagaatagatagatatatatgtggaatctacaaaacaactagtaccaaagattgattaatgttcacatatgtagaatctgttgatggagtgatggatacttggctagttggcttgcttgctgtcactgcttggtgctgcacgcctgcacagatgttgtgcccttcgtcccaccctgctcgcaggcccccctggtccctggcggctggtcgcgctgccgcctggttggagaggatgccgcagccgcagctttgcgccctggaggccggaagcctggcagccacgccctccacacctcacccagccctccagcgcgtggcgagcaccgcagcagccgccgtccactgannnnnnnnnnnnnnnnnnnnnnnnnnnnnnnnnnnnnnnnnnnnn

SEQ ID NO: 53421 - DNA, 1420 bp, Oryza sativa
  unsure (1)..(1420): unsure at all n locations
nnnnnnnnnnnnnnnnnnnnnnnnnnnnnnnnnnnnnnnnnnnnnnnnnnnnnnnnnnnnnnnnnnnnnnnnnnngcgtacgaacaggagggagctagaaggaattatctaacgcaagcaagcatcgatcattggattctcgagatgtgatgattgggggcatgacataaaaatttgggcccgtacattcgctgcaatgctaggctaacgtacaagctatagctgctctgctgctacccccaattctcgtcgctttgttccttgctgtcgtcgtcgtccttgctacctgaagagatgcatatgctggtacccctgcagcagcaggagggccggactgattagccactagacgatcgatggatcaataatctgcagtttcgatcttgatcgattgatcggttgcttgcttgctcactcaactaataaggcggaaggagatgcagttagctagctagacgtcatgtgtacgtctcagctgatttatatattaatgaaggagatggttttaatatatatggtgttgtttggtgtttggatctttctgatatctgaattaacgaccaatcagtgatgactagctacacttgcagatatatgtggacaatcagacaatgtagctagctaggtgtactactactacatggttccttgcttgcacgacgcaaattgtgttatttggtaatatgacactgcaagcatgtggtttgcagctgcacaaagcccggccaatgcttccacattttgctatgctgtcttctttttcagagctagcttagcttgcagcttgtgcagggtgtggtgaacatatatatatgtacagtgtagctactgtggttgagaggaagaatatgcatgcagattgaagacacaaagcatatgcatgcagcttttgcccaagaagaaaatatgccattggacccaatcgagtacttacgaaaaaaacactgtccatctcaaaaaaaaaacactgtttatccttttcttttgtgccataaagcagcaaccagtgtattaacacacacctgctatggtaatcattcatccatgactcagttatgaagtggttcgcgattttgtacgctctgtaattgaaaggctcagaatttaattaccttaaaaccacttgggcttttcatcagctgattaattgggtacatcttgttttgctagctagatttcttttgttagtttagtttgtgctaatggcatggagatgcaggtgactgcgtaactatatatcttacgcacagaggaatatgatatctgcttattatattttaggatggatactacccatcatagcaccttattaataaagtcgttcataatatatgttattacaatgcaacttttgcttgttgatgtttgatcagcttaattaattaatagcgatcttttcatccttgttgtaattaaaaaa

SEQ ID NO: 53422 - DNA, 1101 bp, Oryza sativa
tttcagagcgtcaagaaatccatacttgtcagtcaaaaccgccaaaaaaaatcattactttgggtgctctaaaaccgccaattcaatatgatttgcacaataaagaagcaaacagtaatgttcattttatacgagaacgtacacgaagcaattgcacacaatttaatgtgtttcgcataaatatttcactagttggatatataagcaaattaatccaaccggtaatgctcttgtacacattccattaagttttatatatctaccagctttaggtgagaacacagttcgatctgatttatacttccagttagtggttcatttgccctttgttttcctctaagatttgatagagatgtgtaatccaataaattattggcagatagaaacttattggacagttttatggattatttgtacactgatccatatcatactggcctctcaatcgatcgtgttaataaacaatagatatatgtcgtttttatagtgtaactacatgagtacttaatcccttaatttgcaaacagtacagtaattagttaggtgcccccaatcattctacttgcaatacctgttcttgtactattttgtgttattttatttctttcattttgagagggccgtgtaccatacatagctagatatagaataactatgagctcaacgttaagcaaaggtaatgcagaatgattctttttccagtgcagggagcactcaatatctctggaatgaattagtggggtctgatcaagattacttctaattatatttcccacaaaattatgcgctatgatagcatatgtacgaacactttatgatgaggatacaggaaatatgaagtcgaatatatcgccagcgtagctcttacagtgtatgccaatggcgctctgacaacgaaatagtaagagaaaaggacagagagaagggaaaataaaaggaagagatcacgtatctgtacgtatatgtgctgttcggtacagaaaaagagattttacggtcattaagatgttacacttcaaaaatagcttgtggcgcctcctaaagaattgctaaacaacagtactaagctagcaaggaatgcataatttgattaattagggg

SEQ ID NO: 53423 - DNA, 1551 bp, Oryza sativa
  unsure (1)..(1551): unsure at all n locations
tatagggcgaattcgagctcggtaccctactgagaaacgcgtggaagctgaaaagctcgcgcgcatctccaagcggtacgtcctcgtagagggggccctctaccggcgtgccgcgaatgggatactcttgaagtgcatttctcgagagcagggcatcgagctcatagccgacgcccatcagggtgagtgcggagcccattcggcctcacgaactttggtcggaaaagccttccggcaaggtttttattggccgactgcattacaagatgcccaagaatgggtccagcggtgcaaggcatgccagttccacgccaagcagacccaccatccggcccaaatcttacaggtcattgcactatcttggcctttcgcagtctgggggctagacatccttagaccgttcaggcggctcaaggcgggtatcagcacttgtacgtcgccattgatgaattcaccaagtggcccgaggcctacctagtcgtgaaaatccacaagcattgtggtcttatgctcatcaggggcatcacgtcttgattcggagtgcccaacgcgtatcattacatacgacggtacctatttcactagtgagctctcaccagcggtcgcagcagaggggaagaatcccatcaaggattagtgttggctcggtggagtctaggcccagcacccgccgaatcaccctcttcgtgtcctcctcaccccagtcccagcgctcgcccacatgcgtccgcatggggtcgttgggaccagtgtattcccacgctccacgggatcattcctggaggggtgcgatgcggcggcgnaagtaatcgccaaagaccatcgcccccgtgaggcctaggctccgcaggcccctgaggcgatcccacaccgcgtcgtattcctcgcccaactccgacgtcgccaaccatgcggcagacctttcgggagggccagcgggaactcgaagtcgcggatggtccggcaacgcggtgtagaaccagtctttcttctagtcctcccatttcttgtggaggtggctctcgatgtactggcccgctgtgcccggtcggggctggaagtagcatccccccacctctacgccttgcagcagctgcgggataaagaaggcctggaaccaccaaatcgtcggtcgcaccccaatgaacatctcgcacaaatccgcgaagatggccagcgtcatcacggcattaggtgcgagatgcaaggcgtgaatttcgtagaaatccagaacttcatggaagaatctggagaacagcgggatcaagcctaccatggcgaaggacaagaggtgcacggatcgctccggatatcgcggccacggcctcgactctcccgcccgcacgacggcaccgcccggcatgatcttgcaaggaaggctaaggtgcctgtctgccgtgatgcaagaggaagggagcactgcgtcgccggtgtcttgggccatggcaaccggcgaagaggtgatggagagcgtggagcacgagacagtgtgaggtggcgagaatattagggttcgagaagcgaaaggacgagtgggcggttggcgaaagg

SEQ ID NO: 53424 - DNA, 1024 bp, Oryza sativa
aaagcccaaaaagtgaagtggggtcccccttatgaagggtaggtaaagcggggcacatgtggtatccctttaagctataaaaggaggaccctgcccactgagatgaggggacgactcccagaaaatctgaactcaagaagagaggaagcaagtgcgctctctggagtgaagaaacccttgtaaaactcatccataatcccaaacacaggagtagggtgttgcgctccatagcggcccgaacctgtataatccgactacgtgcaagcttgccggtaatcttagggacgagcgagtgatttccgagaggcgggcctccgcccccggccaaactcacgaaagcggggtcccatgactccccgctattgaggatcttccctcgacacgaggcaagggtgggcgtgatggagttgggtcggccggggtgtccggttgatcggcttccggattcaccgtggcacgagaggggactgcccgctgccttgcgaggagtgggggtgaaacctgaggtgtggtgcgattggttagatttaatgttactttatttactcaacagttttactgttttgctcaataaaatgttttacaaccgcctttatacaaatagccacaaaccgtccttgtatccccttgcacgtctgcatcgttggtgtggcttgctgagtacggtagttgtactcagtcttgctattgttcccccttttcagaagtgtattgcttctgagctgaagacgaagttagaggaccaaggctcagaccccagttgagttttgcctgtggagtggagctgaagctccgctaagatcgcctttttccgctgctgctgctttcgtttcggtgtgaggactaactgcctattatgtaagtattttacgctttatttacgtttggatctgtatattaatttgtcgttttgtgtgccttggttgatgcctggacatggatttaatacacaaaatagtctagaaatttgggctaaatttctgggcgtgacacccggcatgttgatgccgacgctagccatcac

SEQ ID NO: 53425 - DNA, 1655 bp, Oryza sativa
gtatgagaataagttcaccatatcggatttatgatgtgattcaattctttttttcttgttgtttctttttgagagaatctattttataccactgagcttgctcaagttcaacaatttgccatcaacattgtcgttttctataatataccgacgactttattaattgttctacaatacgccattgggctaagtattcttttcaaaaatacctaaaatacccctatggatatatgaggttaacaattgatttatctaatttgaagtttcaaaaaaaaatgaaaactttcatgtggccttcttatacaacatggaaatttgtatagaagttttaagttttttacatttctattttttaaaaaatatataacttatttgttatatgctatataaaaatacttttttactattgtttttaatataaatcatctttcatacactacataagatatttttattctattatgtcttatataagcaaattctctttcacataccacataaaaatattttttctaaaaactaaatataccagaaaaaaacttgaaacttgtatacaaacttccatgttgtgtaaggatgccatttaaaaattttcattttttttgaaacttctaatgagataaatcaattgttaatcttgtatatttctaagggtattttgggtatttttgaaaagaaggcccagcccaatgacacattgtagaacaattgataaagtcgtcggtatattgtagaaaaagataatatcgatggaaaatcattaaacttgaataaactcagtggtatagagtagattctctctttccttttttgtttgaaacttagatccttttcatttgaaggtatacacgttatgtgatgtgaatggtagatacgtgattccatgagatttgtgattcagatatgtcttttgtcttttaatttgtcatggtagatattcttttgtcttgaagcatttccgttttgtgagtagtcccacactcccacatgaagcacataaagactgcatgtaatttacagagtttatagtttctataatcctctaactcaaatccggctcagcctgttttttttttcgagagctcagcctttttttactcgttcgtcacagatgagcccttttcagtgccgagaacatagagccacggtgccagatccaaatctagcactgttggcccttttggaaccgacactgaattagtgtcgtgtggtagtgaaaggaaaacacatacctgaacaatgcatcctcccagccctatcccttcgaagaactgatgaaatgttaacgcggccacgagcggtctgatcgtgcttgggctctcggatgcacctagtgatatcccgatgataatcgaatgcactatgatacccagctcaaacaccttcatccacacatgcaaattcatatcaaaccaagaaacgtatgaacattagcaaatttaaattaattaacgcgcatccatgttcatctcccagctatatatatatatatatatatatatatatatatatatatatatatatatatatatatatatatatatatatatatatatatatatatgacactcatatggggcaccatggttgcccgggcaccatggtttcaaatgcacaaaatcactcaaatttttcaaaattttcaaattgtgagt

SEQ ID NO: 53426 - DNA, 1291 bp, Oryza sativa
tgggcaaacaaaggatcggggaaacgaaagcatatatgcaaacgaaaagtaatatgtgaataaaacttttatatacgtgttcttagcgatataaaaacaaagaataaaaaactttgataaaaaacctcaaaatattggaagtataaaatttggctggtaaacgtaagcataagaagaaagatgaggctcgagggggtggacgtgccatgatctcggacacgacgcggggctgcttcagcggcttgaggaggaagtagaggacgcgggtgacggcgacgatgaggacgagctgcacgccgagcagcggcagcgacgccgagagcgggctgccgccctggaagatgttccggccggtgcccgtggtctgcggcacgacgtagcagtcgatcttatccattcccaacgattcctcggcgtctgcctcctctgcatccgcgccccactgcgcgcgccggcaatggcgcggtcgccgcgccgctggctcttcttgccccccgcggcccgcccgcctcgtcaggctgctttggccatggcggtttgctgcaacgtggaggggatgagtggtcggagggcgagaagagaggagaaatcaatgacatgtcaaaaaggttcagaacttggtatcctcgagaatatattaaactcagtttgtttagctccatttttgtggctgtaaattgctgatgctgtagagagttcctgcaggagaatctatgttgttaataatagtaaatctaaaattggtgtagtgtacttttactgtggcttatacagatatgaatcaatgaacatatccatagaaatatggaattaacacaaaacagtctatgcttgatgaagataataactggataaattacactttgaactacctctagctcactttacatttgttgtactttgaaacacttctctcttctctagctaatcatatttatggtatccacctgaatattctctagccatatttatcatatatcctcccgtaaatgacagtatgtttataggttgacagtatcacgatttgtatcctagcatcttagaatactacgattctaccatgtcgaaatggtaccgatcccacctagtatcctaattttcatagtatctcaattctactattcattactatacgatcctacaaaatctttggtggtatccagattctacgatccttacgatattacaaaatattatttaaaataagatgggttaaaaataatgtaaataaatatgcttaagtttatataaaagtccggtaaatatatcaaaaccaacgtggcttctcttg

SEQ ID NO: 53427 - DNA, 751 bp, Oryza sativa
  unsure (1)..(751): unsure at all n locations
ttttcctaatgcaaaatgaagactaataatatattagtaaactacatataagcgttgttaacggtctacatggctatcagctaagcaaaacgaaagctaactcatctactggaaaatctctcaccaaaagaaacctgtctagatggctgccacatttgccatttcagtccgacagtgtccacagcggcgagtcgacgatgtcggcgtcgagctcctcaaccttgcaatcccgagtcgtcatcacagcgtcgacgtcgaggtacatggcgatgtcatccagacactcgaacatctccagctcaggccaagacgcgtcccactcccaatcccaatgctgcgccattgcctccgtgccgccgccatcctggagtatggccggcaacggcaacggcaacaccaccggcttcacgtcacgctcctcgaacactgcgccgccgccgctgccggcgacggctgcaggagaacagcccggggtttggcgttgctccggcgcagtggcggcggcggtggtggcaggagaacagaacgggggttcgcattgctccggcgcggcgatggcggcggcaggagggctgaatgccgggaagttgaggaccgcgcggggaccgaggatggacgcggcggccttgtcgtaggcgagggcggcgtcgacggcgctgccgaaggtgcccagccagtgccgcttcccgcggttgggctcgcggatctccgagnnnnnnnnnnnnnnnnnnnnnnnnnnnnnnnnnnnnnn

SEQ ID NO: 53428 - DNA, 1395 bp, Oryza sativa
  unsure (1)..(1395): unsure at all n locations
gagacgtacacatgacgtctagctagctactgcatctcctccgccttattagttgagtgagcaagcaagcaaccgatcaatcgatcaagatcgaaactgcagattattgatccatcgatcgtctagtggctaatcagtccggccctcctgctgctgcaggggtaccagcatatgcatctcttcaggtagcaaggacgacgacgacagcaaggaacaaagcgacgagaattgggggtagcagcagagcagctatagcttgtacgttagcctagcattgcagcgaatgtacgggcccaaatttttatgtcatgcccccaatcatcacatctcgagaatccaatgatcgatgcttgcttgcgttagataattccttctagctccctcctgttcgtacgcccccacacacattactaatgctgtgcattagcagcagcagcaacaacaacaacagaaaaagatatataaaatcactcgaacgaacgtttgcaacgcaacccgatcgatcgatgatcgaataaagcacaagcaacctgcatgttatagctagtgtatgtagcgtcattgcagtagtactcctaatattatgattagcgcagcagtacccctaatatatactattatgattagcagctagctagctgctagtactagccagctaaattaccaacctaggagtattgaggttgcttttatagtagtagtagatgaatctagcctgtacggatccacaaacatgtacagtactcttacaaagcacctcagacctcacctagttttaggatacgtacgtgcagtgaaacatcaaaatattaaccactaataataattgaataaaaaggggttagtactataagagtaatattaattttcttgctgaagataatcaactcgactgccaatggtgaatggatcgcggccattccacggtctatcccaataaatttgggacaagacctggcattatgagggaaattgaaagcaagcactgcacgcggggaggaggtgcagtttattttgccaactgcatgcccaggcaaccaccttcaccgtgggtggggtcatggcgagaatgaagctatagctagcaagtggaggaggaggagaggccacagtttccatggcgaaaactgggcgaaagtgcaagcgagaacagtttcatggtcagagaaaacacacgtacagtggcgaggagtccagagttaggtcttgtttgggggagcttgtcccagctgcagcttttcccaaaatctgcttatgctagaagctgtcccaaatagtctacagcttctaagaatctgtagttacagattctgaaaaattaaccaagaaggcagnnnnnnnnnnnnnnnnnnnnnnnnnnnnnnnnnnnnnnnnnnnnnnnnnnnnnnnnnnnnn

SEQ ID NO: 53429 - DNA, 712 bp, Oryza sativa
ccaagtagcaatggccagcaaaccaattctgtctgtatttgcaaacaacttaatagtaaaccatctccaggtacgaggatatgcatttgtagtttggtacagtatcatattaataccatctcgaaaaagactacagtagtatcttgggctagtaactgcgcatcttctgtgtgatagactgctctgtatttgcccatgtcatagagatgttcgtcaacatactacctatgatcggtcgagagaatggtacactgcttgaatattgcaatcttgtcttggagctgaaactgaggcttgaacctctattcttttctgaaagctatctaatgggaccttcactgatatagcactaagctcgcatatcgctaaactttccaagttcatctgatgtatagacagctgcggaacctgtttctgatctaagaatgtaatctgaatatctggttactgcaggctggatacaggcatgtagatacggctgctcaatatggaatagaacaggaggtacaccaaaacaatattatgtttatctggtagtctattgcgtgatgtttcgttaagcattctctgcaattcaggtcggcaaagggcttaaagctgcgatggaagctggaatcaacaggaaagatttgtttgtgacgtcaaaaatatggtaattatatttacaatcataataacttgtcctttggtgtaaaattaaatataaatgcag

SEQ ID NO: 53430 - DNA, 3758 bp, Oryza sativa
tataatgtaaatctcgaaattacatatgtaaatttcaaaattacatatgtaaatattaaaattacatatgtaaatagagtgtaattttacatgtagatagcaaaggaacgtgatcgatcggataaatcacagcaagcagcacaggtgcatgtgtatgtagtacgaactagtgcttgcacgcacgatggcaaattaagtagtcctgcatgaatctaaacgaaactttgagggctaacaaactgactgtaattagagaagatttatggcgacataactatagcaaaaccgattaaacaatatattgaagtttgctaaaatataggataaacgtattgaaattcattaaaagtgaggacaaatatattagagttcgttaaagtatattatagtgttttacggtatgcaagactgggaaaaaaggagacggagcaagttgcagtggtggtggagagcccctagcgcaaacagggcctatagttcccatcctctccaaattaatacagggagcctccacccccaccatttttgctatagaaaagatactactgcatgatgattgatgagtagtttcttttgaaaaaaaaatgattgaggagtagttgtaaaatgtagaagagtggtacttctggagggtggaaaaacatatatggaatatccttttatcggactgctccatgtttagatgtaagctgaacacatggacagcgtcaggcttgataatgtctttttcccccagaaaggaaggattaacactctaactaactcgtgatgaccttcggatatgatagagctttacagatatggagtatactcattcacgagccttgtcttaccccgtacatcacggattcacatcaagaccagaattctgcccaccactggcattattgtcctccaagatgaaggacagtggtaggcgcaagtgcacgactctacaagttctgcacagtaagagagcaacgacgacgatgacgggtcagtcagtcaagtcagagtaacatggtcactgaactgttctacatatcgtgcacgggagacccctctcctcgtcagtttcaaccaacggagtggtctctcttttgagatcctcgaacgaattctcaggtcttcgcgagagcgcgagcgtgatcagacgcgcctaagaacaaaaacctgccattcctgccgaacaaattgaaacgccgcacgtcgcatgctggccgtgatggtcactcactcatcacgcccagatggcgatcatggacatgagccctgcgccgagcagcaacgcgacgttcatggcgagctgcaggcgtccccttctctgcaccttggtcttcatgaagtcctcggcgaggatgtcgacgagcgccatgtagacgagtatccccgctgccgacgcctcgaggagcccctgcaccaccagcgccgttgggctgttcgcgtcgtagacggaggagatcccgatcccgacgacgatgccggccggcgtcgtcagggagaagaagagcgccatcgtcaccactgacctgacacggaactttgcctgcagaaacaagaaagaacaggttatattataagttattttaacttttttcttaatcaaacttatttaagtttacctaaatttatagaaagattaaggagtattaagaaaaccgcagtaagttttttgagtgaaaaattttcagatataactataatataattgaagtgaaattacatcgtaaccacactgcaactgcgctgtaactgtaatataacttatataaaacttatattctactatgttttggttagcatcaagttcttacgcgtgagatgggtgaaaatttctttctaccaattattttccttcatgcacaaatctcaatgcgatctgatggccacaaatctgaaagttttttgggggcaaaaaaaaacttgcggaagttttctagcaattccgaaaaattattaacatctacaatacgaaattaatttcattaaaattaacataaaatatattttgataatatatttgttttgggttaaaatgttgttatatttttctataaacttagtcaaattttaaaaagaaagttaaaacgattaataataatataaaatagaaggattacttttgattgagattaattagtggaggcccagccgcccagggaagtaggatgggatgcgatttgagtcgtgatttaacaactgggcccctcaaagtactaaggcccatctgtaaatctgcaaaatcggaacgtctttttctaactttttggtagtacaagacatcagttgtcctcttgtttgaaatcggtatcttcggacgagttagtaagcacgatggattgataggatatgaacaccaaaaacgttgaaatctttctctctctctctctctctcgaaaaaaaaaaaaaacaggttgaaattgacaattgtgagtgcggagtaaatgtgtgggtaaatcacctgaacgatgcatccgccgagcccgatgccctcgaagaactgatgaaacgtcagcgccggcacgagcggccgcaccgtgctcgggaagtcggaggcgcccagcgacatcccgatgatgagcgagtgcaccaccactcccagctccagcacctccaccatcaaggacgcacaagcaaaatcgattaagaaaataagaacagaaattttgattgaattttcttaatttggttgcgtttttttgttttcgcagctctgtttcttgaatggcgcggtggcgggagatgtagtatgacatacctgagagatgacgcggtggcggacgaggtcttcctcgccggcgggagcgacggacatgacggacatgccgtgggcgtggccgtggctgtgctcgtcggaggcctccaggtcgtcggctggctcgtcggcgacggccgcggccttcctcttggcgtccgtgcggtgaaagtaccccgtggcgacggtgtcgacgatgagcgtgccgatggcggagaccatggcgaccatgccggcgatcgggaagcgcttccacgggccgccgacgaggcacggcgagctgagcgcctcgaaggccgcgggaaggatgtgcaccaggcccgtggcgaggatgacgccgccggcgaaggccttgacggagagtaacacgtccgtctccggctggatcgccgggaacctgccgcccagggacggcagcgccgccccgacggtgctcccggcgaggatgcagaagatggcgatgaccttgagccgcagcgcctgcgccttgtcccgccccgccgtgtccgtcgcgcagtcgcactccgctgccgccgcgtgcgccggcaggtagcacgccgccaccagaaagagcaggacgaacaccttggtcatcgccgccgtcgccatcgccgatggctcacctgcagctaagcttagctcgcgcggcgagatgtcgcggcgtttcgcagcggaggttcaggttggcacatgcgcgagctaagctccgcttcgttcttctaggccttttgaacccgtggactctccatttcagtctccgatccgttgcatgtaaacaaacaaatttaaaaaagaagagaaataattgattgctggggcgttcgcgcgctcaactgagattaaattataactacttagttaattaattcttcgagcaacaataacagtttggctggccttgatgcgtttccaattttttgtgtggtttgcctttgccacaacaggtataagcatgaaaatgtgaaacatgcactaatccggttcttctatttcaatgaaattggtcaaaaaaaaagagaaagaa

SEQ ID NO: 53431 - DNA, 1352 bp, Oryza sativa
  unsure (1)..(1352): unsure at all n locations
nnnnnnnnnnnnnnnnnnnnnnnnnnnnnnnnnnnnnnnnnnnnnnnnnnnnnnnnntaagattaccggcaagcttgcacgtagtcggattatacaggttcgggccgctatggagcataacaccctactcctgtgtttgggattatggatgagttttacaagggtttcttcactccagagagcgcacttgcttcctctcttcttgagttcagattttctgggagtcgtcccctcatctcagtgggaagggtcctccttttatagcttaaggggataccacatgtgccgcctctacctaccctccataggggggaccccactccactttttgggctttaaaccgggccttctcccggaagctaagcaataaccgattctcgagtggaacccggcgccgccccccgcctgacacgggggacagccctgtcattccctcataaatgaacgatgacatgcaacagcccttcctcgagtgacgctaggatgtgacaggtcatacccacccccactccgccggggacaagggcgacgtgaggacatgattgccctatccatcggatgtgacggagacgggccggtcacaaaccggtcacatccaatggacaggggttagctaggcgcgccgcacgtctgcccttactgcattaaatacagtaagggacagttggggcgtcgcacatttatggctgttcagcctgtgctcccctcttgccctctccctctgccgcgtggcggccgggtgagggcctcggggcgaagccgcgggagagcccgagggggtgacgtcatgccccgaggccccccccccccctcagccgctttcacgactcgcgtgacgcgcgagtggggccaacctgcagagtcatgtggccggagggaaagtaattcccctctacttcacatacccccgggcttatatctccgacacctgggtacgtcggctagaggaaagctacactacaagcccagccgttgcctacgctggcttgtggtaagtacaataggttattccagggcatcccgcgaaccagtccttaattgccatgggtgcgactagcaaaaccatgcatccacagcccaccattcaatcgcattttagttggataattacgaccatgaagcatggccagatgtctcgagcacgcagctcattctgatactaaaaaggtctaatactgtaattatcccatcaactgagctagtggtaattaagcatggctaagcatgtagttctagctaggtcacataagtaacatgagctagtcgatttattacccaatgttaacaaatgacagatatcaactaaacatggcacaagcgagcagataggtaaaccctattcccatgtaatt

SEQ ID NO: 53432 - DNA, 1895 bp, Oryza sativa
  unsure (1)..(1895): unsure at all n locations
caaaacgaggaaaaactctaataaaaaccaagtaaacagtacataaaaagtaacaaaacatgtagatctcaattttagatgaattttgcaagttgaatggcccaatttggagttcgaatgaattagatatgaattttagaagttttgagccattttaatgaatttttagaattattaataatttattgtgcaattattaaataatttctcaaaggaaaggcctgctgctgacatcatcaaaggggccggctccgacaggcgggtcccacgagtcagcgacacacaaggggttggcgcacggtggacacggtccaccatggctggggcggcaccgtggaccaggaccaccacgggtccacgggcggcggcccagatcggcaaaaaggggggctggcttgccggccaacccgacaaggcggtggcggcggcacacggccggcggctgagaggcggtggcgcacgaccaccggccatcgacggcgagcggcggcgcgggaagcagcggaagggatgggaggaggagagggggatgctcaccgagcacccgacggcaagacgacgacggaaggtggccggtggagctcgggcggcggcgctccgacaaaggacggcaaccggggtttcctggggaagaaaagggaggtgcggggagatgagtccggcgacgattcgcggagacagaggagtggccgagctacacacgagggctgcggtgccggggaaggcaacggcgcagtgcggcgtcaatcgaggaggcggcgcaacgcggttggagacaacaaatgagatgatggctcggcctcgcagtgagaatggcgctgcggggggtggaagaggaaaaaggagtggagaccgggtggatctcggcacggcgatgccgacggcgacgacaacggcgacgcagcttggcggtggctagggtggcggcggttggcggctgaagatcgccggcgggcggcggagagagggagcgcggtggctcgaaggatttcgagcacgggaagtctcgggagagaggggaaaatggagagggaggtccgagcatcctttttattggctcggggcgacgggatcgtggccgatttgggccggcaaccgacggcgacatggggaagagagagagagagtgagaggctccggattccgcgggggagggggggaggagagtggggcgacgcgaacggcgaggtgaagaagggggcggcgcggtccgggcccacacgggagaggctgtaggctaccgaaggaggcggcgacgtgggtggctcgggcggccacggcggttgccagcccgtgggtcccacctgtcgcgagagggagagaggaggccggttgggggaggaccaatagactttagagggaaagggggccgagcgagatgattgaggggaggacttggaccgagcccgaaaggagggaaggggaatttatttgcttttctttttatttaatttgattatatgaactttgtattgttataattatttattgagctccgaaaattcgcgggaaattttttaggaaaaattcccggccaatgatttttaagggaaaattttaattctcccattatttcacttgattaaattgatttaacttttatttaatttctagaaaatacattatttaatgatttttaatccctaacgaaaatcgaggcgttacaccgggggcaacggggaccactccgcggccacccaggaatgccaccgcctgcgaaggtgtcactgcgacttctccccgtgccactacatcccctcctctaccgccgcatcaaagggagtgggaggcggagatggcgcggtggctcaaggaggccaaggagatggaggtgctcgagnnnnnnnnnnnnnnnnnnnnnnnnnnnnnnnnnnnnnnnnnnnnnnnnnnnnnnn

SEQ ID NO: 53433 - DNA, 3423 bp, Oryza sativa
  unsure (1)..(3423): unsure at all n locations
nnnnnnnnnnnnnnnnnnnnnnnnnnnnnnnnnnnnnnnnnnnnnnnnnnnnnnnacccataattccctgtacgggcaagccctagcggcagaaaagatgaaatttagatgggttgggggtgaatacctgagatggggtcaattggcaggatttgcacccgctcagagaagggtagtcggtgacggtggatactcaaggatgggcggcggcaccacgctacggcaatactcaataatggaaaaaaaagaaagagaagataagatatatgtatgaacgatcactcatataatacgatatatttaagattcacacgtagaattaaaaggaatgacagtgacaactgtttttttgaaaaaccaaaccttaaattcaaatttgctgatttccagtaaaagaaattcatatttgctgattataatctgcaacaatgccaaagaaaaaattctctagttctgcatcaaacacttccaacaagaagcattggtagaagccaagatgccaacaaaagtgtgtgcagtttgtactgcattttacagccagcttagggaaaagttcagtcactctcttgatccaagtacttggatccaataaatagtggggattttcagaatttttggggagttgatgaatctactaaaatttgaaaataataaaaccaagcaagcacccaaggctattaaacatcctgttatcttgtaatgttgtgtttaccttgtgactaggagcaagacacaaaatttcttcttcctaaaaaaagagtggctatggctactgagccatcgcatgagtgcccccaaaagagagagagagagagagagagagagagaaagaaaagtgcagcccgtgagtgaacctgtactatatcttttgacctggataccaacaacggcaggagacaactaatttcacatggctcttaatttgctgctaccccagacgaccagatgttagaaaattaattttttgtgtagatttcagttagtttgcttatatgtatggtgtacctgagtatgcagtcccttctccttgaagaatctgtgagggagatcccttgcccgtgagcctattatgtcgcccaagtttgaaaagaaattagcaagtttaagaattggaaatgaacaacattgccgtaatgataagatgagattcagtatgaacccagtaatagatcataggttagctcttgcaaataaaagtaccaagaaaatgagagctaccaagatccctcttggaatcagaagatctactcctgtactcagaatgaccaataataattcaaacagtagatatcagaatcagcttgttgtacaatatataatatcattaggtttcaataataaattatcagaagaacttttttttttcaaactaaacagtaggccaacatatttttatccaaactgatcagtagaccacaatatgtccaattcatccttaacatcacatgagccaatcgagcaaaagaggaatttggatggaggcaatcactgatatcattttgttaacctcatatggcaaaagtgcacggcttcatatggcagaactacattatcaagaaacggcatagctcaaggaaacgtttgacatttcagttttttaaaaaagtgttgtttcagtccaagttgtataaacacaaagtcaggcattgaaggattttgtaggtacactttaatgtttctcaaagatgaattggcgttcattcacacaaatcacaggtcaaatcttagctcgtatgtaagcacaattcacatgctatcttatgcgcaaaatggaaacattgttgacatggtagtcctcacatcctgttgacatcaataggaggaataaagagcaggagatagagtaggcagcattttatcgaggacctacagatgcagtttatagagtcaccttgatatgccttaggagatctttattgaaagcctaaattccagtgacgctgacctatttttaacatcaacatcatgaggaaaaacaggaatccccaaataatcaatgcatagttagatcaaaatgataagctgagttaatttgcattgggatgcttgtgtgcgaggcaaacacgtctctgcaaatagtcgatcgagtgtacgcatcgatcctgccatatattgatttacatatcgtgcacatatataactgcatgcagatcaaataatcgatggagaattcgagatgacaagaataaaaatcaatggttcaagaaactgaatcatatgtatcagaaattagatgtaatcacaaattacttgttcagaaataatttatgtagctgtagtgcaagtcatctaacctatatcacaaaatggaaataagatgtaatctgaacttaacatttttttattgtcttgtgaagaaaaaggggaaatggaaaaacataaatgatgcctatatgattttggttgattggggaggaggatgatatctgtacggtacctttcggcggtgggcgagtggaagtggatgacgaggcggagtggagaccggcgaggcgagcgactgtgttcgggcggtggagagcgggggcggcgcggagaactacagcggagatcggtgcgcgaggggcgagaagggcgtgtgggagcggaggcgggggcggcgagtgtgtagatcggcggcggcggggtggcggtgagggtgaggcgtgcggcgtgcgagggaggagaagggcgcgtctggcggcagcggcgtggatcggggctgctgtggcggcgaccgagaggagagggcgtgcgagagggagagaggttttttcacctgtgtgtgtttggttggtgggatataaccggataggacatagccgccgctttttggagggtgtttggatgctgggcgagagtgggatagggcggcccagaggagaatattctctccagatgctggatagagggatctggccgatttggccggatgcaaccgcccgaggctcgggcgagccgggcaagcgagttgcgtgactcgcgtcacccctcaccaccacgacgcgagcgaggcgacgagctcggcggccggcgagagggccggcgcgggcgacaagcgtggcggccggcgagagaggcaacgagctcggcggccggcacaggtgacgagagaggaaggcggcggcgggaggaggcgagccgcggtggtgggaggaggcggccggcggcgggaggaagccggcaggaggaggctgccaacggcgtcggcgagcccagatctggcactgcttttttttttcttttttctttttttttctatgtgtatttataatggagtgtgtatttataatggagtgtgtatttataatggaatgtgtattatgtattaatttgatgaggtatattcaccatctcaagtgagaggtgaccacacctacaaatccaccatacttcctccatcccgtcgagtgatagggtaccgagctcgaattcgccctatag

SEQ ID NO: 53434 - DNA, 702 bp, Oryza sativa
tctggcttgtctgccctctctccactccgtggcagttggttccaggactagtggccgtcttccagggcctgcttacctgagcacctccgcgacagcttcgactccctagtgctcctggtctcttggtgtctatggaaggagcggaactctagggttttcgactccgctctctcttcggtcacagtggttttggagtccgtccatgtggagggccatctgtggtctttagctggcgtcgctgcttttggggatttgttgggagtttagcatggcttagccccttcccgctgcttggagtctgttttagccaccgtaatttctgtaagcttcaggttttttttcttcttttactttttcttccttcccttagcataagccagtctggctgattgcgtttgtttaactaaaactcttttccttctaatatactagcaaaaatgcccgtgtgttgcaacgggtgaaaaaaattctaatgataatatacgtttttcatgcataatcatgtcaatgacaatgtttgtattttaatgagcgacatgcttttttataaacgatgtttttttctcttgcgcgattttctcaaaccatttttcaaaaatggcgcatttctttctaacattttttttcctagcatgttctttttgctttttttttactgacgacgaaaaccatatttgggtaccgagctcgaattcgccctat

SEQ ID NO: 53435 - DNA, 1279 bp, Oryza sativa
  unsure (1)..(1279): unsure at all n locations
tttttttggcttttatagcttctttgtactgtacttgttaatgcagttttatattcccatgaagaaaacattagcttaaactggaaatatacaaagatggaatgtgtttaatttagtagaacacaagttaaattcaatatagagcatatgcaaatacaaatttacctccaaattttcaagagctttctcaaatttaagtgccaattcaggtatgcagcgcatatgcatactagttactaggttttgtactggcagtacaacctttacaaatcctggatgcgacgtggccttcgtcttcttgggccatattctttatagtatagcattatatatttatgctcccttttggatttccaacctgtacttttttcaggctgtgcaaattaccatacaaatcctttttttttatgatttcaggagaacaatacgattgaaattaaaagattcgataaggataggcgtcgagattttgtgcagatgctgaagggatttattgtaaatcaggtataagaatgctccactagtatttggcgagacaccatgattattacactgtatttatccgtagtgaaagaagaggtgtatacatgtcaataacattggtatatattactgtgtgcaggtttcatattcagaccattatgctaatatgtgggcaaaggtagcagacgaaactaaagtgtatgcaaaaaggagcaactgatgcggcttgtgtatagctagtagtaggatcttggtttattttgatttgctgactataacacttgattctccccagttttgccaccatgcggttcattgtattgctacatttgagttagagagagtttgggcgaatgggcttctcggtgacaattgacatacacgacatatttttccccttattttttttctcaaaaatccatttccctcttctagaaatctcttgtgcattttacggtcctacctcgtgaaactgatgtatctggtttgaattttgccatggacgcaatccatggtatatacaacaggcactttttcacacgtttctgactgtcaaggctgaggcctgaagatccagtggctggtatctttgcttatccacacacgtaagcattgtttcttcagtctacctgttgtctcgttgtatgctgctatgcatatgcaatcgaaatctcaatcttatcgatgtattaccacactgggagctacataatctggtcgattnnnnnnnnnnnnnnnnnnnnnnnnnnnnnnnnnnnnnnnnnnnnnnnnnnnnnnnnnnnnnnnnnnnnnnnnn

SEQ ID NO: 53436 - DNA, 1072 bp, Oryza sativa
  unsure (1)..(1072): unsure at all n locations
nnnnnnnnnnnnnnnnnnnnnnnnnnnnnnnnnnnnnnnnnnnnnnnnnnnnnnnnattagaggcctttcaaaggcagaaagacaagaatatgcccctccagcaggctctggcttcatctctggcttttcatctatctcaggccggtcattgatagacaaaatttcatcagctcgtgattctccttttggtcctacctcatatttatcagcacaggcaagagtagttgatgattataccatgtcacaaattattctgaaagagcttaatggcggggatacttcaaggatgctaattgttataacgggtgcaagccatgttatttatgggtcacgaggaatcggtgttcctgccagagtatctaaaaagatgccaaagaaagaccaagttgttgtactacttgatcctgagagacaaagcataaggagggaaggtgaaatcccggttgctgacttcttatggtattcagcagctaaaccttgcagtagaaactgctttgaccgtgctgaaattgcacgagttatgaatgctgctggtaggagacctgaagctttgcctcaggtttgctgcttgatcttcgttttagtccattgcttgttaacttcatgtcgtgatagacctttgagaaaaatctgtaaaatcgtgtatttagtgaaggtaaccatgaacaggctcttctagatattgctgccctactatcttcaggagaagaaatattgaatgagtaatactgagcaagatttgacaagaaaccttcagattacctaaatatcttgtgttgatttgtattaagctttttattctggttttcgagttccagaaatgtgccccagagtagtacaggtagcacaataaaacctaagcctctagcattttctgaaccctggctgtgacacagattagctaataaaatgcatcacattagtcaatatgcccagtgcagtaacatctttttcacatgacccaaaaaattcttgtaagtcatagagcaggagctttcttctgtggccaaaatgttnnnnnnnnnnnnnnnnnnnnnnnnnnnnnnnnnnnnnnnnnnnnnnnnnnnnnnn

SEQ ID NO: 53437 - DNA, 977 bp, Oryza sativa
ctgagtttctctaacaattgtgtttcagatcattgctggtttagtggagcatcggctaggagagagtctagctactagctacaatcagccacttcttgctagtttgttgtcctttgtggcaaggacagtgaactcatactggggaacacaggttgagcattctctgcacatttctagttatatgtttgtgttggtagcatagtgcagactcaagatgtttagatcactttagactaaagaactcttcagggaatctggctatgagtaatggcattgcactttcccatcctacatcccgatttatattgtttatttaattcaatcaatggtcacaggaaccttaacattcacatacatccattaaagctttactgctattaaaggaatattttagttgagctttacctcggaggcttcaagcagctttcctatgataatttacgcatttaaactccttaatatattcatagtgcttttatggttttgaagcttatattttacacaagataggagcttacagtaaacctatcccttctctccttactggttattctgtttggtgcagcaatgggttgatcttgcgagatatactggactacaaaaaaccaaggaagttcctcctgttgaggccacagcaccacctgctgaaacgtcacagttagccacaccgcccgctgaaacatcacagttagccacaccacccgctgaaacatcacagttagaggatggtagaacagaagtacaaaatttggatgacaacagcaaccaatcaagtggttgaacctagtgatttggttacttcacaatgccttcaaagtacataacgatatagctaggtttgtatcacaattccttagagttagggagtacatcacttgttaacccccaacacagtacatgcatgtactgcttgtgattttagagtaaaaattggaagggggacacttgcagtcttctgaggattgcagcaacaaccg

SEQ ID NO: 53438 - DNA, 1650 bp, Oryza sativa
  unsure (1)..(1650): unsure at all n locations
ctgaatttctcacagatggaaatgcaccctggttggaagaacaataagattttcgaggcctgcaaaaaacatggaattcatgttactgtaagatataatttcttatgaaaatcagatacaataagctaacctcactgatgcaatttccgtgcatgtttttgttataaaaacaaacgctctttaacatttttcttgtatatttaattatttatgtcacttttgcaggcctactccccactgggttcttctgaaaagaaccttgcgcatgatccagttgtcgagaaggtagcatccacaaatgttcagatagaataaacaatatgaaaagttagcatgctcttcaattacgtgtactcgatagctaaatacaaccatataaatgcagatagccaacaagctgaacaagactccaggtcaagtgctcatcaagtgggctctccaaaggggaacaagcgttattccaaaatcaactaaagatgaaaggattaaggagaatatgcaggtgtttggatgggagatccctgaagaggacttccaggtcttgtgcggcatcaaagatgaggtgaggattgaccttgtgcatcccgtttgtagcgtgtgggcttgtagactgtagctcagctgtcctaagagctcagaggttgagtgcaaagagaatatgtttaatgaaattactgttaaagatggcttgatgtggatgttattgttcttgatatggtagactgcttagaaaatgaaaacttggtatagtagaggtgtgaaacatcacttgctagttttgacccaacgacattgcatggcaattcagcactgcacgggcggaatctggatctatattcctatatatactgcaatagaataatccactccatagtgacaatgcagtagtaagattccgtcagtttgtacagctttactacatgttttaagtagtttcttcagggtatcttccaggctagccaggaagacatctcacacagaaaatttcggtgttcagaacttcagatagagcatcatttgatctgttcggtgtgacatctaattttaaatactggacttaactaaacacatatgctacacataataaactactaaataagccccgtctacttagctacaactaatctttttctctgatataatgtgattggaccttggtattgcagaagcgagtcctgacaggagaggagctcttcgtgaacaagacccatgggccatacaagagtgcatctgaggtctgggataacgaggactaagctgccatgtttcacccaaagatatggcaaataatggttatgatgttggtcatgcacgaaggagttatgtgatgttctccaagcactgtgacgaaaccagctaactcagcacaagatgtactactatgtgtaaaactagtattgttctatgtgtgctcttcttcaagctttgtgtaaccagcttctcagcacaagatgtacagccagtgctgtaagataaataaaagtatcatggctttgccgttgcacttgctactacatgctttgcctgcttagcattatggttgagtttactctttcttcatagaaatcgaaatgtgctgcctgcctgtcaagctnnnnnnnnnnnnnnnnnnnnnnnnnnnnnnnnnnnnnnnnnnnnnnnnnnnnnnnn

SEQ ID NO: 53439 - DNA, 6243 bp, Oryza sativa
  unsure (1)..(6243): unsure at all n locations
tgcagagaaaaagatatgggagcactataaacaattagtaccataactgtctagttatcgataataggtctcataattaatggtgtgactatattgatggtatacataatgattaggaaggaattaagcaatatagggcatattcaatggtagaaacgggtatggtctcttaaacaatacaaaattatttagagaccatgtctttacaatagttgagacgacaaaggctctaatcattaactcaaaaaatattcctttgttaatattcttttcatatttttatcctcatgcaaccatatttccatattataatgactaagagtcgttgttaagccgttgtcatgcataacaacgatgttttatctctcctctttctctttcctccatgtcaacaagtattcctaattagcaacgctaagagatcactattgacaaccattgtacatgccgttagaccatttgtcgatcaacggatgacatccttctttcttctctttctcttcattcttcgtcgtacaataaatcctacgtgacatattctctcaatagtgacattattcacgcccttaaaagttgattatggattggattctgatgcgtatgggctttatatatgacctagtacgtagaatgatatggtttttataaatccccaatgaaatcttatatgcagatattttttagagcaatatatatacttacttcggtcctgggcacaactactaaggtgtgacaagaacaaggaactaatacatattgcatatcgaatcctagagtcaacggctatacatatttttaccaagctcgagtggagatttagaaacaaacttgaataaatgtatatctcctttagtgttggagtattagtctttgcatcattcctggattgtacctgctctctattgagcgaattgtgtaataagtggttgtagcttcactgaagtaaaggccagttcattatctaaaaaaaataaagacttatttggattgttaccaattttgtcctatcaatattttagtagaatcatttggtaagtgagtgtaaatccatcaggggttaaatcttggtgtacacaaatattatgcacatgtaggtgaactttcaacaagattttgatgagatcattaatgtgctgttggttttttaatcttagagcatgtgttagtggggcgtctaatatggtgtcaatttggtattgcgtatgaaatactccctccgtccaaaaaggacaaactctgagtttccgtgtccaacgtttgaccgtccgtcttatttgaaaaaaatatgaaaaaaattaaaaagacaagtcacgcataaagtattaatcatgtttatcatctaacaacaatgaaaatactaattataaaaaaatttcatataagacggacagtcaaacgttggacacggaaatctagggtttgtcttttttttttttggacggagggagtaatatatgtcagtatgtttctgcaatgtaatccaaaatagaatgaaaaaaaaggaaatatggcttgaaaagaacttaggtcccatcttttggctagctaaatgctcgtaacataccatacaacgtattaaagaaatcatatatgtcttcagcgatttaaatgtctttttttacgaacgcgcaaaagaattgcatgttaatctctatctcttctacttataaaaaaataaaaaataagagatgtttcctccatccgtcaaaacaaaaaaaagtagcgaaaaaaagtccgactcctaccgattccttctcaaaaagggaaaaaaaagtcctactctagatcggattcacccttaaaaacgaaaaataaaattgatgtgccggattgaagatctgtttgcaaaaatggaacctatcggttgagagcattccatttttatatgattttaatttttgatctgtacttttgcatttgagtccctgtaattttgtaatttttatatttacatttgagtccctataatcttgtgataagatacttgaggttgtttttgatttaaaaaataataaaagggaaagaacataggcagaaagctgcataaaaagaaaaagaaaaaccgcaaaaaaaaagaaaaagaaaaaataaacaacaacaaaactccgtttctcctaagtggcgaaaataaccgtagatccgatcctataaaaagcaaaaaaaagtgaaaaaaatactagatctgattcatttaaaaacggaaaaaaaaagtccgattcctataaaggcgaaaaaaattcgaaaaaacatataaaaagttcgtccagttctctaagaagaaaaaatggtttgtataaaataaaaaatacgcgtgaggaaaaaatagaaggggcgaaacaaattccgatttctaaccaatatatatctcttcgctacgtataatctaatctaactatttaaaaagagaaaatgcacgacaaaataaaaacggttcaaagaaacgtgtgagaaaaatcagaaaaaagcgcaaaaaaaacacgctaaaaaggttttccatcttccataaaaaataaaaaaacgtgcgagaaaaaaatatttccatcgtcagtaaaaaaattttaaaaaaacatgcgagggaaaaactatcagaaaaaacgcgccatttttaaaaaatggtttgaaaaaaccgtgtaaaaaaacatcgcctattaaaaaaacaaatcgatccgaaaaaactgtcagaaaaaagttaaattgatggacacttgagccggataggatccatcgattttttgtcatctactacacggcttttatttcgtcatatattctcctgtattggaaaaagaaaaaaagaacattcgaaaaaacaagcaaaaaaacacgcgagaaaataattgtcagaaaaaacatgcaaaaaacacactagaaaagaaaagcaaaaaaaggagaaaaatatggttttcgtcgtcagtaaaaaaaaagcaaaaagaacatgctaggaaaaaaaatgttagaaagaaatgcgccatttttgaaaaatggtttgagaaaatcgcgcaagagaaaaaaacatcgtttataaaaaagcatgtcgctcattaaaatacaaacattgtcattgacatgattatgcatgaaaaacgtatattatcattagaatttttttcacccgttgcaacacacgggcatttttgctagtatattagaaggaaaagagttttagttaaacaaacgcaatcagccagactggcttatgctaagggaaggaagaaaaagtaaaagaagaaaaaaaacctgaagcttacagaaattacggtggctaaaacagactccaagcagcgggaaggggctaagccatgctaaactcccaacaaatccccaaaagcagcgacgccagctaaagaccacagatggccctccacatggacggactccaaaaccactgtgaccgaagagagagcggagtcgaaaaccctagagttccgctccttccatagacaccaagagaccaggagcactagggagtcgaagctgtcgcggaggtgctcaggtaagcaggccctggaagacggccactagtcctggaaccaactgccacggagtggagagagggcagacaagccagaaggcgacaacacccggagccagacctgccgagcgaatacgtagtcgaggaggatgtggttcgccatctcaagatcttgagcgcaaaaggggcaagccgagtgactatcgataccacgcttctggagaagatcagccgtccagcagcgctgctggaaagcggaccaaagaacgaacctgcatttggtaggaccctttgcttgccagagaagatcagcacaggcaaaaaaaatgttggccatagaagaaagcctgttatgccgaacgcgcagagtagcgctggtcagccgtccagcggcaaacgagacgatcctcgtcaccggcgagagctgtacgtgaagcaccgcatcccagataagaagaaactaggagatgaccgggacagtgagggcaccgcggatatcagcgatttaaatgtcaatacttaaaaataaacttcaatagaaaaactttaaaattaagttttaaaatttaaattttgacaactactgattatgcatagacgaaacgttaggtgccttaattaagcgtgaggaaaatatagagatatctcgcccgtctttacctatcaaattgatgaatgcaacatttcacctttcccaaagacaaacgaaacgaagcaattaaaattcgaaacttcaactgaaagaaagaagccggccggctgccggcgcatctcgaaagcagccgtttttcaattccttttgaaaccaccgatgctctcttgcaatcgaccgaccaatcgctttgccatcgtcaaatcctccggaaagtcgatgtggtcgtcgccgtttagagcccaagcgtatacctgcaagcggcgacgaagaggtcgatttttttaaaaaaaaatattatttttttttggcttctacatccaactgggtatatgcagccattttaaattaggaacttagcccatcaaacaacccaatttgaactcgagattttgcgctactactcagatcactacaaccactaaggccccctttgattcaaaagaaatttataggaattttagaggattttatttctatagtaatttttcctatatagccctttgaatcaaaggaatggatcttatggaatcctatgaaattcctatggaatgcctaatgccatgcaagttttggaggaattctaacatgaggtaaaacctcatggaaactttcctttgagtctttatctctctctaattcatgtgtttttcctgcggtccaatcaaacgctcattcctatcaaaattctacgttttttttattcctacgttttttcattcctacgattcaaaggggccctaaactgcatctccttttacgaggaagagatagatagaatgaagcagttggagagggaaaaaaagaaagaaccccagaaaaggattagcacgccggcgaagcttctctccccctgtgcaaagcaagcaaagcacggcgcgcccaacttgcatggcaacttgcatgtgcgatgccgcaagctcatctaacttagcaaaaaaacaagaggagaaggagaggataataacaaagcatggaggccaaataaatcaaatccggcgaacggccgagttgttctttaatttttgttcctccttttcttttcttttcgcgaacacgacggtcgagttgctctagatagctagctgatcgatctttcctgtgtagcaagcttgaccgcgggaacgagcaaagagagatggcgggaaaaatgccagttgaacaacttggccaagtgcccaaatatataaactcctatgctactactctttttcctctccatatgtcgcaagctttcagtttgttaatgccaagtggtccttataaaacaagaaggggcaaaaaaaaaactgaagtaaatgttcataaccatactgccagttgcagatttttaacatcacggtacagggctagctagcatgacgtcgtacaatttggtcaggcatgtgtaccattttctttggcaacgggtacaaaagggctcgatctgtgagctgtgaatatcttaatttcgccggatcagccagcattgatacattgaaacaccagtagttgagcatgtcatcactactactgtaaccagctactccgtccctaaatatttgacgtcgttaatttttttaaatatatttgaccattcgtcatattcaaaaactttgtgaatattattcaaaaacttgagtagtagtaatatattttaacaatgaattaaatgatagaaaaataattaataattacttaaattttttttataaaacgaacggtcaaatacattttaaaaaatcaatggcgtcaaatatttagagacggagtgagtaattactaagctatacccaagaatcacaatgtacgcggcttggctggctccatgtttgtattgcctgccgccatgactggcatcagagcaagctccaagctttcgctgcgatattagcttgcatgcactcgcgtcaggtggcacagaccacctcgacctgtcgagcagaaagaatcctaagcgaacgcatacatacaccgatacccgcacggtctcctagctgatcgctgtcaagctagttcttttgcccagttgatggatcattgatgatggatggatgaagcatcgttccactttacttnnnnnnnnnnnnnnnnnnnnnnnnnnnnnnnnnnnnnnnnnnnnnnnnnnnnnnnnnnnnnn

SEQ ID NO: 53440 - DNA, 730 bp, Oryza sativa
ccatcctttgttgtttgctagattactgacttatcatcatacagggaaaggacaggatgttggtgtaaccctagtaaaaacacttcagaaccccagatattcccttaatgaaaagttggatcagagttttataaatttatttggtagaaagcctgctgctcagtccgaagacatctctggcaaccagaatgatcagggagatgctaatattttggaagaagcagatggtaataacatatgcaacgcaaacacattggagagcaatgatcattcttattctgagtgctccagcgatagtgaacatgataatgatgaagcaactcagcaaaatgaccatgaagttggcttgagagaagaggtggaattttgcaatggaaggatgaggagaaaagctgtatcagctaattttaaagatgatgacgatgatgaggtttttaccattttcctttgttcttattaattaatagttctcttgctctcacattcttttttttttcttgctctcttactcttaagttccctgtttagttttgtttgcccgatgtaatccatccaggaaacacatggctttgcatcactactccagaccaagaaatttgacataaaacactatgcagctgaataacattatgttagcacagctattggccatttctaagtcaccaggtggagttcatgtctcaacatcatttgaggtgagaacaatgatattttttgaatacctatcata

SEQ ID NO: 53441 - DNA, 2061 bp, Oryza sativa
aacacctttgtccctcttttcatgttacagccacgaaggtagccatacaatgttattttcctgtcacactttctgttcaagcgcacactttctggaggagttacatcttcaaatctatcgactagcagataaggatgtgccatcctccaactcagtgggataggcttgataacagagatgaaccttgcaagattatggacttctcttttcgtgtacctgcatgagacaaaaaatgaaacttctacactaaatgaccaaatagtagaaatgaaaagaacataaaaacaagcattctcacttataactgcagcatgaagaaagataatgtatagtaactccctgctaatatggtgagcttaaatcagcatagatttgtttactgataagtatcgattgatagttcagctataaccactcctccgtccatgatataagggattctaggttattttggagagattttaaggatgaagggaaaagactgtgatgctctttattaaatgagaggtggttggaagtaagattgggtgaaaattacatgagggatggttgaatgggcaagtagtactctacaatccattatatttgtgtacaaaacttgaacctcaaaatcccttatatttgtggacagagggagaacaaacaaagagtctgaaggaagaaataccagctttatgccaacttactttccatgaatgagaccagacaagtagaaaagttttgctccctcctttatctcagcccaaaatcgatgcttcaggcgctgcttggttttcctaagcttttttacatctttaaacttatcaagatgtgtaaggactcccatcaccttggggaatccgtgcacttgcataatatttaggaactcaaatgtatcctggaaacaagcagttatttaggtgccagtagtacaataaagcataaatggaattaatcacgcggatagaaagcagtgaatagatcagcataataaatacagtatgtcagctccatcactagtaggagtggtaggcagtaatggacagcactttaattgctagtaatggaactttagttaaatgtataagatgaaacttttatcggggatgtgctcctaagggcgaaaaaacatatttcagactacatcctaagctagaaatatttgtgaaaatataggcttcaacagcacaccatttcaaatccatagcttccatcaataagcagcagagcaagatcagctattttagcagcatcaatcattccgttgatatcatttggacactccaagaactgtacgcgcctgcttttacctgcacatgatgaaaaaattgcatacattagtttcatatcttcacaataattcaattgttcagaagaacaatatagattgtcctcaagtacaaggttcagagggttcattaacctgacacaacagtgattggaccacggacttcagacaaattttgtttcgtgtagtgctttactagacattttatcagcagcgacttcccaacctgataaataatgtaatgatcagaaaacaatccacatacatcatcttctccaggtggcagagcatacctgaggaggcccttgaactacaacaacaaaaggtggtggttcaccaattgagcgatccataattggcacatgaagacgacgttgttcaatctcagccgatcgtgcttgtagacgcttggcctttgcagctgactgaaaggcaaaagcctgggacaaagaatggtaacctattaaaataaatactccaaaactagagaaggaaaaggttaaacagatagacaaaccattcttgagttgttgagttcgtttgcacagtgtaaagaaccatttagttacagagatctaaccgtgtcctttttaaggaggatatttaccatttttctttaaaaagcatggatcatagccagtgaccacatgacctccaaccaaactcataaaattccatatatagacggcagaaaatatcaccaaagcataaataaataaatgcatctattgcaatagcttgctaataatacgagcacgggcactcaatgctatctaaattctacattttaagct

SEQ ID NO: 53442 - DNA, 4269 bp, Oryza sativa
agtaatagattggctatccgtctctagaacatgacatttacctgatgaaacagctaatctgttaaatgtggttgtaagttgatatcttttgttgtattagtaggtagataaagtattgtaagggcttgggtttgcaaccggagatggatgctaaaaagaagaggaacaagaagaagaaggggaaccaagggaagaacactggtgatgtaacgtccagcactgcagaggctgccattcggtcccacaatcatgagacagcccctaatgaccatcataatggcactgatgctgatgatgcaatgtccactgttggagaggaagctcctcagtaccagaatcatgagccagatcgacaggcaaatcatgatagcacaaacactgatgatgtcatgtcctctgttggagaggggattccatttcagaaccttgaccctgccatgacacatgaaaatcacaaagtcagtagtacagcccatgctgatcagaggagtgttgagatgtcagattccaccgtggagcttgacatgcacagactatatgaagcaaagcttgtaagtatctgtaaattattagattataaatttaccgtattcttatgcaaagttcgtagcttacaaagcttagtggaagcagcttttcctaccacttgaattgacagtgtattttttgcattagattctttaccgtgcaacaatacattagtaggtttgacattaatgctaaaagttggcaatgtgaattttcttttgggaatgcaaaaaaaagggtgctctgatatcacttgggcatgcttccatgttgttggattagtttcacgtgcagccataatcacccatacagtgagcaaagaccatataggtgtcattttttctcccccttgcccatatttttctcatcattcccacctcttgtattcttagtctcctccctgcatttgtccggttgcattgcaaccacttcactgttcttcctatcacccattcttagccacctaccatgtgccaatagttgagctcgtcactgccttacctgctgtcatgtttctcaattatgtcatcttttaacctcagatattgccaatgcaggataaattacatgatacgataaagaagttggaagatgagaagagtttgtggcatcaaaaaatggtttgtatctggctatcggcacttgtggttgacatacatagcactcatttgtatttatagtatataccattgctgttggccaattggtctgaaacatatttttggtaccttagtacaataaaataacatgtatagaatttaaatatctccataccaacctactttcactttttttcctaactacgaggcatgtcttgacaccacaaatttttatttgataataattcatggtccaacactcagtcttcatgtgctgataaacagaaacgagaagatatgtgtgaaacaatgttagattaacttctccgagttctaacagttttatcctgtgatttgtgctttgccgaatgaagcatttttgtttcatctattcatttcctcaatcaggcatctccatttgttgataatgacatttgctgttttgcatgttaaagacttaagttacaaattataatacatgtttggtacattattttgtgtccatatgtttatatctttggatcaaatggtttgttgcaaaatgtgaacaaatgctattttggccatcatagaaatgtcatgtaagaaatattttctcattctttttcctgcagagctccatggagattgaggttgaaaagttgcataacaaagtggattatcatgcacagaatgaggtatgtttatgccctggaatcctggatgcaaccacatgcaattcattcaaccaatatagctagaaaaactaccttactcttcatacccaagattttctgccatgtcacaaagtgaatggacaggtgatatgaattaaaaatctagctaaaatgttgtcttgtgatccaatctctaggtccgtttggaggaaaagctcaataatttacagaatgggtatgatgtgctgattaagaaggaggtatatatttatttattctaatgatttctttgctcgtgtgggtagacataccagtcctgcctatatgcaggagttctgaattttgcagattaattttagttccaatttgtgtttttatgcctctatgaacaacaaattatgtcgtcttcactatgatacttcacagctaagtctcaccaagtatgtctggcatttcattcatggcctcagttgtgtcctgtcacacttccaaacttgccacaagggtgggtaactaataattgtgaaaaaaagatgtggcttccacacttcttttgccaaagtgtggtcagaaacaaacatttctgatagtaagcacctctttcatttcacttgatactatagaacccaaagtgtctgtatttttctttttgttgttacattaacttccccctgatatttgaagtgtcttagcccctcatgtgggaactggaagtacgtcaggcttaaatcttgttataactgttaaacaccgctgtgctccttttgttgttatctattcgtggcttcatcctgtaaattttgttctctgacttcattcaggtagctttggataacaaagtcaggtccatagaggtcatcaatgatgccttaactcatcaggaggtaatgcatgaatcacttgttctgttacaatttttatttagtatttgcagcaaatgcatccaaagcccttcctatctgtttttggctgacatgttgctccttttcttcagacgtctcttaaagagagattaagtggactggaggagacaaataaagtactgcttgtacaggtatgaactacaaatccaactatttgtgtttttttttctttgtagttaatgtttgatatcccgttaagattcaagcaagcaaatgattagttaaatactaagattgataggttgttgtgtattatgtaatctgcaacatgtggccaaatatttgtcctctccagaaaggtgttcaatcatatgtaaagttaaaagtcatgatttattcgtgacgattttgaatatgtcggatttaaagctttggtgctttggttttcatttgcagcattagacatagttctgcttatatcatctgatattactatttaataacaaagtctggcaggtgaaggtgctggaggaagcttcaaacaatactgttgaggaaagccagaggttggtaaaaggttttgatgaactggcatcaagattaggagtctttgaagcaaagtctgctcttactgaagcctccgtgactaaaaaggtaaatgttatgcagaacattcctttttgtcacctgtgtccaatttggtagacgctatacactccagtggatctgcctggggagaaataccacttgatatcagtagtctcttctctcttgtgcataaaacacttgtccttccagattctagtgcataagatagagacatgataattgaggtctttgaaaataatgtgatggattaaacggatttgaccagcacagttctcaatgagcagactgttggttttggtaagaagtacgagtctccgcatgcagtgtgacagaatatcaaatgtctggaaaccgccagaattcatatatacttgtatacagcgtaattgttttctgcttgcagggtaatgaactgattgttgatagaagtgtaaacagttctgcagcaattacttctgtggataactatagtccaatcaacagcagtcctagcaacgcctatgttagtaatcatctagaagaagctccaatgcaacttccagaaacaacaatcaatgatgtttcttccgagggcctcattgacatgaatgcacatcaaaggtcaaagcaagattttgatgaaccaagaacaagcgaagaaattctgccagttgcattagatgatatacagattcatgaggaagacccacaaccaccggtagccgatgatgaggcagaggaggttccattttctgatgctccaatcgtcggtgctccattccggttgatttcattcgttgctaggtatgtcagtggtgctgatttggtgaaccagaagtaattctccattaatgccatcaagcagcttgagatctgtatttcttggaaagaggagtcttcctgttttgattctgctcacacagttatctcgctaagattgtgaggatgtatacgatggatgcactgaattcaacagagatatggaacctctgttcagttcttggtagtgtgctcgtgtcactaccagtttttctt

SEQ ID NO: 53443 - DNA, 1674 bp, Oryza sativa
aaaggaactaaactgccaatcacgttgtctcctctaccttgatttttctttccccatagaaaaagactccctagtgacaatttctaatgaacgcaagttaccaacaccggagcacagcatgtaaatacaggtcaagaagccagcaaatcaacttgcgcatcatgcaatgcttctacatagtgccagtgctgaaagcttctggctacattgaagaggccatcacgaccagcttaattctaaatgaattgctgcaacctgcaaacatacaaaccagtaaccacacagcagctcgtcaggcattacgccgaaggaggattggattccctggcattttcggtggaggaatcgcggctctctgaagcagactggcggagctcctcgatcatcctgatcacctccgccatcgtcgggcgccgttcaggggatcgcgacgtgcacgccattgcgagctgaagcatctgcacaagctcgtcttctatgttcaggtacttcatcagctcaacgtcgaacacttcagcggtccactcctcccggaccaaggaatgcacccgccttggtagatccacgacatcgtcctgtccttgcgactgaaggggtgcttttccagtcagcatctccatgaggagaacaccgaagctgtaaacatcggacttgtgagtgaatttcctggattcgaaggtctctggagcacggtaaccgacaacaacccgggatgtgctgatggggaagctcatcaaggcactcagcccgtagtctgagacgtaggggttgtggtcttggtcgaggagtacattggttgccttgatattgccatgggcgagcttggagccgccttctgcatgaatgtgtgctataccacgcgctgttccaagtataatcttcatcctggtattccagtctaacggggtcttctcggcaatacccttaatacctgttaatcagaagtttgtgagaaaaatgagaaataacttttggttgcgtgcttgcattgcattttgtgcttgtaaattagctttgatacatcatggattgttagatttctacctggaaaaattgatcaatatcagaaatcaaatgtaaagcatttagtagtgaaagacataagcataccgtgcaacatggctgaaaagctgccggtggcaacatactcatagacgacaagtttctcatcctttgagtagtagtaagcgcgaagaggcacaaggtttgcatgtttgcctaccctcccaatttgctccatttgctgctcaaattctttcttccctgccacgacgtcctttagcctcttaacgaccactatggtgccatcctcaagtatagctttgtaggcagtcccatagctccccttaccaaggacttcggcagaagctctcagtaaatcctccaagtcaaagttataactacatccatccaagaaaaccaatttgttcttctcggccatttggacaccgctactgacttgctctttgcgcttctcaatccttgcattatcagtgcctttaccattgttatccaatccatcatctttcttctccttcctcttagaaaagcacacgacaaatatcgcagcagctagcagaaatacagcaaagcccccaactgcagctgcaattatagagccagtacctactttcttcccacgatgtggcaatgctgatggtggtggtaatgaag

SEQ ID NO: 53444 - DNA, 1304 bp, Oryza sativa
catgcaaaaactcaaaatcccttatactatgggacagagggagtactagcatactgtagtatatcctcacgtcacagatttattttttttatcaattttgtcatactttatgacttacaatttgtccacaatacatttggggttatcataacttacctaatcttagttgtgttaaagtgtggtcgataatcaaacacatacataatctttagaggaggttaatcgctaggaaaaaatgattgaaaaatacataaaatgagatgagtcattattgtatgattaattaagtagtaattattttagacttaaaaaataaattaatgtaatgatttaaaacaacattactatagaatttttaaaaaaatagttactattttttttaaaatagttacaagacaaatattttttccctttctgtaactaacgctcccttagtatttacttatgatttgttataaaacttttaccaagattagttactattactgtatatctttgttcgtagtatgaatgtttgattcgtcggcaaagaaatgacggcaacaggtattcattcatatgtcgctgtggcctgtggcgagcactttcttttcgccgggcctgaataatgagtacactctcaagagatgttaatgctctatttcttactcgctaagattaccaatcatctgaaagcttcagtgaacaaggcaaagaaaggggagtgtgaatcagttcacaattttggaggcggcaggaagggatcaaaatcagatagtgccaccatggtccatcgaactttatatgctggggaggagctgtttggttgaatccgcagctcacatcacatcacaaaaaaatttccatgcttttttctcctctcctttgcttccctggtggcagatgccaccgttcttttgtcctcagtggcatctcaagctggagaccacaccagctgtcaagaactgggggattactgtagtttctgcatcttggaatcgcagttatataatgctgttaatcctgctatgttcaagtgtgtactatgtcctaccttgattctgtgattttggttcttcttggagattggaagttggatctgtccaaaaacttgcatggaggactgtccataggcagcaagacaaatcgctgcccaagaacaagaacttagcctaaaaataaaatgaaagaaaaagagaggaggaggaggatgaggagcaagaacagttttctatctattatgctgaaacgcagcaccggtgaagcagcatatactgattcagactacagtattcatgcagattggtgcttatgaatcatgccaa

SEQ ID NO: 53445 - DNA, 2918 bp, Oryza sativa
  unsure (1)..(2918): unsure at all n locations
nnnnnnnnnnnnnnnnnnnnnnnnnnnnnnnnnnnnnnnnnnnnnnnnnnnnnnnnnnnnnnnnnncccagggtttatgattccgacgaaatccaatcggatttcgcgaccatctgagatgaatggttgaactgggatgaatgaaagcttcgtatattccctaatcagcgtgtatgcatattgatgtataaaagttaatttatttgggacagagtgagtaaaatatttcgaggagggggcttgggaaataattttctttctcaatgtccaaatcgagttttcattgagcttttcttaatagtttaatttattatattattattctctatcatctgtatttgttaacaagccaaaacgaaaataactgtcatgggcctaacaccctcttgcactagtttgcaccacaaaagaataaaaaaacacttgtttttcacgtgcacacttttcaaactattaaaaggtatattctcttgtaaaaactttttacaggaaaattgttttcgaaaaatcgtattaatctatttttcaagtttaaaataattaatacttaactaattaataatatcttaatagctcatcttattttacgtatattttcaatcattttctttctcctccttccgaacactccgagtatgcaatttagatggatagagtcttttatgatagaattagattaggttagggaattcttcatctatacagtgagcgactctatatagttcagggtaagcattacactaagagtatcgatgtatccgtagcatgcatgtctctccaaaccggcacacccttgaggtacatggctattccattttgttccaaaatattcttgcttgcgacaataacttgcaaaattagaaaattgtaaagagagaatagaccaacatgagcaatttaggactgagccaccgtgccaactatacgagcttctattcacccttgcgcacgcacaccacattcacgcatttacgagtatgatctctctaacacacggttcgtatatataaataccattaacatattcttgatctcactaattatatatgaaaatgcatctacatgcacataatatttgtggaaatttagatttgaagtgaagttatggactcacgactccacctgatacccatgataatttccccctgcaattattttttttcttggttagcgatgatgattctaccaggggtatcattttctttaggcggtgtttgaattgtggttgtggaatgagaaggcactgatttggacggacctattcttatcgaacgactagtaatattctcgtgcattgcaatgggtccattccaccgggccataccagtgggaataagctgggtgtggatgtaatacacatgattttttttagcaaccaccttttttttttctgtttttctgttttttttccggcatgagtactacgtgtgtgtagccagattggtagttaggattggttttgtcatgcccttgatgaggtatacactaaatacaggggagggaggacgaacgactccacttttagtattataaataaatatagtaggatgtctcatcaactgtctatctggaggtctatctggagctggctaatgggcgattgatcgctcgatccccatccaccatgtacactcctctctccctccttcctccttccattcctctcttcctactacactataaatttaaaaaaaataaaaaaaacaaagtttgaaaaaatatataatttaaattcaaatttaaatttgaaacgggtatgtaaacttttgacttataaactttgggtctataaactaatatttgaatttaaattcaaaattgaatcgggtatataaacttttgacttataaactttgggtctatacactttaggtgtataaactttagatgtgtagaaatactatatatataaaaaatatttgaattcaaattcaaatttgaatcgggtatgtaaacttttgacttataaactttgggtctataaactttaggtgtataaactttatatgtatagaaatactatatataaaaaatatttgaattcaaattcaaatttgaatcgggtatataaacttttgacttataaactttgggtctataaattttaggtgtataaactttagatgtatagaaatactatatataaaaaatttgaatcggatatataaacttttgatttataaactttgggtctctaaactttaaatgtgtaaagttgaggtgtacaaactttaggtgcataaatttactaaaatagaaaagtaatgcggtgtcaaaaaggaaaccagatggagggagggggaatccgaatctgatcgctaggggcgatcgatcgccccttagcaatctcgctgtctatctagagtttggttgacagggcggctccattcatgcgaaaattctcaaacttttgaaagcccacctagcacttatttttctgaaatgccaaaactacggaatgtcatattgacgaataaatttaggtagtttatttagtcttcttaataatcatgaaaacacaaggttgaccaataaaagtgccaaagagaaactccctaacccaaaaggtaatttataatcaaattctataattcaagcgggattttcattattgggcctttaaggtccaagacctacgaacccgcaaaaaagagcccagaaaggaaaaaaaatatactttgactcccttaactatcgcccgagtttgattcttgtccttcaaccataaaaccgagtatatcgactccttcaaatatcaaaaccggtgcaaacaatgtccctcggtggttttagaggtggttttggctgacgcggcgggcttgaccgagtctttgtcctacgtggcgcttacgtggcactagaataaaaataaaaataaaaaaatatgtgagacccatatgttattcacacaaaaaggg

SEQ ID NO: 53446 - DNA, 8023 bp, Oryza sativa
  unsure (1)..(8023): unsure at all n locations
ctcacaaactcctagattgtctggaggaagaaaatgaacagtgcactcacaaggtgttcgccagagggagttttggtgatgtgtgtcactggctcactgcagcttttcgttttctcatccttttatttgcagaatacaaagactcaccatgcatcgtggcctcgctgccattgccgcgaatgtgttccatcccacacgagcgaagcggagcgcacgacgcggatacgccgcgacatgaactaagcacgtccgaaggaatacgatgccaacagaaattgaaacctgatgcaatctactctaggatgctgctaaaaacaaggacacacacatgaccaccgtcggctacggcgacttcgtcccgccaacgacgctgccaagctgctcgcctgcaccttcgtcttcctaggcgtctccatcctagcttcctcagcaaggccgccgactagctacctcgtcgagaagcagaccagagcgctccacttccgcgcactgcacgcccgcggacagagcttaattctcgtcggccgacgctaggctatggctcgagcgacggctccggtggctggtgcttccctttggcgtgagctcccagctacgattctgcgcatgtgcaccgtacggaaaggctatacatcaggcactcgcggaccggagccgttggatgcgcaagcgacggatatcgggagtcgaacgtccctctgacgtagaggagccgattcccggccactgccaccgccgccgctcctgagagagataagggagaaagggagggaggatgacatatgggtcccacatgtcagagggtcctactttttatgtgaatgatatgggttccacatattttttttaattttgttcttattctaatgccacgtaagcgccacgtatgacaaagactcgatcaagcccgtcacgtaagcgccatgtcaaccaaaaccacctccaaaaccaccgagggatattgtttgcaccggttttgatacttggaggagtcgatatacccgtttttatggttggaggacatgaattatactcgggccatagttgagggagtcaaagtatactttttccgcccaaaaaacgcactaactttctaagcccattaggcccataagttcggcctggtatatgcgagcgcgagatctccagagtaaacggcccataaaaagtagcattcgacgccgccgctcgtcatccgaagccgagccgcgacgagggaggaagaagcatctggaggcgcacgcacctcaccttccttctcccatggcgccgcccttggtcgccgccgccgccgccgccggggacgtatcctcctcctcccctctcttttcctcctcttcgtcccgccccctcccccgccgccatctgcccccgagctccgtctccctcgggcgcggcgccgctcgatcgccgcggcttccgctgctgtcgagtccgccgggaggccgcttctcgaggcgcgcgatctcgtcgcctgcgtgaaggagaacgggcaggagatcctcagcggcgtcaacctcaccattcgggagggcgaggttcgttctggtctagttgtgtggctatcttaaaattcttaataattggggtctgcgaggttgcagggtacttagattgggtgttcgtctgcttgttttgtatagattcatgcgctcatgggtcaaaatggctccggcaagagcactctcatgcctgcaggtcgactctgatccccgatgctttcatttcttattctgccaaaaaactaaatattaggacaagaactttgctaggatcgacactgtgcggaaatattgcctgttacctatgtaacacttctgttcctgtatatttttgtttttattagcatagcatagcagattgtctcgcacaattttgcgaggagctaaactttggaagtcgaattggatttagtatacacctctcaactttgttttcacctgtaacagttgtattttgtatacaatagattattaaggtgaaattgaatttgataaacaattctttagcttctgatggaattgtactttgtatcacgctacatcgttaatttggaccaaccatgatctaacggtgtagatctttctttttcctccaattaatgtggtaatttatagccaccaaagcgaacatggtgactcattttcaagctatcttaataatagataatacatcaagtgttttctgattgcgatagaattgtttatatgtattgttgccgcctggcttctctagtatttgcttctgtgagaaattgtgccatccatgaaagaggtttctggttgcctcgtgtgtattcttagtccagaataagaaagtgcaactagaataatccagtttgtgatcttgaagttcaagtgcttttggagatcaacccctaagtgttcaatgtgccttcccaccatcctgattaaaccgagaaactaaccatgtttgttactgtgatatctaaaacttcagtgaactgttgcatcctttcgtctcaggttctggctgggcatccagagtatgaggtaactggtggtaccgtgctctttaagggtgagaatttgattgatatggagccagaggaaagatctcttgcgggcctttttatgagtttccaagcacctgttgagattcctggagtgaacaattacgattttctgctcatggcattaaatgctcgcagagagaagaagggtttaccagcattagagcctctccaggtttgcaatttatacttatggtgtaaggcatttttaaaactgcactcttaatttacaaagggaattataaggcatcatgtgtttctcactatttcgatgtatgacctatcctattaatatttctcactatttcgatgtatgacctatcctattaatatcttataggaatgactggggttaagttaacatgtcccagactccattgtctacgttgtttgtttttctataaatgcagaactttctattttaataacacaagtgagcttggtggtgttttctaacctaatcgtttcttgttttgctgtttcttactgttgggttatttccagttgctaggaactctgacataacttctctttatcatacaggtttatccaattatagaggaaaaggttaatgccttgaatatgaatgcagagatccttaaccgtgctgtcaatgaagggtttagtggtggtgaaaggaagcgcaatgagattctgcaactctctgtaagattactatgaaactatgtggcgtcttagtttattgtcaaatgaacattacacacttttcgtttgaacataaatctggagaaatattcttacatttattactcagcaataaaatagaaactagtgttttatgccacgaagattcactgaacttctcttccagatgccatgttctgttaaatgtgattttttttaatgcaacgctcttgtttcgttaggtcttaccgtgggcggcggcgtgaaactgtggtccaaaatgcaattcactgatatatttatgaccaataaatataggcaaaagtttcctgaaaaaagtgctagaagataatattttatgagacagtgcttccttgaacatttttacctgtcagaagaatttgtttgactatctagttatgtacttcgataaatttgtgcctcttatttgttttctcattatcaattataggtccttggggctgatttagctcttcttgacgagattgattcgggattagatgttgatgcactcgaatatgtagctaaagcagtgaatgggatcttgacaccaaacagctctctaatgatgattacacactaccaacgtctcttggatcttattaagcccagctatgttcacatcatggtaagcgtatagacaaattcctttttgagcaattgcacttgaattgatagtaatttatttgttcaaatgaatttaatacttcaatttacataatcctgtattattttcaagtagagtctcttttggactcatcactggctaatcattacattggtacacagaatatattgtgattttagttggccattaggtggtaaagagctatgtgagttatatacaattgttccactcaagatgtataaatactaagatagcaaacgtgtatgatattgctcattatccatgctatccctcctgttgttttcttatgaaaattttgccttttgatggtatcttggatttgaccaatgaccactgctttttaaatgttccatcactataatatatataaaaaataatattgtaaatttttttttaaaacctagtgatgtaggtttcatatatccaaattttgacacttttaaacaatgatgtcgcaatttggatgtctgaccgagtggatcagcaagcatcaattaaataggtacacatggagtactacatgaagggcatgaattggtattgataatacttctgatatgctacttccaggaaaagggcaagatagtgaagaggggtgacagagctttagccaactacattgatgagtctggctacaaagcgattgctactgcgtagcatggagcatggagaaaggtcgngnntttgttcctcttctttttttggtcttatttttgagcaattttgtatcctcttatacctgaatagttttctcatgtacttacattgtgaacagtatcagtaataccgcctgattaaagagaataataatgaaaatatgttttagattggtatctgaataagtaattcaggttcatatggatttgactgatttttgatgctttattgcagatctaatacttgaatgacttgttgggttagttcccagcctatagcctacttatcatgccagatttcagatttgtcattcggttccatacatttctagtattgcatgatgagagcagtgcatactaaattcagtagatgttgagttagtggcttagtgccccatttagctaaacgtgttaactctgaaagtggagcattgagttctccattgagtataggtcactttccctactttttgaaattttggattacagtattaagacatgaagaaaagtatcttgtgtatacacgattgacaaaattttcatggttttatctacaatttagccagttttgaatattggctgttccttcaattgttcatacagctataaagaattcaaagtttgtggtctgtttccatggcgtgctctttaaaggcctccccttatatgtttcacccaagaaatttgacgaaccaaaatctgctggttatgaattatgtatgattcagtgcgccttaattaattaatctgatatggagcgtacatgcacagctcaggcatgatcttttcttaggtgcatcaccgagaaaatgtggttaatgggtttttgctattcccattatatatgtgctacatgcctaggaaatacaataatttagctgtacaaaggttgatactggtgggctatactatgctaaagtttcttaggtgcgttccagacatgttatatagatatattttgaacgggcgattccagatatatgttgcaggctattgtccatctgccactaatggtgagtggctactacacagccatttctattacaaatgcatactttcgattgttcggtgctagttaaagcaaaggcaaacaaatctttctgagtttgtggctgctcccttactcgcaatgcaagttggttgacttcccaataaatggatctccaacgcttgtttggtttaaagccaatttttactcttaatattttggtagtgccaaaatgttagtaagttttaccatactaattgtttttgtaacactaatataagcaaaaatttgtagtaatccaaacatctatgtgatactattaaagttgtcaaaattttgataaggggctagctggcttcaaaacaaacaaagcccttcgtatcgacttggccgtagataaacaacagtgaaagatgacaacaatttagaattacggttttgctatctcatttgcgataaatatttagctcctatcttttgattttttttccataaatcttgtatcaagattcgtgtttctttagacctaagttgcagttaaatttagttacatggcacttatacttggttatagaacacttacattcattaacaacgcactaacattaaattttacaaaagttcttctctagattacgattttttgacatgttcatctttttttatttatttcaaaacgagttgtattcatttgtcaaaaattctgcaagatttaaagctctaaatctgtctaaaaataaataggtagctgaagttctaattttgaattgtacaaaataatgaccataattagaagttttgagcggtaaccggacatcgatgatacaatgtagaaagtatagagaagaaaaggaggggaagtccaagtaaaattaaaatgaagttcttgatagagttttgaaagacatgtagggagtgtcgagtggtgaatgcatcttctttttattcccctgtcgatgacaacctaaaagaaaacgaaaagaagaagatgcaccaatgcgcgtgctcggtgggagatcttgtcgtgagttgacctactcattggatggggaataacgaggatactccatttcattcttcaacagacttgattcaggccctcttggctgtttggttcataggactaatccattagtctctctattttagttccttttaatctttaagaatctaaacagagacgactaaaagggtcttaaaaagtacatataggactaaaatccattagtctctcttggaggtatttataggactaaagtgacagcttcactcttctctctccctcggtccacgtgactttactccccgtttagtcccttgatctaaacagtaaggactaaagtttttaggccatgaactaattttagtccagaaattaaatgatccaaacaggtctctcgttcccaagtattctactcccctcattggttaatgagggtttttaagcatagctgctggcagctctagctccgcctctaatgcacgctccatttctgcacccaagtgatccaccatgcccattacatcgccggaaagtaaagctaccggcgaaaagcctacattgtttgtgcgttccgttactagaggcttccctctcggtggtcaatattctcgagaatctatctctctctcagccgcggattacatcggagcagcctgcatatgtttaagcttaattcgtcagcgctcgtcgattggcggcagctacaaagtggaagaaaggagaagggatagaacggccagagccggccccaacgtaactcaccatcacgtattcacgtacacggccgagacgtcgccgtcgggcaatgtcacggaggaggtagccggcggcggagttgggtccacgtggcgcacacctggagcgctggcggtgcaacttgcacacgcaccggaggaggggtaaggtagtacctaatcctaaagctataataagcaggtcgcgtcgcgtgcatatatccgggccgtcctcctcgctccttgccaaattccatggcgtaatcatgcccttttttctcttgcgtttgtggtggtgactctgcacgtacgccatgggggggccgggcctgcaggacttccctataaaatgcacacacacgcaagttgttgctcggggcatcatcgatcgtacaatatcctgtcccggtccggccggcttagctgctgcaaattcagcaattgcttggcacatcgagttgattgatcgaggtatagtagtagtagcatgaagtagtgctctgctctctctgtctcgatcgatcggatcatgatcctttttttcctttctgtccgtgtccctttctttttctttctttcggtctcgaaatggggtgcgatcgatgatgagctaggtgaatatctttgtgtacgtatataattcaatgtcatgcttgttgatgcctacaggtcgatcgaggctagctaagctgcgtccaatggcgttctcacgggctacggcggcggnnnnnnnnnnnnnnnnnnnnnnnnnnnnnnnnnnnnnnnnnnnnnnnnnnnnnnnnnnnnnnnnnnnn

SEQ ID NO: 53447 - DNA, 1087 bp, Oryza sativa
gggggtggcgcacggtgcccgcggcgtgcgtcgcctacgtaggggctacatgacgcgggggcagtacggcagggacctgagcagcgtcatggaccaggtcgccgcctacgtcgacaccgtcgaggccgacggcgacggcctcgacgcatggatcctcgacatcgacgacacatgcctctcaaacctgctctactacgaggcaagcagttcgggtatggggaagagttcgaactcatccattttttagttctctgtacttcaacttctcgttaaattagtccgtacataactcaacataggatcaggctatcagcctagatgatactaagcataatatgtttcattcagaaaaaaaaaactaagcataatatgttcacgttgtcttcctttcttttctttgtttcttttcttttctataggttgtgtcattgtgtgcgtccctaatagatacaggcgccaaatgcaattccattatccaataaaatatccactattttttaaaaatgatactttatggccagtagctaaatcaataggataatcttttctttaatcggcttggatgagcttatcaaaacagaaaacttagtactttcaagtaaaaatattaatgctggaaatgtggcaattagtactttcaagtacagattaatatatccagcgatgtcgtgacttgttggtatttttattccagggcctatgatccctcggccttcaagacgtgggctagcaaaggggcttgcccggggatacctgcggttcttgagttgttcgccacattgcaagccaaggggttcaaggttttcctcctctccgggagggatgaagagacactggccacttgcacgtcagagaatctcgagtcagaggggttcttggggtatgagaggctcatcatgaggtgcgatcacatttctgttcttgttccatgttgtgaaaattttacactggttaaaaatgttttatggcatgtttagtttgttgtcactttaaacctttcaaattttggtagggcaataaagtaaacacactttaaccattactaccttaccaaattttaacagttctagaagcttactctcttgaa

SEQ ID NO: 53448 - DNA, 790 bp, Oryza sativa
tttaacttttccatcacatcgttccaattttgacgtgaactaaacacaacctatatgtactagttaatataataaaaattatacagtgaaccacctttttaattgacacagtacatatagatggacaacctttactttacatcctagttacgctactgattgtgattgcccttagatactatgtactctctctttactataaaaaactaacctgtactggatgtgacacaccctaacactatgaatctgaaaatatatctatccagattcgttgtactaaaatgtgtagtatctagacagctagttatagatttgtttttgggatatgaggagtagatatcaaatttatatatgtaggtatcaggtaatataagtagataccaatatttaagaatccagtgatatgagctgccaggtgccggcttacatttttttattgagggagtagatatcaaatttatatatgtaggtatcaagtaatataagatgataccaatatttaaaaatctagtgatatactctctctgttctaaaatataataacttttaactataaatctagataaatgcatatataaattcgtagctaaaaatcgttatattttggaacggagatatgagctgccgggtgccggctaagcaatctttttcccttgtcagcctatcctaagcggctggccgttttctacgttaagcggctgcgttttcctgttttcccctttcttaaaccttccacacacaccaatcctcccgtttacaccttcgtcatcttcgtcgcgactcggtgttg

SEQ ID NO: 53449 - DNA, 1943 bp, Oryza sativa
taatgatctattatctgaaatcttcattttgttatctgatgatgagagaaacattgaactgagatagtcttgagtttaaaacatatcttgaatgtgttcctgaatttgtgcatgattgtgtgagctaaactattttgtttactgaactaatctttttacaatgagttaatactagaattactgtgattcttgtatgtaattttattacttttttacagtaacatgttaagatgtgagttcatatgaattggctcttttgtttgtgctgtatgagatattgaacttttatgtaatattgagttggatgagacaagtggttgacattgagatttgaatttgtcattagtttaatatggtgattatgctgataaaattgaatgtatgacaattcaggatatgctatatggcctagttgttatatttctgtataactgtatgactgtgatatcttcagagtgaaattcagtaaggttggaagactaatcaatctgtcatgtttttttataaagttagtttggtattcatcaatagtacacagtaatactatcatccagaatgcagttttgtagtactgaatgcagtgtagttttacttttaacattacatagttcagatctacagagcaaacatatgaaattttcagttctgagttgttgtatttatccagcaaagtggattgttaaccttgtttcatttgacatattcagcaatttcatgtattcttttgaattatatatttgacctaaactctctctttgatctttttcaggaattgtatataggggataagaattggagccttgaactaaccttgaactggagccttcttgtttctcttgattttgccttcctcttgttttttctttgtgttctccagattctgtgtttcctttgtatggatctcaactttctgttcagaagttgtctttgatttcttctttcctatagaactactctttgattctgacattgtactctctccttccatctgcgatttggatcctctttttctctcttctttctcttctcctagctccatgtttgattcgtgctagatctgtttgtgaactagtagtgctgttgaaaagtaggggattgaaaagtgtggtcccatacatggttgattcacgtgacatgtttttcatctacttggcttccaagtttggtccctactacttttttggataggctgttggattatgatttgggctttatttccttgtgttttgcttctaattttgtatcttgggcctgctttttactaatgggcttttatggatctggatatagacttgggccttcaaataattcgcatgggcgaaaaaatcatgggctttgtttatttgtgtttgattcaaattttgtattttgggccttctttttactaatgggcttttatggatctggatatggatttgggcttttatggatctggatctggatttaggctttaaaaaaatggcgttcaaataatcaaataatatatctgtttttaagtgtaatatctatttgtatcactttttctgagttgttggatgtgcatcctatggtagataaaatctgtatgattggagcttcagaaatcattcgattcctatatagacagccccttctttttttttggttctgggatttttttcctctactcaggctcttctagatggcattgtccattttgtttaaaaacccttcttaaaacttgcattttatatttaggtccgctggacctttttctcaccgttcgtatgtcatcggacggctatgggacattttgaatgcgtggcatgttctcctgctgagaatttggatggagcgcaagcgtgatgccacgtggctcagtgagaggcctgggattagacctgaaatcgtatatagagattgagggacctcagatgaacttattcctatataaaacccaaagtagggtccacgtgtgcccaaaa

SEQ ID NO: 53450 - DNA, 1254 bp, Oryza sativa
  unsure (1)..(1254): unsure at all n locations
ggagccatgcttcgtctttgccatccaacctgtgccgccatttctcatttgtggagatcaaggctgcgacaaacaactttgatgagtccctcctccttggcgtgggtggttttggtaaagtttaccgtggagagattgacggaggagcaaccaaggtggctatcaagcgtggaaacccattgtctgagcagggtgtgcatgagttccaaacagagatcgagatgttgtcgaagctccgccaccgacatcttgtgtcgcttattggttactgcgaggagaagaatgagatgatcctggtctatgactatatggctcacggaactcttcgtgagcacctgtacaagacccaaaatgcaccactttcttggaggcagcgcttggatatctgcattggtgcagctcgtgggcttcactacctacacactggtgcaaagcacaccatcatccaccgtgatgtgaagacgacaaacatcctcctcgatgagaagtgggtagccaaggtttcagattttggtttgtccaagactggtccaacaatggatcatacgcatgtgagcacagttgtcaagggcagttttggttatcttgatcctgagtacttccgcaggcagcagcttactgacaaatctgatgtctattcttttggtgttgtactgtttgaggtcctatgtgctcggcctgccttgaatcccactcttgcaaaggaagaagttagcttggctgagtgggcattacactgccagaagaagggtattcttgatcagattgttgatccccacctgaagggaaagattgctccacaatgtttcaagaagtttgcagaaacagctgagaagtgtgtttctgatcagggcattgaccgtccttcgatgggagatgtgctgtggaacttggaatttgcccttcaaatgcaggaaagtgcagaggagagcggaagccttggatgtgggatgtcagacgacagcactccccttgtgatagttggaaagaaggatcccaatgatccatctatcgagtcaagcaccacgacaacgacaactacctcgataagcatgggtgagcagagtgttgcaagtattgactcggatgggctgacgcctagtgctgtcttctcgcagatcatgaaccccaagggacggtgaggtaacaatgtctcggcttgttaccctgcaggcataatnnnnnnnnnnnnnnnnnnnnnnnnnnnnnnnnnnnnnnnnnnnnnnnnnnnnnnnnnnnnnnnnnnnnnnnnnn

SEQ ID NO: 53451 - DNA, 1343 bp, Oryza sativa
  unsure (1)..(1343): unsure at all n locations
cactttcacaccggagaagggccacccaaacgccttcgccttcgtcaacggcatcgaggttttctcctcccccgacctctttggcagctccaacccgatggaggtcaccggcgacggcagcggcacgcctttcccgatcgacgccggtactgctatgcagaccatgtaccggctcaacgtcggcggcaacgcgatctccccctccaaggacacgggcgggtatcggtcatgggaagatgacacgccatacataccctttgcgtcattcggggtgagctacgcgaatgacaccaatgttcccataaattaccctgacagtattccgcagtatgtggcgccggcagatgtctactctacggcgcggtcgatggggcctgacaacaatgtgaatttgcaatacaatctcacctgggcaatgcaggtggatgctggttatcagtatctcgtgaggctccatttctgtgaaatacagtctgggatcagtaagatcaatcaacggacatttgacatctacatcaacaaccagactgcttttagtggcgctgatgtgattgcgtggtctactgggcttggcattccagtgtacaaggattttgtggtgttccccatgggttcagggcctatggatttgtgggtggatctacatccaaatgtcaaaaacaagccacagtactataatgctatcctcaatgggatggaggtttttaagttgcagcttactaatgggagccttgctgggctcaaccctgtccctagtattgtaccaacagcgtcgggtggaaattctgggaagaagtcaagtgttggtccaattattggaggagtgattggaggtctggtagttcttgcacttggatgttgctgcttctttgtgatctgcaagcgtcggcagagagcaggtaaggattcaggaatgagtgatgggcattctggttggttgccgctctcactttatggcaactcacacacttccagctcagccaagtcacacactactgggagccatgcttcgtctttgccatccaacctgtgccgccatttctcatttgtggagatcaaggctgcgacaaacaactttgatgagtccctcctccttggcgtgggtggttttggtaaagtttaccgtggagagattgacggaggagcaaccaaggtggctatcaagcgtggaaacccattgtctgagcagggtgtgcatgagttccaaacagagatcgagatgttgtcgaagctccgccaccgacatcttgtgtcgcttattggttactgcgaggagaagaatgagatnnnnnnnnnnnnnnnnnnnnnnnnnnnnnnnnnnnnnnnnnnnnnnnnnnnnnnnn

SEQ ID NO: 53452 - DNA, 1935 bp, Oryza sativa
  unsure (1)..(1935): unsure at all n locations
ggcgaattcgagctcggtaccctatgcccccgtacacacctctcctcccttccccctccccttcttctcttcctaatacactataaatttaaaaaaaataaaaaaacaaagttggaaaaatttatgtatagaaatactatattaaaaaatatttgaattcaaattcaaatttgaaacgggtatgtaaactttttacttataaactttgggtctataaactaatatttgaattcaaattcaaatttgaatcaggtatgtaaacttttgacttataaactttgggtctataaactttaggtgtataaactttagatgtatagaaatactatatataaaaaggggatgctatataccggaatcccgttcaaaaacaggacgattctgataccgatatgacatcgctctgagcaactgtcaccacctgcatgcattgcagcaaaatgagaatgacgaccagcgcttgccaaacgccggcttcccggcatctcggcgaaacctcctcggaagcgctcgcctccgcgcgcgattactcgcttcctcccgccggcgcgcgcgccgtccaccggcttctccccatcatggcgaatcctcctagaaagcgcgcgattcctcgcttccttccaccgccgcgagcatcgtccatcagctcctctgcatcccggtgaaacctcatcggaatcgcgcgccattccttgcttctttccagcggcaccctcgtcgtccgccggctcttctgcttccttgtgaaacatcctcagaatcgtgttttgcaaggatatgatcttacaatcaaaatagtacaaggtttgacagagaaagcttgcatcaatgaacttgacaccagtgggaggacaacatgctgagaaggcccggtttaagaatcgaggtgataggcagtaaaaatatgtgaatgagagtaataccatcaagactgtgagtatcttgactgctatcatggtgcctgcgggtttcattgatgatacattagtagaatcatgtgatacttgggaggtttcacgatccttctcggtatcataaaacctgaaggtttcacgcatgatccctcgctaggtatatatcatcttgtgtgatacctgaaggtttcatacatgatacatcaaaagtatcattatgtgtgatacttatgatgtatcacatgatcctacttagatatcatgcatggtatcatggttcctgcgggtttcacgtatgatacttgaggatgattatgtgatacctaggaggtatcatgatcctcctcagtatcatggatggtattatcaggtttcaccgatgataccttaggaggatcatatgatacatgggaggtatcatgattctgctcagatatcatgtctggtatcatcaagtttcatagatgataccttagaaggatcatatgatacatgggaggtatcatgattcttctcagatatcatgtctggtatcatcaggttttatagatgataccttagaaggatcatgtgatacatgagatgtatcatgattctgctcaatatcatgactggtatcatggtttctgtgggtttcacagattataactaagtacgatcatgtgatacttgggaggtgccatgatcctcctcggtatcatggctggtatttactccacaaaaagtctacacccatgtaatacacttcatttgttcatatatggggaaatgatttttgcttccgtcaacttccagatcaaatatatgtacatggagtggacatggataagttcatatcatttgattcgatcgatgtatcgtctgacactgcttagagcaagaaaatgaagaacctcctgttgatggagaccgtcaaccaaagaaaacgcggtgggtgtcggcgtcggcgccaccaccacgctcannnnnnnnnnnnnnnnnnnnnnnnnnnnnnnnnnnnnnnnnnnnnnnnnnnnnnnnn

SEQ ID NO: 53453 - DNA, 1468 bp, Oryza sativa
  unsure (1)..(1468): unsure at all n locations
aataaattgatgcatagaatgcaaggtttgcacttaagatacatgccacttgaaagtttggacttagaaatatgccactccaaagtggaattattttgaaacatgccactacgaagctaaattggttgattaaattgcccctatgaccttcttcctctctttccatcatcccactccagaagttctctcgtccctctctccagcagggctggatgccggtgagatcctctcccctggccagcaggccgcagacctccctatgccctgtgactggccagccccaagcccctcattccccctccctccggtggcacattgattctgcaaaggaacttaccttgccagcttgcagcagcttggcaagaagagacctccaagccgaggcagccctcggtgcagacctccctgaggaagagctaggaggctcactggcggacccaggattttgccgagccctgggccaacactaattgctatcttgaagtgggctattggagtagctaggaatttttcgttggctagttcgacttcaaaagttcacatcactaatcaaaatttctaaacactgcaaatcccatatacaagtacaaatttgaataaaaggcgtcacagatataacaatagtatcttataacatcatagccaactaatttaacaagcaagttcaaaatgagcaatattaccaccagtgccggagggaggaaaaaaatttaggtgtggcctatgaattaccacgaaagttagcacagaacgaaaaatctcaatgcacgtcattatacgacacaatatcatctcaataagtctacattaagcatggcaaccaagaactactcacaagttcatgattcatcatccatttgcaaacaagtgtagatagaagaataggttctcagaaaatatctcatcttctcaagattcatgttttcaacaacacatcacatataggaactacagtactaagaatagatagatatatatgtggaatctacaaaacaactagtaccaaagattgattaatgttcacatatgtagaatctgttgatggagtgatggatacttggctagttggcttgcttgctgtcactgcttggtgctgcacgcctgcacagatgttgtgcccttcgtcccaccctgctcgcaggcccccctggtccctggcggctggtcgcgctgccgcctggttggagaggatgccgcagccgcagctttgcgccctggaggccggaagcctggcagccacgccctccacacctcacccagccctccagcgcgtggcgagcaccgcagcagccgccgtccactgatggggattggggaaggggattgatggattgggggagggtggaggagatgattcaagagacaaaacaagacaggccgcatttacactaaacaagcctaatgggnnnnnnnnnnnnnnnnnnnnnnnnnnnnnnnnnnnnnnnnnnnnnnnnnnnnnnnnnnnnnn

SEQ ID NO: 53454 - DNA, 1132 bp, Oryza sativa
  unsure (1)..(1132): unsure at all n locations
nnnnnnnnnnnnnnnnnnnnnnnnnnnnnnnnnnnnnnnnnnnnnnnnnnnnnnnnnnnnnnnnnnnaggaagttgcgtcattacttccaagcgcatcgggtttccgtagtgatgtcataccctcttggccaaattttgcacaaccgagagggtactggacgggtggtaaaatgggccatcgagctggctaagttcgatctgcacttcgaaccgcggcatgcgatcaacagtcaaatcctggctgacttcatcgcggaatggaccccggtggacgaacctgtcccatccaatgtccccttctcccccgtagaagaagagaatccaaacgccgacattcgcggcaggcacaggattatgcatttcgacggctccctcaaccttcaaggtgcaggtgccggagtcacgttgacctcgccaaacggggatgtcctcaaatacgtcgttcgtctcaacttccgagccacgaacaacatggcagaatatgaagggctccttgcaggattgagggcggcagccggaatggacatccgccgtctcctggtcttaggtgactcccagctggtcgtaaatcaagtatccaaagaatatcagtgcaccgacccacaaatggaagcatacgtctgcgaggtacggcgcatggaacgccacttcgatggacttgagctccagcacgtgccccgacgcgacaacacagttgctgacgagttgtcgcgtgttgcgtcggcacgagccccactccccccggggactttcaaagaaaggctcgcgcaaccatcggcgcgaccgagtcctttgaaggaccccaacgacgcgccctccgacccgacctctggcgacccgcgcccctcggggcccgagggggtcaaccccgacccccctcgtcaggttgtgtagatgaccgacatccgggcgtatctcaacggcaatactcttactgagaaacgcgtggaagctgaaaagctcgcgcgcatctccaagcggtacgtcctcgtagagggggccctctaccggcgtgccgcgaatgggatactcttgcagtgcatttctcgagagcagggcatcgagctcatagccgacgcccatcagggtgagtgnnnnnnnnnnnnnnnnnnnnnnnnnnnnnnnnnnnnn

SEQ ID NO: 53455 - DNA, 1111 bp, Oryza sativa
  unsure (1)..(1111): unsure at all n locations
cgactctggaggatcccccacttcctcatcaacaactttaaggatccaagagcaaatgtaagaagcgtaaagaatagggaaaaaatttggggataatctgaattcgatgtggcttctctccctacttggatttgaagaggaaagattcaaggtggctagcatcttctatggcgccgccggccgccggacctcctcctctcccacctctccccaccggcctctgtcggggagctcgacgtcgcgacgctcggttggagctctctttccctctctctgcgccgtcgcaagcggggtggagctcgacgccgtgacgctcggtccgccctcgggctcgaccccatcctcatcggcgctgaccccatcctcgtcggtgccacaccaagtcgccgccgcatcgcctgtcattggccaccagacgaggagcaaagtgagagagagaagaagggagagaagaggggaaagagattgtcctacgtggcatcctgacatgtgggacccacgtgggtccaatgctgactcagccgctatataggacaaatccggcatcaatattgccctgggacctcgggtgatcggttttgtattgttaagagaccccacatatctatttttacggttggaggacgattttgtaactcgatgacaagttgagggaccttcggtgtactttttcctaggcataaatggggaaagcgccaaataggtctaatgggccggcctggcttatcacggcccatttgacacgcgactgcacgcttaaactagtttgcatgtttagcatagtggaaacttgaaggtcttaatttatttattttttatttgtgttgacgtgatggcaggtaaacttgaaccatgcacgttttgatattcttttagttatccaagatccgcaatctgattgtggttagttcttccaatggagcagggacggcctagataatgacgtcatgcaggaacgactcaaatcaatcaggttgggcgatcatggttgcgtgcaacatgtctcaactttcagctatggcaagtattgcaacagattagtatatatannnnnnnnnnnnnnnnnnnnnnnnnnnnnnnnnnnnnnnnnnnnnnnnnnnnnnnnnnnnnn

SEQ ID NO: 53456 - DNA, 3890 bp, Oryza sativa
ctgaatcattgatctcctgctcagcatctttatttgaacacattaattccaattgtttagcaattttgtccatctcttccactgcaaactggaaagtttcattgcttttcgatccatttgatgctatttctgcacttttccttgacaaaatgttgaatctcaggattgagctctgtgctaaaggtatatttccattgccttttcccccaagacctttgtactctttttttgtccatctttcaataatatatttttctggtatcttcattgcattgaggtggagcattactttcaatacatggcagcatagaagtccatctttctcaaactttgagcaaatgcagttgaaatcctccttttccaagtccacaataacaaggtacttccttcttctgattacttgaatattttgattcaatgccaaaaaaaacttcataagttttgaacttctctacttcatttatttgaaatctagttgttcttttcaactcaacttgaaacttgatgaagattttgcgattatacattctcattgcttggtactcaatgtagtaatgggaccaaagtttgcttggtttctttgtccttgaaatgtgatcatcaaactgttccaagttttgaattgtatccattactctttcatactctatcatgaagtttgtaatgctgtactgtggaccaacattattcttaaaccttgagttagtcccttcactgagagctgtgctttttataaatggacagaaatcacccttgaaatacactggaataaatctttttctaattgaccacatgtgctttagaaaattgatatgctgaacttcaaagctgtcaatcatttcttgccataaatactcaaattcttcttctgtaactgagttatttatgatgtcttcatactcatcatacaacccttcttttgctttgaacaaatttccaaatagattgaaagctttctttacaatatgaaagaagcaatttatgtgctttgcattttgaaatacttgagcaattgctgatctcattgctccatcctgatcagtaatgattgtttttgggtcgttttgtgacatagctttcaaaaaagttctgaacagccatttaaatgtttctgaagtctcatcatgcaaaaatgcacaaccaaaaacaattgtgtttccatgtccagaaattccaacaaagggagcaaacgggaggttgtatctgttggtgaaatatgttgtgtcaaaactcacaacatcaccatatttctcataccactccctcgatctcccgtctgtccaaaacagatttttcactttcttgctctcatccaaatcaaactcataaaagaaatgtggatctttttcttttttccttctgaaaaattctaaagttttcatcatatcattgctgcttgtctccttgttaattgtggttctcacattgcttatatctttcttcgtataaggcaaagaagtcaatcctcctcttagaacagataaaatcacaatcatgtgccttgttggtatattacattccttcaaggtccttatgagcattttttcttctgtagtcatgtgtttgtgtgatttgagaaatctcacttcatctcttggacttagttgatgattgtggtctaattgtacccttgaaatattccaaatctcattcctctctgaaataaccagagcacacttgcaatctgttgcatcattttcatttgtatttctttccgaaaccactgtttcctctgcgcttactggtttggattgagaagttggtttgccttgtctattacatctgaacgttactgtcacgcccggaatttctatccaaaattccaaacgcttacatgtgtgtgaactctcgtccaggaatcagccgaggcacacaataacaaattgataatagagtacaattattactctaattaataagcgaataaaatgtcattacagaggtagatagttcctctcaatcaataaagatctaagcagcggaaaaaataagataaacggcgcagacgactccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcataatagggtttcattttgcaaaagcagcatttagcaaacatttgagaatttaataaaacagttaagtaataattaaacaatattaatccaacgctatacaacataccctgttgtataggcccaaccattctgaacaaccatcccagctgcacagttctatctccaaactaggaatataccattccaaaccaggagctaatcaaattattaccagttatagcatcttttattatgatgagaggtgtgagactaatcacgaaagacattgttagacccgcccataaccgcgggcacggctattcgaatagttttactctgatcagaggtgtaccaatgtacccacaagacacagccccacatcatgtcaccatgtgcctcaataccaccacggtacctcggaaaggagctgtgacaataccccttgcacaacacaatccactacagcgcacctttcctggatcataatcacccccttataaacaaggcatggactccccagcgacccccgtgggcttatctccgtcacttctcagtctggtgctccgcaatgaaccatgctatacaaaaggtaaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaaataatagtaaatcttaagttatcccaatagtgtgctaatgtttctaagcagggctaagcaattatatctaatacatctagttgaaccaatatatatatagcccaactagtcaagttataacaacccaaggtatcaaggaataaagtaatcaagaacaaaaagggctataacaaacaataggttaattccacccaatgacattcgaaaataaatgcaatagttgaatagaaacgatagctttaaacgggatcaacatgctcaaagggttgtttgggatctgtgtgacttgccttgctggccttggaactcttcaaactcttctcctgcgaaaacggactctccggaaacgacggaatctaagcagaaaagagcaaaatcaccaaaacagcacaaaaacaagcatgaacagtacatgtggatatttttaacatgtagatctcaaatttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcggctagggtttcgcggtggaccgggcgcacggcgacggttcacgggaacggacggccgagatcgatcttatccaaaacggacggccgagatcgaccgatccacggccggaccacgagagacgacgacgatgacgtcagcggtgacgtcaccacctgcggcggctcgggagcacaagctcgccggcgaacgatggcgcggcggcgcgaacggagggcaccaagacgtagagggcgacgcggcgaactcaccggcgaccaaaacggcggcggaagatcaacgaacggcgacggcgtcgaggaagaagcggcgtccacattcggttacagtaaataagtatttca

SEQ ID NO: 53457 - DNA, 2464 bp, Oryza sativa
  unsure (1)..(2464): unsure at all n locations
ccggcggtcttcaccgacggcgaaggggcgcacgaggacgggttcgcgacggcgaccacgatggcgacctccccgatcgacggagacgactggagcgacggcggagcacggctggagcggcggcgacaacggcggcgcgaggctacacggggctagggctctatcggcaacgacaggcgaaggcgagggtggcgacgggtagcggcgactccgggggtccttttaaaggggctaggaggcggcggcgaaggcccacgatgaccggcgacgctatggaaacttcggggttcggaggaaagagaccgatccgattcgacctcgaataaaacactttccaagccgatttagccgatgattccaaaagagaaaaggtagaggagatctcgggaaacatttcccctcaattgatttcaccgggaaaggaaaggatcggccgaatttgaaaggaaacggcggcggcgcggcgctagggtttcgggcggcggcggcgcgacgaagacgacgactccgacaggcgggacccacctgtcagctacagcgagggcgcgcgcgcggctgcggactgggccggcttgggccgaggagagagagagagaggatttgggccgactttcggcccaaagccaaaagaagactttttaaaacctttttcaatttaaattattcatgaaatgcaattccatttattaaaaatacttccttagctcaaataaatcccagaaaaatctaggaattatagaattaagcaaagtatttaatgaaattttatctggccccattttatgttggaatttattaattaaaattagatcttctcttcaaagatttttaaaatcatttctaaaaaattccatttaaacaacaatttatatattttgaatttttaggatgtgacaaacctaccccccttaaacagaatctcgtcctcgagattcgaaagaactggcgaacagatgcggatgagctgacttcaattcatctttctcgttcccaagttgattcttcttccgagtgattactccactggactttacaaaaacggataactcgattcctggttcttctctcatctatttccaagatacggattggtttctcaacataggtcagatcctcttggacttctatctgttcaagattagcttcttcggtaggtacccttaaacactttttcaattgcgacacatggaacacattatggacgcctgccaaattgaggtaattccaactgataagcaacctctcctcttctactgacaatcttataaggtcccacaaaacgcggtgccaattttcctttggtatgaaaacgatgaacccctcgaagaggcgtgacatgaaggtacacataatctcctgcgtcaaaacttagatctctccgacgattgtcggcataactcttatggcgagactgggccacacgcaatctttcttgaatgattttcaccttttcttctgcttccctcaagatatccgtcccgaaaacctgacgttctcccgtttgatcccacaaaagcggagtgcggcacttcgaccatacagtgcttcctaaggagccatctgaagactagcttgataactgttgttgtacgaaaattccgcataaggtagattcttatcccaacttccaccgaagtctaaagcacaagctctcaacatatcttccaaaatctgattcaccctttcggttgtccgtctgtctgcggatgataagcagtactaaagttcagcttagaacccatctctttcctgaagcttcnnnnnnnnnnnnnnnnnnnnnnnnnnnnnnnnnnnnnnnnnnnnacactattttcttagggacgccatgcaaacacacaatccttgccatatacaattccgccaaccgacttccagaatatgttgtctttactgggatgaaatgagccactttggtaagtctgtcgactatcacccaaatagagtcatgacctgatgacgttctgggtaaaccagtgatgaaatccataccgatttcctcccatttccattcaggaatcttcaaaggctgcaacaaaccggcgggtttctgatgttctgccttgattcgctgacaaacatcacatactgctacgtattctgcaatttcacgcttcatacttgcccaccaaaatctttccttgagatcctggtatattttggtactaccagggtgaatggagtataaagtatcatgggcttctttcagaattgcatcttttaaatctttgttgtcggggacgcagattctctcacccaaccatacagttccttgctcatctttcaagaaaccgatagcttttcctcttctcatattcttcttaatttcttgaatatcaggatcattaatttgggcttctctaacttgatcaattagagtgggcttcgcttctaaggctgaacgaaacctctacttgacaattccaaatttaatctttcaaattcctcgcattattcccatggtaac

SEQ ID NO: 53458 - DNA, 2715 bp, Oryza sativa
  unsure (1)..(2715): unsure at all n locations
nnnnnnnnnnnnnnnnnnnnnnnnnnnnnnnnnnnnnnnnnnnnnnnnnnnnnnnttccagaatatgttgtctttactgggatgaaatgagccactttggtaagtctgtcgactatcacccaaatagagtcatgacctgatgacgttctgggtaaaccagtgatgaaatccataccgatttcctcccatttccattcaggaatcttcaaaggctgcaacaaaccggcgggtttctgatgttctgccttgattcgctgacaaacatcacatactgctacgtattctgcaatttcacgcttcatacttgcccaccaaaatctttccttgagatcctggtatattttggtactaccagggtgaatggagtataaagtatcatgggcttctttcagaattgcatcttttaaatctttgttgtcggggacgcagattctctcacccaaccatacagttccttgctcatcttccaagaaaccgatagcttttcctcttctcatattcttcttaatttcttgaatatcaggatcattaatttgggcttctctaacttgatcaattagagtgggcttcgcttctaaggctgcaacgaaacctctactgacaattcccaaatttaatctttcaaattcctcgcataattccaatggtaactgtcatcctttctgctaagagcgtctgctacaacattagcctttccgcggtgataatgaattcccatgtcataatccttaattaattccaaccatctccgttgtctcatgttcaaatccggctgagtaaagatatactttaaactcttgtgatcggtatacacctctgtacgagtaccgaaaagataatgatgccaaattttcaacgcatgaactactgcagctaattcaagatcatgagtagggtagttcttctcatgcggacgtaactgacgagatgcataggcaaccaccttcccatcttgcatcagaacacaacctaaccccagtttggatgcatcgcaatacacttggaaacccttctttggatcaggtaaaatcaaaataggagctgatattaagcgattcttcaactcttgaaaactctgctcacattcttctgaccacttgtacttcacatctttctgaagcaatcgtgtcatgggcttagcaatcttggaaaaattttctataaacctccgataatatcccgcgaggcctaggaaactgcgaatctctgaaactgtctttggttgtttccagttggttacggattccacattactaggatcgacggcaactcctcctgctgagatgacgtgaccaaggaacttcacttcagacaaccaaaattcacacttactaaacttagcatacagttgatgttctcgtagcttttctagtgcaaggcgaagatgttctatatgctcttctttggttcgggagtagataagaatgtcatcaataaagaccaccacgaacttgtctaggtattccataaacaccttattcatcaagttcatgaagaaagcgggggcattggtaagtccaaaagacataacagtacattcaaacaatccatacctagtggtaaaagctgtcttaggtatatcttcctctttgattctcaactgatgataccctgatcgaagaactatcttggagaaaacggtggcacctttaagctgatcgaataaatcatcaattctgggcagcgggtacttattcttgatagtcatatcatttagtgcacgatagtccacacacatcctctgggtatggtctttcttttccacaaaaattactggagctccccatggagatgaactcggtctgatgtatcctttctgaagcaaatcgtctacttgccttttgacttctgccaactcattggctgccattctataaggtctcttatggatcggagttgttcctggtaccaaatctattctgaactctatatctcttttaggaggcataccaggtaaatcgtctgggaacacatcaggatactcccggactataggaatctcttccaaagttatttggttcagtcttgaccttaaagactcagaagacaatgcatgaattgttacaactcgaccatcatcactggtgagagttactttcctgttagcacagtctatcacacccttatatctggctaaccagtccatccctaggatgacatcaaggtctttggattctaacaggataagattggccagaaataatgatctgagaatttctattctgacagaggggctacgttgcaaagagagtgcttgattacttggggtattaaccatcaaaggacgtctaagatcttctacttccatcacatgatttcccgcaaaactcatagataagaatgaatgtgtagcaccagaatcaaaaagcactgttgcagggactaagttaacaaggaacgtacccaaaatcacatctggagcaccttgagcttctgtagcagcaacatgattgacacgggcctttggcgctggtgcggtagagttgctctgggcagggacagccttcacgcgtcggggcttcggacacttgtcagcataatgtcctgggtctccacagttgaaacacactacgggcttgctgccttgctccctcttggcaggctgttgctgtgttggagctgcaacagggcgtggagcttgattgcggatgttgttgccagcattgttgttgaagaactgacgctgcggacgaacaacagacgaagaacctccct

SEQ ID NO: 53459 - DNA, 1502 bp, Oryza sativa
caatcaccagcttcaacagaattagtggtactagagaaaataggcggcctcacacgaagaaattctgctaacttgttctgggaggtgcatggttatttccctggttctgctggttctgaagttgctgcatcatcatgttcataagttgtgtctgttgagccaggacttaggcaagtgtgggattctctccattgttgttgttgttgttattgttgttgttggggccattcccattgctgcgagtgagcaccatctggcatgggcaggagcataagaagagaaaccggggaaaactacttaggaccgagaattaatttaacttttattgatcttaagtgagtttcattattacaaaactgaagactctcacaccactaaacttaccaactacctaacactcgaaagcaaacaaacgcacgcacttacatcccaccactgatgtaaatcacatgcgagacacacacaaccaaacttaaacaagcaaactaacacaacgatctaagacaacggtttgacaaggcattctaggtcttccgggcatcgcagttgattgaaggctcgttcggctcgtcttcatcatcttgagttgctccccactcaatcttggaatgggtgcgctttgattcatctccttcatcatcacttacattgacgaccggaggatccgctagggctggggtaacttctttctccaccacacggacctttggcaccaattggtagcgagggacaaatagagctctcttccttgcggtaagacgaatcctggccttctgcggtggtgcttctcccttcaatgcggctagttccttctccaaacgatccactttgtcctcaagcttgcaaatcttaccacgattccggtcttcacgatcttgggctgctaacacagtctccgcacgggtttcatccatagcccacagcatctcaaccaaatgccttgtggtagcatcattctcaattccctcagtctcaaggtagctgccacggtcacttccctgtggttggcgaggatggtagcgatactcagtgtcggccaactgatcactgtagcgatcaaggagctctcctatggcgatccttgccacctcctgacatgtatggatgtagtttcttcctccggcttcgaacatcactgagggaatatcttcactattactgttcaaggtgactttgactcggcacttctcttcgtgacgatcatgaggaatttgggcatagaaaggggcagtcccaaatcctatggcaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagccaaacttgcaggataagttgaaacagttggaaacaaggtcacaaattttgtacttttgaacaaccggtttcaaaagaaat

SEQ ID NO: 53460 - DNA, 1099 bp, Oryza sativa
  unsure (1)..(1099): unsure at all n locations
nnnnnnnnnnnnnnnnnnnnnnnnnnnnnnnnnnnnnnnnnnnnnnnnnnnnnnnnnnnnnnnnaatggaaggatgaggagaaaagctgtatcagctaattttaaagatgatgacgatgatgaggtttttaccattttcctttgttcttattaattaatagttctcttgctctcacattcttttttttttcttgctctcttactcttaagttccctgtttagttttgttttgcccgatgtaatccatccaggaaacacatggctttgcatcactactccagaccaagaaatttgacataaaacactatgcagctgaataacattatgttagcacagctattggccattcctaagtcaccagttgtagttcatgtctcaacatcatttgaagtgtagaacaatgatattttttgaatacttatcatacataaatattaatgttaaatatttacgttaatatttaacactaaatatttacttacaatatctagtttgttttagcaccgtattaacataaatatttgcaatgtgtactttgatttctagtacaactcactaatattacttacagatacatatttggaatagttagaagaacacgttttattgtaacccttgacttctagcacagcttctattcgcctggtatacttccaaattacctcattgcgatgaaccatgaaccatgatgtggtactttgcttttaattcttttacatgtctacagattttcaatttcaagcttttaaaggtatttcaaccttggtctaccttgtagggtgcggaagaagatgacgttgacagtgaaaattctggtgatgaccagttatctgaaggttccgcagatgacagtgaagaatcacttgattcaggtactactttgcacacacgcacgcacttactcacttggtgtaacatcttttcgttgatggggagcaaatagagtcttgctactgttaatttagcatatacatgggatcccataggcaccacctatatctgtacccatcacctgtgatccactcgacctgcacataaaatcatgttgctattttatttgctgaagtagttagctctgcaactgaagagcatttggggt

SEQ ID NO: 53461 - DNA, 2783 bp, Oryza sativa
actgaaattagctaggtgcattgttaggtttcagatcatctttgttctttcttgtactacctccatttcaggttataagactttctagcgttgcccacattcacatagatgttaatgaatctaggcacatatatatgtctagattcattaacatatatatgaatgtgggcaatgctagaaagtcttataatatgaaacgaaggaagtaataatctgccttttaacttttttttacaaaggtgggtagactgcttggtagttaataagaccacagagccctcctagttttttttatctgaaataataaaggactgctttctatccttacagcaagcaaagaatgaatcaacaagctttgatgatatggatgctgaggattactccaagttttttaaaactgagctaagagattggtctgacgaagatctcatcaagagcattcgtgaccgtttcgtgactggaaattggtcaaaagcagctctaagaggacaggaaataaatgaaaacgatgtggatgacgaagaagtcgatggagattttgaagatctggagactggtgaggtgcatacaagcaaggcatatgaaaatacttcaggaaatggaggtactcacaagcaagatgaccttgctatgaagaaagaagactcaagaagctcgcacttaaggcaaaatttgatgcagaatatcctttcttacatttttgaatgttttttttcttttgtttgttgtcaaataatttgctatcatttaaaaggggaattgcttttatggtccactctgcactgcatgtttaattcttcttttgctgccccttagacttggttttttttgtctccgtggcctgttttcttttccaggttatctagtctaagttctcatttgcttttttgagcgtacttcactgcgtgcacttactttctgattccttaacttaaacctacatatgatggatctgatctctccggtgaggaagttgataatgacacaaagaaatcgaaacgagaagaaactaatggagggggctatttcgataaggtatgtcatagaatcttttgcttttgttttgttggaactcttgtattacctggttattgaaccatcacattttgtaccttttcagttaaaggaggaaattgaaattcgcaagcaaatgaatatttccgaactcaatgatttagatgaagataccagggtagaaattgaagggtttaggactggttcttacatcagattagaggtacatggtgtgccgtttgagctagttgaatattttgatccttgccatcccattctcgttggaggcattggccttggtgagcagaatactggatatatgcaggtcagctattttaattttcctctcctatttgctgtataaaaagttcagtgttcagtaattgtaggaaataatggatgcagcagtgcaacatacatgcatcgccattcagtgttagatcagacaatttttgcttgatagtttaagtggttatgacattctgggattttaaaatgatgcatcatataggagtacatccttacttctagctgtcaatatgtaatttaactatgaaataatgttcttgggcactccctccggttccatattaattgacgttttggacaaggttaaggtcaaacttttttaactttgaccatcaaactttaaaaatatttagtttaaaagaactagaacgacatatatagatttttcttttaaagcactataataaaagtgaacatgcatttatttattatatatattatagtagaaaaataaggtcaaagatatatcttgtagaccgtgtcattgtccgaaacgtcaattaaaatgaaaccggagggagtaccttgttgcttctaagctagatattcccatgtgaattggaaggaaaatttaaaaaacaatctctagaccacttatttggtggacccagaataaaacagtttatgtgtaacatattgataaaatataccaagtataacagtgtttctttgaacgttatgataattcaagtggatattatgttgccagtggattgcatttaccctttttcacactttatacaggctagcctgaaacgacacaggtggcacaggaaagtactgaagacaaaagacccaattattgtctctattggttggaggcgtttccaaacaactcctgtatatgcaatagaggatcgaaatggtcggcaccgcatgctcaaatatacacctgagcatatgcattgctttgctatgttttggggaccgcttgctccaccaaaaagtggtgtactggcagtccagcatctctccaacagtcaggtgggttcaataatttatattcatttgtccatatattttcagtgctgctgcttctgagcaaacatcataattgatggcgctgtcagactagcatcttttaggacttgcttagattcatctagatgcagaacctccctagaatggatattaaccttatcttccatttaccttgtagcattcacatttactctattaaagtgtttgcgctgacattctctttcccaatccttgcacatcaggtaccatttagaattactgcaacaggctttgttcaagaattcaacaatactgcccgaatcatgaagaaaatcaagctcacaggtgtaccgtgcaagatatttaagaaaactgccctagtcaaaggcatgttcacatctgacttagaggttgctaggtttgagggtgcaactattcggacagtaagtggaatccgagggcaagttaaaaaggtaatacatgagatcctatgctctttt

SEQ ID NO: 53462 - DNA, 2449 bp, Oryza sativa
acagttgccattttgccatgaaagcacccccccctctttgcagtatatgcatgttaccagaatggattttatttagtcaatgtgtgctcaagtaattattttgggtgttaggtcaaggaaaacgaaagctcgatatggatcataaactctgaagcgtatgtatcgataaatttgggtaattcaagtgtgcgcattaaaacaaatcttccttttattacaggcagcaaagattgaaccaggagatatgccaaggagaaaaggggaaagtatagacgggattgcaaggtgcacatttgaagacagaattcttatgagtgacattgtcttcatgcgtgcatgggtcaatgttgaagttcccacctactgtaaccttgtgacaactgctcttcaaccccaagatgagacttggcaaggcatgagaactactgctgagctgcggagggcacataatattcctataccgcacaacacagattcagtttataaggttctctgagcgtcgaaatcttttgtgtttatttttcttaatatcatgctcatatcatgttatctccaaatggcagcccattgagcggaaagtgcggaagtttaatcctatagagatccctgcaaaactgcagcatctacttccttttaaatctaaaccgaaggatacgcccaagcatagaaaaacaccagtggagaacagggtccctgtccttatgcagcccagtgagaagaagacacatgcagccattcaacagttaaggctgctaaaacatgagaaggtattggtcatgctacagcagcttgttctgatgtcaatcgctgatataatgtgtgctcattatttgcccgatttttccaggcaaaggaagaagaaattgcaggatgagaagaagaagaaagcatatgaggcggagaaagcaaagtctgaacttctaacgaagaaacggcagagagaggagaggcgtgtgaggtaccgagaggaagataagcaaaagaagcgagcccgcagataactgaaaatagtaagagaccttcaggcataatgagtcccagaaatctcctgaggcacatcatccagagcatatggttgcttcaaactagctcaagttgccgcctccagaaaaaagaggctcggattgacagcagacgaggtctgatgcctcggcatatcaagctggagatgcagaacaacttggtataatctgggccggattcaactagtagcgtcttttttatgtagctaaccagttttgctccaccatgctgctacgaaaattttgtcatccatgtaactgatgatttgtagctcccaggtgaagtgggagtgaatatgttaaattatcaatcttaggacataacagttgcccattttcaggcctatatatttctagagctaggggacactgagttgtcagcattggatttattggtactactgtatgacaaggacgtgattttgataaatttggttcccgttctgctcgcaactacatcctgtacagtttggcaacactacaaaagcagagaagaatttcttctgtgtagctaacagtaatggatcggagggtactggtagagatcatgtgtagttgtgctcctaatcctatcgctcatctgtcattttcgtccctttgggctaggagttccacggatgtcaaaagcgacccaactcggatacgagagacgggaaggtagtgacggtgcgtgtcacgcttcctaacgttcccaatgcatgttagtcggacccacgcggcggccactaccttcccctccgcgtcgatcggccgctttggacggccctgattacgcccatcccggaacattttagcggagctggtggagcccatctcctcgctggttggctagattcggctggctcacagctttgcattcggcagctaacgccacgcccactgactcgtgggcccgggatattggccccacctgtcacagactatcgcgcttgacaccactgtccacgcaataataaacggaactgtccacgttaccagcccgcattgaataacgctttgtcctaggtacgccgtgcgcggctgggcaacactcactgacacgaggcccccacccccaatagccctcaatagccctcgcacatgtacgcgaccgcgccgccgaggaaaagctttacaaaaattccaagctggaggaaaacccgcagccgagcgcacaccactgctagttgcacacaccgcgcggtgcgagctgtcgtccacagtccacacccaccaccgtcaccgcggtagcaaaccccccgagccactgctcacgtgggcccgtggcgtccccagacccaccggccagtgggcacgcggtagcgagacggctccagcacgacgcggtaagcgagcgagcacgagcagtagggcggagtaggtcgccgttgccgttgctggtggcctctcccacttaatgccgcggccgtaatcccgaagcctcacat

SEQ ID NO: 53463 - DNA, 1285 bp, Oryza sativa
  unsure (1)..(1285): unsure at all n locations
ttctttaaacaggcatggatcatagccaagtgcccacatgacctccaaccaacctcataaaattccatatatagacggcagaaaatatcaccacagcataaataaataaatgcatctatccaatagcttgctaataatacgagcacgggcactcaatgctatctaaattctacattttaagctaattgcactggactataacactgtattaatacagagcaacgctgttagcacagatttaaacacagtttacaatatccaatctgtatggcttgcatcagatgctcaaattaatattgttccaatttctccaatagaaaaccgagaaaatgagacttcatcgtgataagcaagatgtatatcttctggaacaagttggaaccgcgcagtatatccgcatgaacgaaaaacaggatcgccacgagctacatttaatcgccacctaaacgaaccaactcctacagctaccacccggatagcacactcgccagagcgtcaaaatcctaatccatggaagctcacagcctcacgccccccaccagacagaacccaacatgaagcccgttcacttgtccgtgcgcccgtgcgtgcgtaccttcgggttcttcctctcgccaccgtcatcgtcgccgccgccgcccttccccttccccttcttcttcctcgccttcgcgccggacttgtgctgccggtgcgccttgtgcggctgctctccccccccgtccgcgggggccatggagcgctagggttagcggcggagggcgtttgcgcgcggcgccgctgcggcgaagagagcggcggtggagaaagctagtggggaggaggaagcctggagggggaagaggccgagggttttggggagagggagagagaggcgccgcgtgtgatgggcccagcggggtaagcgctactatgggctgggccaagaaggccaaggccattttcacgtcacgagattctgacatgccacgtgtagcgcgcagggtcgcaccggccaccgcgccggaaagggaaaggcgtnccgcgtgcgcggcgcgtgcccgcctgcgacaaagccaccggcagttacgcctccgcgctcctccttcccaagagacgcagatctccaccccgcgctcgcctcgcttcccccaaaaagtcttctcgtgagagctttcccccccctcctccacccaacaaatccccagcctcccagattcgtggcggaggctgcggcctgcggctgttctagggttagctctcgctccgccggcatttctcggtattttttctaactagtcttgtt

SEQ ID NO: 53464 - DNA, 3124 bp, Oryza sativa
  unsure (1)..(3124): unsure at all n locations
cgccgggaatcgtttcgatcagctgagctgatatgatgtttgtggccaagtggtggttgagtggttgatctgcaggccccgggcggtaggcactaggctcgagtgtcaccgtgagtggagagctaatagctgcgcggtacagaatgaggccaaccggttgagacgataaggccaaccggctgcgtttccagagttgaacagatattttttcgcacgtatatattttaaactactaagcagtgtatttaaaaaaaatctttttatataaaagttgctttaaaaatcatactatctatttttgaagtttaaaatatttaatacttaaataattacgcaataatatcttatcttattttaagtatcttctcaatattatttattcctctctctcaaacacactaatatgagaagcattatagtaccatgtagactaggtttatgggtttaaaatttgagttttcagcaagacaagttgctttaaggatggttttgattttatattctagtccttaataccttttgttttagttatcatattttctcaatttgtgtggagattcaaaatttacaccgaacaccctagaatccagaaaaaaatacaaaaatctccatcccccctctctcccttatcctctcagcatctccctcaatctcgctaatcgctaccggcggtgactcccggctcccatctccttctgaccaatgctcctcatctcctcccccgaccggcggccctcctcccctggctggcatgcgcgtggagcatgttgaaggcgagatcgacggctcgggagtgggggatggcaagacttggcggcgcagatttgggacgagctagctcgagctcctctccctctccccctcatgtcttcctcacggccggggccctctcctcctcccccaaccgacgcctctcctatcctctcctctccaccccacctagtcgacgcgctgatgagttcaacggtgcggcacgggggaacaatgatgagctcagtagcgtttgtcgagggcagtagaatgagccgacaagcttctccagcccccaccgccttccccatcgagccgtgcgggcttctccagcgtagatcaaggtgggcggttagggcaccatcgacagcccaacaagctcccttcacctatccccaacctccatccctcaccaagaaaatctgcattcaccacctccactcccctgctggcacccatctcccttcaccactcgatggcgacagcgagatccacaagacggtgaccacgagctgtggatgggctgagggtttgagaaggccaccattgggctactgcggcggacgggtcgaggccaccgccaccttctcgagctcatactcatcgtccacggccgtgatgttgccgacgcaacccaagtgctccacgaccatgaggatgacgcccggtcaccctcctcccctagccaatgaggttggcggcgtggagcgcaggttggcgatgaggtccctatcctcccttctctagcggcaagggacatgagtgtaggccagacctgcaaattttgagcaagaacctatggctcatcttgtctccgcaatcttcatagggcaacgagaatggcagacgtggcacctatggctcatcttgtctccgcaatcttcatagggcaacgagaatggcagacgtggcatggaatctctgacctatcatgctgaggctgaacgacatctcagtgcattgtgaaagcaccaagagcaagttttatagtgaaggtgacaattacctttaattttagtcatatcatttactaggaataatcattgattaagagataacatgtacatcaatttacacaaatcccaataattttttgttggttcactctcataccatctcactttgctcttggaatttgagtagtggtgtctcatcctctctcttctcacttctccctttcacctcatcatctaatcttatatggtatttttagagtacttgctctaaattgatcggcgagcgttcacgatacagctggataagctcgatgtaattcaaggatctgagtgatcagcaatatgaattgtagaccccggtgagtttacctattggtagttatggatttattcttacttcttacagtacatactcttgttttttagttgtcggtcaatgtcgatccagaacccattttctcgagtaggtaaacctgcctgtgtccaagtgtttgcgaaaataggaattcttcaatcggataacacaaccacgagcaaaaagatttttttgcaggagaacgtgttatgctgcccatatgaaaaagaatttcggcgaaaaaaattccaaaaaccaaaccctagcccccaacccagaaaaccctagccacccccaccgccgccaccaaaaatacattgccgcacggtggtgtaggcgcccatgccgtcttcgagctcccctgcgccggatccaccatctttgaggtcatagtcatcggatccgcgtcgttgaggccgttgctgccacccgctcgtggtccctatcgttggatccgccgtcgatgaggtcaccgctagcaaaaagtcgttttttaagtagtcgatgcctcttaatatcatcttgacttgaggcaatgtaaataaaacatataggagtaacttccttcagctatgtaccttgctctaaataatgtcaggccttattcgttttgaaggattcttaaaggaaatctcaatccctttggaataagcactattcatgcattcggtttgtaggattcaaagaaaaattttccataggaacattatgccaatcctctaaaaaacctccaaaatgtactaattccataggaatgaaaacatccactccattctcttttgtttagctcattgtagaaaaaattcctgtgttctaatcctttattttacacgtgtatttctatattatttctacgtttttcctataccttgaacatataggccctcagtatgtgtgtctcttcaaaacaagttgcctgcctagctactaacgtttgcagcctaaaattggtcgccagtacagtgaccacttaagcccacgcaatatgtcagcttgttnnnnnnnnnnnnnnnnnnnnnnnnnnnnnnnnnnnnnnnnnnnnnnnnnnnnnnnnnnnnnnnnn

SEQ ID NO: 53465 - DNA, 2661 bp, Oryza sativa
  unsure (1)..(2661): unsure at all n locations
nnnnnnnnnnnnnnnnnnnnnnnnnnnnnnnnnnnnnnnnnncttcagcaattgatgagcaattagttaagactagtatatatctctgaatgttgtatattcttctatttcctctgtgcatatagcaatagagcttggttgtagctagcttcacccacctagttgtttttctctccattttgttatgtaattgatgccaattatcttaaagaagaagatccattcaattgccagtagtttctttgtggttgcaagtttttttcttcgtcaacacaagaagttaaaatatccttgctacataaagttgtcaaccagtgcaatataatctcccaaaagtctgattgtttggtactcttgacaccttaaattaacatgcagagctcctaccaaattttcttttttaaaaaatggtttgatgccaattataacaagtcatcaaattccttcttttaatatatatatacgcacatgttgcgatatgagtggtgtaattaagaaaatggtgtgtatcaataccatcgacatattgtatcgatatcactatatctaagcaagctactatagtagtttacaaatccgaatgcctccctaagaagatgaatctacacaagaaggagattgtgcaaacccgttttcggcgattcttgtgtagaatccccaaagatgaatctacacaagaatccgaatgcatcgagcaacactatgggcccagcctctacacattttattgacataaaagcttctacacatcgaggataggattgtagtttcttcttgcaaagaaatcctctcttcctcccttctatccatatgatttgttcatgtaaagaattctgtacttgattatctttcaaccaaaattcaggtggggaaacccttaatttcttaaagaagaaaacccgaatatcctataaatcctagctctaccactggttgggcctcaagccagcccatttgtcacccagcatcgcggtctaatttatatggcccagaaccgtgacattgattttgactgttgacatttttacacctatccatttgtgctttgttttggacgtctatgaaatgcaccgtttgaaaattctacaagatgacttgttggcattgaaagaggccaatagtgatatggtgatgttgtataccattgcttgtcatgttgatacaagagaatatagggctgtctatttatgaccttcgaactaatgtcagtaaaaacgaggccataacttctctaatacattactgcacatttgttgcacccaactgtttttttggtcatggccatttgacaaatcctcatatgccagagtatacaggcatttagccaatttatgggaagagctcacatatggaaaaatcaggtgaaaccggtatgttagtaatagtaaattagtaatacacaaccaaagctcttataagcatgcttaaaatagcttatagaggagtatttttttcacaaaaaaaaaacggaactcatattttgtgacacatagaagataaagtattttaggacccttgtcgcatttccaagatggactgtgaacttccttcctttcctttgtactctctgtgaatttgtcatcttaactcctaagttatcactctcgcattgcttattatccataatctgctataccagaatagcaagctttaatgtcctacaagataatggcgttgcattgcctctattgtccaatcaacaattccatggcaagaatgcattaaaataataggcatagatgggctaccagctggagtagttacatcttttcctttatattgtatatcatggaacataaactctactgttgtgtggtactattgccattgtggcccttagaagaagaggtgaagagatgtctggaaaagggaagaggcgaagtgctagattactgaagcttgaagagcagaagaacgatgacactactgccactggttgtctcctagatccttggcagataatccgaaacagcattgctggtgttcgagggaagagaaaaaggaatgaagaaatccaggtaattgtctgtctaggtagtcattaggtaccctgatgaactctcatcacccttgccgttctcatctcatcttgatctgtatgttctttcagcatttgcagggagaagcttcttctagccaagcactgtgtgcaacaaccgatatcagtaagaatatttgtttctttttgttgtctcgatgtggtgttgcttgtgcaaatctgaatttctgtaagagagagagaaagcagcatatctgaattctgccgcttcgtctttcagataatttgtcaagcaaaagttcagcagtacaaatcattgagtacattcttgatacactagagatgtaagtttgaactatcgtgttcttttggcttccacatcaatcggagcacagattttgtatgatgactgatgttaaggatatatatatatgcttatattatcttatcttttcctctgttgcaggagagacactcatgagttatttgcaatgcctgatgacatccaagtaagccatggaggaatatatcaaaaaatatttaagttcatgttaaagaatgataatacgctggttgttctctcatgaaaaaaaacattaacaaatcacttatttcttggtttcatgtgctgatgtactatgtgttattatcttatagaaagg

SEQ ID NO: 53466 - DNA, 740 bp, Oryza sativa
cagtttagttcctttctgttcatggctatgcggttgtctgtcttcgctatgaaaaattgcaaacgagaaagccaagtaacagttgacatccataggtccaacactaggacaaacaaatggagcaacaatgcggcaccgcagagatcagcaataccaggggcaaacattaaatcggggacaccaaaaggttccaatttgacaaaacaacattgtatagcaaccatccaatcaatgcaatacatcaaatccaaatggtcaactttcttcaagatgcatggtcattgttcagtgcattaaacatctgttggaataccaaaaattttcagtttctgtagaataaatatggtcagtacaccccacatggtcaggaaggcctcttgtgtgtataacactataactggggaacaagagcttctgctgcccctgaaaaattgacaggggaggaagaaaaactggtagtgacacgagcacactaccaagaactgaacagaggttccatatctctgttgaattcagtgcatccatcgtatacatcctcacaatcttagcgagataactgtgtgagcagaatcaaaacaggaagactcctctttccaagaaatacagatctcaagctgcttgatggcattaatggagaattacttctggttcaccaaatcagcaccactgacatacctagcaacgaatgaaatcaaccggaatggagcaccgacgattggagcatcagaaaatggaacctc

SEQ ID NO: 53467 - DNA, 1024 bp, Oryza sativa
acagggtcttatcataacaatttgaagcaaaaacgcttgaggaggcattggcttctaacccggtcgacttgaaatttgacaagcctgagaaatggacagctccataccccaagtatgagtatggatggtgggagccctttctacctccaaagtctaacaatggaacagcatagagatgatcggcaatccatatgagcaatgtaagatttcttccatgcaagtgcccaaatgtaatctaaatttttaacaatgcctatgtaatacttggggtgctgtgagtacagttagctacaatagttgcagagttgctgtactttctggtaataccagataagcagtggttttgttttgaaagattgtggacggctgtggttggggtataattttcttcatgatgcacattgctgtctatgttgtaaattttatcacgggaaaaatgcagtcttccaggtcctatataatttctgaaccaccaccatgtgcatcaatagtgtgcacatgatttccattctgcagaaacagccaccaagcaaacaacttggtgttgtcaatgattacagaaaagactcgagggccttgaaggtctctctctattagtcatatataatcataacatttcgtaatccaacataatcataattttcattatcccaagacatcagtaccactaactatatactattaaagcttagggtgtgtttgattctttgggtgtaaagttttgaagtataccgacgcatatttgaggtattaaacgtaaactaataacaaaacaaattacagattccgcatgtaaactgcaaaacgaatttattaagcctaattaatccgttattagctaatgtttattatagcatcacattgtcaaatcatatcgtgacaacgtctcgtaatttacatgcaaactgtacaattaattttttttccacatttaatgtcccatgtatgtgtccaaacgtttgatgtgatgttttttgccaatttttttttatctaaacaaggccatattgacatgtgttcattt

SEQ ID NO: 53468 - DNA, 1054 bp, Oryza sativa
aaaaaaacattccaccagtaaccaagcacacgcttattacaattttaattaacaaaaagaccattgttctgatataggtcacattgttcttcttacatacagaaagcttattggattaggaggaacccaatgacacagatgcgcacaagacctatctggctacatgcctagattagtgaagggtaaaaccaagagttcaaccaaccagtactgaaattacagtcatcattacctgcattatgaccaacatacaacaaacactgaatcagtattgactgaaacaatccaagggtaatgttatagctcctagatcaatcttcagatgcttcagaatctgcaaatcaatggagtacattacttgaaggcatataaaaacttggtttaaagccaaacatgtataataagaaagcaatgcgtaatcatataaagtgtagagcatgcaaacatgctgatgcaagttcctattaacatgtggtaggtattcataagcagacgttaggttggcctagcaatcttcatgtgcttaaacgtacactactgtactaatgaaagaacaagaagataatggtccatgtgagaactctatgcctccttggatttaaaagagttatctattagatttcaaacaattaagcttttggaatgaagggaactcaaaatagaaaggaggaaaaaaaggagaaatgccttctcaaattctgatggaaaaacacgagtactttaaaagagaggtttggatgtaatagggggaggggggggatgttgattttcaagaaaggggatgaaaacatgaagttgacctcatggattttttttttccaaaataaatatggattagtctgttagataattcctttaaagtaatctgtaatgtctaatcctttgttccaaaggcctccatagatattatattcctgtagtaggatcatagaacaagcttcccatgttctctataaccctgtttagtgctaatgattttccccttggttagaatattgataggttttctgtgaaatttctatgttttaaacctgtccacaatattttcaataga

SEQ ID NO: 53469 - DNA, 1201 bp, Oryza sativa
  unsure (1)..(1201): unsure at all n locations
nnnnnnnnnnnnnnnnnnnnnnnnnnnnnnnnnnnnnnnnnnnnnnnnnnnnnnnnnnnnnnnnnnnnnnnnnnntatttctcggcctatagtatagaatggaatcctctgtggcctgagagacactcatgagatatgtgcgttgcctgctgacatccaggtatgccatggaggaacatatcaaatgatggccgagacctgtaacggattgaaaatacgctgtttgatctctcatgaaaacccgcattatcaacgcacttatttcttggtttaatgtgctgatgtactatgtgttattatcttatagaaagataatttaacatgttaacgcaggtaactgattatgcagaacgggtgaacaggcccggtgactttgcaacattaaggcagaagaacaaggatggcatgtacaacacactggagcaattcgaggtccacctcgttgctcatttcccaaatcatcctctcttctgaacatataaagctgaatattatcagttttatcggcttcctgaaattcatatgcaactgcagaatgatgtttacatggtgttccagaaagcaatgtccataaacagcgaggacactataccttacagagaggtcggttgtatcaaaacttagatagtacggagtatatcacaatcacatcatagatgtatcatgtatcaaaactttgatgataataagctcactaattcgcatggacgttttctttgtttcctctcttttgcaggcaatgtcactgctacatcaagccaagcaggtattcctgtccctgaagagcaaccagatgtactcggagtcagagctcgcagcgtggcgccagaaaaatctggtgagccagtcgccggccaagctaaacgggaaattcgatggcagcaaagtaggctccggctccggcgccggcggcgccgctccgaccacaccacagcggccgagcgcgccggcgaggaagaagatcgccgccaaaaccggcgctgtcgccgccgccacctcggttaagagcacaacgaggcagcgggcagcgagggagagcaacggtgcgccgggaagaagagcaagaaaaggtaagcgagctgttcattgagtgtttcatccgccgtgatgtgatcgagacgccttacatttggagctgcagctgcatcggtgacgccggggacggcggagcacggtggcgccggcgccagcgccaccgtgg

SEQ ID NO: 53470 - DNA, 2957 bp, Oryza sativa
ctcaagctcctcgtgctgatcggcaggccggcgttcatggagagagccaggagagtgctcggccatgagcgccaggagagcagctcaaagcagggacacgatcagaaaccagctgtgaccagagccggtgacgacgacggcggcgcgaaggccggcgtaacggcggccaagccagggaagaagaagggcagtgccagcaagccagccgccgtcgagttcgggccattcgcgccgcccaagctggtcatccccggccggcagctgggcttcagccagttcgccggctcgtcctcccaaccgttcaaagtgacgcctaccactccaaatgttcctgacaagaagaagaagaaacgaggttgaaccaaacaagctgcagcttgctgctccaaccacatcagcttattaccaattctttagtcctgttgggaagaatggcacaataatcttgattcacttcacccttattatgcgtttatatgtaaactggaggatgactactacctctcgttttcgacttttcaaagttaaacaagaccaactccaaaattcatacgtagctcatgtagtacagtgatagacaagaccagcattaacatgcacatctgatgatgtctccttgaacattaacatggagcttatttatagcttaaaactcttcctaacaccatcgctcttaaagcgttgcacggcagtaagccccacctacagggtaagctttctgcattagctaacctcgagagaccggaccatcagacgaagagtaacagttgcatcggtattaacttttccagttatccttggtcttcctaacttctcgcagggcctcaactggcgacttggcaccaaactttgcctgcaagatcgatggcattatctgcataagcatcaccggcaaaggaactatcttcgaaattaagaattgatagttgttgattcttgtcagtaagaccgcaagtttctaaacaatattagctttatcttgctgtcaacctccatggacgcaaagatttttccaacacagccacaaagaaacatagcatcatgttgaacagatgtaactaataagtggattagaacctgtatttctggcagatcaacacgcatgaaggtgtttgtctcaaattcctctcctatagttgatggaatagttggttggtttgcttcacgctgcttttgagcccattctagtttctgcttcactttttcgttatctggctcgaccgtcagtatgaatttcaggttcttcacagtgtactgtaagtcataataagactagtaagaataaagtatggctgttaccttttttttttcttttgaatgacaagaaccataccatgataagtagaagtacataacaaagggcaaccaaaaatttcgttggttgcacacataaactaatggcaatcacgttatcctccatttatgaagaactgacagcatgaacttatttttccttaatgcagaaggccagaccacattcttttttttgccagaaaagaacacgttagttattatccttcagttaaggctgcacatactagcctcatctagtttgtaatctagattcaaagcttccagcatctttaataatggaggtttatggacaggtccaaattaaagtaagaaaatagcatggaacatgaagtagaagccaaagggataaaacatcagttgtcaacacaaatcacgaggaagaaggaaaaaaataaggcaaggcacacagcatacatatcctacatatttcactacagattcacatccctcaaaaatggaggaagagcaaagaagcaaatgggggaaatagaaaatgtacctcatgcccgcagtaaacttgagttggcttaggcagcgagcccagtgttacacaaagggattggtacatttgctctgcagtgccctcaaaaaatctcccacaaccagcaatgaactataccaaaaaggaaggtcgatatgttaaatagaaaaggagccatcactgtaagtcagatgcatatactaaccaaggtgtctccagtaaacactgctggatcttcctcctctttactagtgacgtaatagctgatatgtccttttgtgtggctgttagaagaagggaaatgaaaggactatgagatttaagtaatcaacaagctgttacagaaacatataaaaggttgactagactgtacaaccaatgcactacagcaatattgtttaagtctttgtgctatcaactatcgcttagttgcatgcgaagtccttgaacataaatgtttcataaacttctcaattggcaaatctgcaggatgggttattatagtgagtacaagtggaaacatgttggatttgcctatctgttattgtagaggtttaaatcctgatcttcagtgcttctatgattccatcgaagtaatcacactgatgataccataaatgaaatgtgacttataaagaaaacagcataccacggtgtgtgcaggcatagtatctcaatgtccttcccaagggacaatttggttccattctccacctgatcagtgcatcctttcacattgtccagggatcctccatagaccttaatccctggcactgactgcgccatcttttcattgccaccagcatgatccctacaaccacaaccacggattagttgggcttttcaattaccacttctctacatcgttgtaatgaattcagcaaaatctggcaaataatattctatgcatagaatgcacctgagagtaatcctaaaaaaaatcaatccttttaatgtatttgtgtttattttatcatatggtgcaaagcacttcctcagccgcatgctcagacaccgtatttctcaatttattataaaatcctaatgcaataaatcccaatctgcaactaactaaaatcactcactttctggtggtaggtgattggtccctgagggtgggattggggaaaattttggcacagcactgattgcatcccatagg

SEQ ID NO: 53471 - DNA, 1629 bp, Oryza sativa
  unsure (1)..(1629): unsure at all n locations
nnnnnnnnnnnnnnnnnnnnnnnnnnnnnnnnnnnnnnnnnnnnnnnnnnnnnnnnnnnnnnnnntctggatctcatccaggagctgctcatccatcaccaccactaataacaaaacttactagtagcacataagataatttgctactatattccccttccagtcctctacaatcaactacctactcttgcatacccaaaatccaaaatctctcaatcctcaatccaaatcccaaactacgtaccaagctcgtctcgttagctagtggaagaaggctaattaatcaataagcttagcatattggaggaatcaggaggaaggcaagttggctatcgagtgaatggaagagaagaagaaaaaggcaagctaagccatgaaaaataaagaaatctaattcaatggagctagccaggaggtatttgaggatcagtcgggaagctatctctttgcccaaatcaccgttgccaccgcccacatcgactctgacaactccgcgcgacgtgtgctccaggtgcctcgtccatgcgtgcgctcatatgtctcattgtgcgaggatatcggtacataacatttccttttttaaaagtaattacactataattgggatgtaatttatattaaacttatatataattgatagcatagtgcgtgtggctggttggctagctagcggatgatcttcttttcgagctatttttgttatgtgaagcatattccaaacgaaaattgcgaaaaatatagagaagttattcatatttacaataacaatgacacacactgctattcttttttttcgagataatcacataaagagggtcatataaatattattaagattgagaaaaaaaattaaaaaaagaaaatactannnnnnnnnnnnnnnnnnnnnnnnnnnnnnnnnnnnataccatgcatgaaccctacaaacatatgcaagatagtgaagcctagcaccaaacaataaccactatacgtgaccgttcgtcgctaagcggagactcccaaaagaaaggcttggttcagtctgtcgaatatatggattacaataagcataacttgaaatgttgatgatatgctagctgcagcgcatacccatggtggcaatggtgcaagaagtactaataatgaactagccctttttttcacacgaagaataattcaccaatctttatttattcgcatgcagagttaatttacagcacgaaccgtgctaccaaagaccaacaaggcttactgcacacagtcaccgtcatttattccactaccataatatatacacatgacatgtcactcttttaacagagctcgatcagacactgcagcctgcaaccacctccaatgagatggacagtgaaagcactcctcatgcgtctgagcctgcaacggagggtgggaagacccctctcccgggctggcgatcagcaaccgatccgtgccgagttagcaactacatgcagcgaaacatcacatccattatattagcatttttttagaaaaaatattattttaataaaaacttgtaaaaccacaaatttagcaccatgtcgaacacatgacacatggtgtaaggtagggttgttgtgcagtaaaannnnnnnnnnnnnnnnnnnnnnnnnnnnnnnnnnnnnn

SEQ ID NO: 53472 - DNA, 707 bp, Oryza sativa
gggaagtcgtccgcgctccgctttttctgcccgacgtcgaagatgcggatcttcgggtcgggcacgccgcggcagtagcgcgacttcgggtacggcttgttcttgatctgacggtagcaccgcactggccctgcacgcacgatatcgatcgatcgatcacgtcctcgatcgcgttgtcattcaagaaaaccaggtaacaacgccatgcacggcaacggccggcaacagctacgatatgatgtctgtgccgtggtaagttggttggttcggttgttgcttactcctccccatggcgatcgatcggcggcgaaaagtgtggagtcgcgggtgctggtgatcaggaagggtccaggtgcgtgtgtgattttgaagagatcatgcggaggccaggtggttgatgtgcgtatgtatatagatagacaaagaggagggcaggtgagtgcgcgaatgttctggttttgccggtcgggaagacgggaaggcgtggcggcgagaggccaatagacgcagcttgcgtttggactcgacgtacgcggacgcctcggcagcaggtgggtgggccgacctgtgagttgggctgagagggcgtgagttgggctttcaccgagtcgtactcttcgtgggcaagcgagaaacggccgcagcattctcaggacggaacgagagtactcatctatgacgggtaccgagctcgaattcgccctata

SEQ ID NO: 53473 - DNA, 1580 bp, Oryza sativa
tttttttaataagacgagtagtcaaccagtataagcaaaatgtcaaaatccattatattataagacggaaggagtagtatggaattatattatcgtagacacgtaaaagtcaaatggtccagaaaaacgtcttgatcgaattctacacctgcgtacgataaattaaggcacgtagtactactaggacgtattactgggagcatgtttagatgggactaaaacttttttaagtccctaccacatcgaatgtttggatactaataataaatattaaacgtagactattaataaaacctatttataatcttggactaattcacgagacgaatctattgagcctaattaatctatgattagcctatgtaatgctacattaaacattctctaattatagattaattaggcttaaaaaatttgtctcgtgaattagctttcatttatataattagttttataagtagtctatatttaatactctaaattaatatctaaatatagatactaaagttaagtccctgatccaaacacatctatattagtctagtctagtacggcaaggagaccggaaaagaaggcaagcggttatacctacactacacatgtgcgaaccaaactgaacacgcaacgtgggggagagggctcaccgcgtacaaaccgcgttcgtatggcggtggtttgccgttaaccaaccagacaccgcatctgcgcgtatgcatcaccaacgagagcgttatgtgtatctttggtgtaccgaagagcctattgtacttgaccaacttgcgttagttgacgcgggcacacgccgcacgcgacgcggcgcaacgcagcgcacggcggtgttgcctgcgaaacgcgagaaaacgcggcgttattcagttagcggtgagcggtgcgggcatcatgtacactcccgtctcccggtgtggacctcgcttgggggctctggcaggcatgtgaaaacacagcgtgacataaaaatctgaaagttggtggtgaccatgaaattcgagtcgctttcctctctcagatcggtcgggaaaattgttgggttgcggattattcagtgatgtgtgtgcccccacttcgcatggatcattgtacaccacagggagctcatcattgactgccttgggtgactgacattgttttcgagaaaacagcgtgtaggaaaacaaggaaatgatattggaatttgaagaaattcgagaaattacttttctcagtgttctcacagtaacgggggagagtcaggcagagaactctcaccgtttcttccagcgttcgagaaattattgctagtgtgcgacgtaaagaaaatgatgttggacattttatacaagtgctagtgcatttctttgggtagcatttcatttagattttgtggattaatttggtaactttctctggtttatgtgtgttacgtattaaacggaagagcgcagcgtgtgattacctagggtattgctgtcttttatgtcccggaaaaaaaaactcaactatcatccatgtggtcactttatgattaggctgaacgcctgattatcttactactactgtcagccagtcagcgttgttggaat

SEQ ID NO: 53474 - DNA, 1011 bp, Oryza sativa
  unsure (1)..(1011): unsure at all n locations
nnnnnnnnnnnnnnnnnnnnnnnnnnnnnnnnnnnnnnnnnnnnnnnnnnnnnnnnttgattcttgcaaatgcattggcgatactaaatgaagaccgctttcttgcacccagaggatggagcatgtctgaagtctcaggaaatggacgatcaaagtcattgaagggtcagattgtaggactcatatatgccacacagttctttaggatgccgttgatagcacttaatgttcttatcattgttgtgaagttggtgtcaggctgatactatgaaggtttcagttgttgggcttgattgatttcaatttcaatgtgatgtaaaagtattcacgctaaatatttctgcagctatattaatttgtctatatatgtgccttgttattgttctagtaaattaattctaagcagcaaattgtttctttggcacgtataccatcagagtatgtttgcctgccaatctgctgcgagggttcccttttccttatttctgttctgaatcaaccacacatttattttcttattggtgtgtgttgtgctcggtgttgtttgatattcagatactgcttaaacggaaggtcctcctaggctcctatggtcttacctcatgtcagctggtgataaactggcccttcgtctggtccagccttagctgagtactagaaaatcggcgcgctggataatttatcctgtgagtttttcccctagggcacatgcatagtttctagagtaattactttaatactgataaaatctatgtaaatatcatatattcaaaaatatcattcaatgtgtacttagttttatgtttgtataatacctacgaagaattatagcatgacagtatacgcaaacaaacggtgcatttagtctcacgtttgtaattttaaaattttgtatataagctgttagaattagtaaaattaaaataaaatattttttatttcttgctatcttaaaaaattgtttaaccttttctataatatacttcctccgtttcacaatataagtcattt

SEQ ID NO: 53475 - DNA, 3472 bp, Oryza sativa
  unsure (1)..(3472): unsure at all n locations
tgcagactataccatactttctctttttgagaaatatatgatgtgttagcttttaaaatggcattgacaccaaaatttgatcatcaatattcattctcattatattattattgactataaaactaatactaatttaatgccacaaataattgtatatgagaccaatatggtttgatttatttttttccaagcctgtcatatatgctacaatactcacatgtatgggttcagctaacaggtcagtgatagctaactcggccagcacaggtgcacagcacgggccaatgtagctaggccagctgggatgattgatttttttttatagaacggggatgagagattaatgagagtgtttggcctagatagcagggacgtgaggtgagacgacatccagaagctgctgttatttttgttttctgccgcacgaagacagcaatacatgcgcgagacactcgatcgtttgccgaatgcttcatggacacgtggcgtaaaactgaatgggggtaaacgaaccaatcagcttgctggagaactatttttatccatcttttatcaattgtatacatgtttcctggagaactatttttatcccaacctattatgctgtgtagtatatggtcattcttagttggctttaacattgtgcaatgctatcactgactttttgttattaatccatcatggacttgttaacttttagatgatatccactggaggaaaatggaattttctgttgaaaactgacgagtactcagagcatgttcatcatgcaggtatgctgcgaacctcgttcttgacaaacaatttcgggttcttcacttatttgacatgcatttacctttaatgtttccagtatatgttgccttttggtactcacaacataaccatatgatgttgacataaaccatttgtccattgacatcttccctatagttaaacacatttaagctaagttctgaaacatgccatgagtacgatcaagcctaaatagtatggagctgtatatgtacttttttttttcaagatgcattcatcatattacaattttctctccatcgacctggatagacactgtcattattatgtccaaatcaccaccctattagtgtctatatgcaccttgcactctcgttaaactgaggtccacaccaaattctggttccacaatgagtttcagtgttggagaatgctcatagtttggcgagagcttcaatacaaacttggagatgatgagggaaattagggttttgagttcagccatagcaaagccctgaccaaggcaagttcgagcaccagcgccaaatggcaagtaggaatgtagctggggttgtgcattggagaagcgctctgggttgaattctttcacatctggaccccacaggttgggatcaaggtgcattgtggaaacagggatgtagatgttgacaccttttggtatatgtacacccccaaacttcagttcctgaagggcctgccttgatacaaaggcgccagctgggtacaaacgcaaagtctcctggatcaccattgtcaactacaagcagagaggacctggaagttagtgagctattgtaacaaatgtacaatttactgcaaagtgcactaatggactgctcatagtcaagtcttgttttgttttgcaagattaaaaagatgcatttctttaattgactgaatggaagatgcagaaaaggaaaggagcatatacattcttcattttctgaagggactgagagtctactggctggcctgcacagacctcctgcacttcttcccgtaccctatcctgccactctggatgtagtccaaggagcattagacaccaggcagctgtgacagctgtgctctcatatcctgcaaaatatatactcttgcagttatccactataaagttctctgcctcagcgagctccaccttactgctgcttgcactaagaagaattgcacgtagtaagttcctttcttctccgctttccttcacaatttctagtattagtttgtgcacttgtttgtgaagctcccacgcttgcttgttcctctttatgggaaaaaacctacaacattcaaaattttatctcttgcaactgaattgaaatgggagtttcaacatgttgtctggaactgacaaaagttttaatttatactcttgcactaaagaaatgacatacttggttgctaaccttaggccagtcatttcagctagtacatttggcttggacacagccttttgtagttctctgatctttaaaaatatattctttcctttgatgtagctgcttccaaagcatgttctagagataacgtctgcagagtaagcccttatgtcatcatcaatctttatgtctatggtcccgccatttttgtctattccttcttcccatgacttaagcagtgtttgcgcagaatctaccatcagatccaccatgccctaagtatgtgaaaaaaacaaagaatcaggcaggcaagtaacactcattgttgtcttctgtctagctgtatgcttgttcttaaatctttgaattctaatttactgatgacaataggagaagaataaaaaacccttatgtaagtgtgataaatagctcatcagaatgatccaatgttactgaaagtggtcctaactagagtggggtatagcacgttatctctctagcttgcatgcctgcaggtcgactctcgtgaatccccctaatcagaaattttaatgctcgtaacacattatctagctggatcagactgtagtagtcactctgctccaggctctcttacgttgaactgtaattctaaattgcgtttgctaagcgggaacatgtagatccacatatttatttctccctgaaactatgaggatagctttgaatgcctacttgctggggcctaaggttttcctccgatgccttcaaatctttgttagcaacccaagtctatttgaacatatatctcactgtcagttcttttttggtggctatagtgggagtgacatttcagagtcattctgggcctcaacctcaagagtttcagtttgccataataatttttatttgcatgtatgatagttggatactaactggatattggaacagtgcgatatattgcacataccttgaccttgtccaggaagaactcacgggcaatgatctttctctggtgtgcccacgcctctccgttggatttgaggatgcccccaccgaacaggggctcgtgcgtcgccttgaggtaggagctcttgcccaggtccagcgacacgcagaggttgatgtcccgaaccacgtcaggccggctcacgtgaaggaacacgacgttccccatggagtaagtgaatattggacctgcaattgatcgtaaagttaaacggttaagatcatatatgaataaaaatcgtaagataaaaaattagattcaatcgtannnnnnnnnnnnnnnnnnnnnnnnnnnnnnnnnnnnnnnnnnnnnnnnnnnnnnnnnnnnnnnn

SEQ ID NO: 53476 - DNA, 1786 bp, Oryza sativa
gaaatttcatagaattaaatagggtaaaatcatttgtttcaaaggagcatgtatgaaaaaatctgtaggattgcaatcatgcaaaatttctattcatattctaaagtaccggtttcggcatacactctccagtgctagctaactgaccaatgacagtgtaacatgtcggagctatcttgatcacaaagaatccagtccagaaatgccacgcacgcatccgcttgtccaaatcaatccaacatggaaacggaggaacatttgggaccatcaatttggtagtatcatgcctggctcgagagcgctgcccctatcggaaagcatcagctggatgccctgccgggaactgacactgtggcaccgcgtacggttcggccccgtgccgcccgatcgaaaaccaaggcgcgccgtgcagaggccaaaagccggcaggatagacaaacataacccacggcggcgaccatctacggaacaacagtaatacagcacgtacgtcgggcgcactgccggtctcacgcctccctggcggccgccgcctcgcccaaccaggggacgccccgcgcgcgcccgcccctgtccccgtcccaccctgttgatctcacacgatcacatcgcaaacgccggcaacggttcggaaatgggttaattgggcacatcgctcaccatcaaggctggacgctatgccgttggctagattagaagtggttgttcgaggcagagtggctgatatacgagtcctaattaataataaatggagtaatcttttttaaaatgttaaaaacaactttcttattcttttcacgttctcgttgaaaaattctcaagacttttcacgtactcgttgaaaaattcttatatggtgctcttttaaggtattccatggctgttgtgggcctggacttgatttcctcacgcctcatccatcgacacgtacgtgcggccggcgttgcatgcggttggcgtaggtggccgcgcgcttctatccgggaacaggcgctcactcgtctaaacgacgtgatatgtcggggttttggtgctatatgcattgctaactatgcaagccatgcccaaccaccaatcgggtaaccgatcttcgatcgtgcactagctagtataggagtagtagctaatagctctgcatcaggattcaggagctagccgtcagcaccatgcaaggctgcgagccgcgccggctatgtgcgataaataaattgatcttgatgcctcttatctttttgtgattcatactcatattattgagatgtgacttgattgtgcccccgatgggactttgattgttgaatttgatggccttttgcggattggttttatagcgttgttgactcgtcgcaccatcgattgattgcagttggtgtgttgtatattccctcggtccacatatatagtgaattctaggttttatagagtttaaggctcgggtgaaattgctttgatatcttgaaagtttacttgattaagaaagactatgactagtgagcaataaatatagtggttagatgatataggtaaagtatacttcaaaatctctacattcgtggacataatatgaatttttgaacataaagtctcttatatatcctatatttgtggatagagtggatatttaggaagaaacaaaataaaatgaatattttttagttgaggggaacgtatcctatgcacacacatcttctcgtgtatacactatacacaccaactaacaaacttcaaaaaaaatttctagaaaaatatatacatatacttttagttgtatcataattatgtctaa

SEQ ID NO: 53477 - DNA, 960 bp, Oryza sativa
tgtaggacttgactcggtttagaccctgtctctttcagcttaagattattataatctagattattgagtcagattactgtaaactagattgttataatctgtagtagaataagcggttagttgtttctttcctagattattagagcctagattattgggtttgcaagtctaaagagggagtggggtagcatggtgggtaatttttcacccaataatctagaaaaagctcacctaaatgagcttatcagattataataagctgggctttagattataataagctacttcaataagttgtctgtttctttcagtttactcccaataatctgcattataataatcctaagatgaaaaaacagggctttagtcgttacgaatcgactcggtgtgcaattgacatggcaagatttagcacgttgttttgtgacccgcatgctacttgttatgtatctaaacatttgtcactttcgattagatactgcgtgcgattcttgtgcaacatggtactaaaaattaattaaagaggtataactcagataaaacacgcattttatataagtatgaattgttggactgactgggtattcagtagcctcgccatttggtggtgatggtgtgtaggctggaacatgattttttagctcgcgataagaacatttccctcctcttggttgttggggcacgccgctgcaaccacctgaaaaaggcattccaattcctctttttgcaatatcaggttggaaaattaagcatccaggaatcatcctttctccacgtgaattcccatccatttcctctcttgaccacagtctgtatcttgcaagaaacattgagatttagctgggcagcaggcgacgacgacatgcagatgttaaatgagaaaatgatcaacagagacacggtagtcccctggttctgcacaaatctagctggagacgactgtcacagcacccttacatc

SEQ ID NO: 53478 - DNA, 1402 bp, Oryza sativa
cctaaattttcaaggcagtattattctctctaacattacttgtgggctcttgagattttaattgaattaaattgggcctagcccatttattccaacaatccccaccaaatttcatggctcacaagaaatgttctcaaaactgaacctgttagttataccagtgtttcgatggagactgttaagttgaacttccacctaggaaaagagctacaccagatcacaactgaacaatagactatgccttgaattattagtcttgtgcgattcaggtttcactcaaacccttaactggtattgggctgtcatttgcatcctctctgtttggagcgtataagtcatactcctggccttttcatgagtatctagagatcacctagatctcataaactgtgactagcagtcggactcatataggtgtgttccttctaagatgttctgtaggccaacatctctgctttatgaaaagccactcagatcacattaaggtgtataccatcctaccatacagattagaagagaagtgcatcatgaaaataggctcattttagggtctcttctctcagctacacaatagtttatttcgccatccaaattcacgggatctccgatcacaatggacaggtttccactattgtgcaactctaagtgggtctcaagcccatctccctcgatgcacagtctatcacattacgtggtagccccttggtaaattgatctgccagatttttagccgtctggacatagtccaatgctatcactccggagtttttatgctttctgacagtctttagtcttcttttaacatgcctggatgacttcatgttgtccttcgaactgttcactttaataatcactgtttgattatcacagttcattaggattgctggtactagtttttcaaccaccggcaaatccatcaggagctcacgaggtcgttcggcctaaactgtggcagtatctaaagctgtgagttctgcttccattgttgacctcgttaagatggtcttcttgcaagacttccaagaaacattgcaagacttccaagaaacagcgccccctccaagtgtgaacacatacccacttgtggcattttctcatcagcatcagatatccagtttgaatcactatagccctctagcacttttgggtacccggcgtagtgaattccatagctcattgtcccttttagatagcacattactctttcaagagcatgccaatgatcatctcccggatttgaaacaaaccggctcaacttgctcacagcaaatgagatgtcaggcctcgttgcactagctaagtacatcaatgaaccaatgatctgagagtatcttaattgatcccttgctattcttcggtttttccttaatagcacactaggatcataaggagtaggagctgc

SEQ ID NO: 53479 - DNA, 1932 bp, Oryza sativa
gtaatcccaccctcatgtcctctcagtagtttaatgttaagaataacatcagccactcccaaatctttcatttcaaagctttttgacagaaagtccttgacctcctcaatcacattgaggctggtcccaaagatcaatatgtcatcgacatataaacacaagatcactccctctcccccaccatagcgatagtacacacatttgtcagcttcattcacaacaaagccagcagatgtaagtgtattgtcaaacttctcatgccattgcttaggcgcttgtttgagaccatacaaggacttcagcagcttgcacaccattcccttctgaccttctagtacatacccatctggttgatccatatagatctcttcctccaactctccattgaggaaagctgtcttaacatctatctgatggacgagtagaccatgagaggctgccagagcgagtagtactcgaatcgtggtcaagcgagcaaccggtgaataagtgtcgaaaaagtcctcgccttctttttgggtataacccttggccacaagccttgccttgtacttttcaattgtaccatcaggcctaagctttttcttgaaaacccatttgcatcctacaggcttgcacccatatgggcgctcgacgacttcccaagtaccattagacataattgagtccatctcactgcgtaccgcttccttccaatagtcagcgtcaggagatgaatatgtctcttcaatggttcttggagtatcatccacaagatatacaatgtagtcatctccaaaagactctgcagtcctttgtctcttactctttcgagttgttacaatattatcctcctcaggatttttctcaagcgtttgatcaatatgttctatcggcacaaagtgctcaggggataaaataggttctttactagaagtgctaggtgcatttttcataggaaattcattctcaaaaaatatggcatttctagactcaataattgtaccaacacgcatgtcgggtactccagaatttactattaagaacctatatcccacactgtggatagcataaccaaggaacacacaatctacggtctttggtccaagtttacgctttttggctataggtacatttaccttggccaaacagccccatgtgcgcaggtgagagagatttaatttcttcctttcccattccttgaatggggttacttccttatgcttagtaggaattctattcaggacatgacacgcagtcaatattgcctcaccccaccattccttggaaagtcctgcagtgtctaacatggcattcaccatctcagttagagtgcggttctttctttcggctaccccgtttgactggggtgaatagggagccgtcctctcatgaataattccatactcttcgcagaaagaaataaactcattgaaaaatactctccacccctatcagacctcaactgtttgattttcctttccagttgattttctacctcagccttatagatcttaaagtaatgtaatgcttcatcctttgttttcaataggtacacatagcagaatctagtgcaatcatctatcagtgtcatgaaatatttctttccccctttagtcaacacgccgttcatttcgcacagaccggaatgaacaagttctagtggtgccaaatttctcgcctcagatgccttatgaggcttgcgaggttgtttcgattgaacacaagtatggcacttagagcctttgactaaaatgaattttggaattaaactcatgttggctaagcgtgtcatactaccaaaattcacatgacagagtcatgaatgccacacattagactcatcatcatcattgcttacatggttcacactttattacacatatcatccaaggaaaagcgaaacaagcctccgctgtcataaccttttcaaataaacgttccatattagat

SEQ ID NO: 53480 - DNA, 1031 bp, Oryza sativa
gaaagttatgaggaaggacaagattttggagaagaaccatgctgagtacatgaaagcagagagagatatactgactaaagttgatcatccttttgttgtacagctgaggtactcctttcaggtatgcatttatcatctctgtgtgttctttgttggcaagctatcatgcatgttatatttttcagtcttgtcccaaattttaaacccagtatttacttggcagacaaaataccgactttaccttgtgttggacttcataaatgggggccatcttttcttccagctctaccaacagggtttgtttaggtaatttcattacattattttatgtttattcctatcgctttgcatgaacatttaattaagcaaccttttgtctgtcagggaggagcttgcacgcatctacactgctgaaatcgtgtctgctgtagcccatctccatgccaatggaattatgcacagagatctgaagcctgagaacatcttgttggatgctgatggacatgtaaggatcctttaatacatatttttcttcaccttctctgactttatctactgattggtatttgggaatttacggaatttttcattgtcttatttaggccatgctgactgattttggcctggcaaaggaatttgatgaaaacactagatcaaactcaatgtgtggtactgttgagtacatggctccagaaattgttcagggccgtggtcatgataaggctgctgactggtggagtgtgggaatccttttgtttgaaatgcttacaggaaaggttagttatttaagcacgatgtttctgcatagaagatgtgtttgcattacagatggtttgcttctatatatccttttgttcccatgctcactcttattatattctgcagcctccgtttgttggcggaaacagggacaaagttcagcagaagattgttaaggagaaaattaagcttccggcatatttatctagcgaagttcattctctgctaaaaggcgtaagttgtttgccagttgctatgattcaccgcaccca

SEQ ID NO: 53481 - DNA, 2368 bp, Oryza sativa
tacaggaaaggttagtatttaagcacgatgtttctgcatagaacatgtgtttgcattacagatgggttgcttctatatatccttttgttcccatgctcactcttattatattctgcagcctccgtttgttggcggaaacagggacaaagttcagcagaagattgttaaggagaaaattaagcttccggcatatttatctagcgaagttcattctctgctaaaaggcgtaagttgtttgccaagttgctatgattcaccgcacccatatttttttgcagccgtgtgctagtttctagagtcaacctgtttgatcttgggattgaatttttagtccatcttatgtttcagttactgcacaaagaagctggcaggaggctgggctgtggaccaggcgggagcaatgaaataaagaatcacaagtggttcaagtcagtaaactggaagaagctagactcccgacagattcagccaagcttccgcccaaatgttgctggcaaaacctgcatcgccaactttgacgagtgctggaccagcatgcccgtgctcgactctccagtggccagccctgtcgctgcagatagcaacttcgtgggattcagctatgtgaggccagcgcccttccttcagaggccgagtcctctaggctgaagacctccagttgagaccgaaatacatcttgccactgggtatgaagctgacaaaatttactgtttcgatgattattatgtaaaactacctatttatgttgttcggtttgtctgggaaaaccccagtatcttttcttcgttgaagatactagtaaaagatgaacgtggtacttgttgaaaccagacaaatttgtctattgccagatggaacagttgccctggcttctatgatcaacccctgccccctgggccctgggcccctggcacatttaggttttctcggccgttcacgtacatgtttccaaatccaaatcctgctgcatgttgcaacacaaatcctgttgagatgcaaatttaaagcataccgtttatgcatgttgaaatgtaaattcgaacagagagttgctaaatttccacgacatctaaaaagtatagtatcactagtaataagaaatggaccgccccaagtaataagctcacatggacagcagcatatggcccttggcggcataggccgagtcggagtctgagcgtttcatgtcagtatgtcacgccaacttcgactccgattcatccttgcctcgcgggcccagtctccatcacgctcagcaacggccacgcaatccgcctctaccctccatcacctctttgttccttcttacaacctccggcgatcgcagcagcagcagcagcaacacccctcctccgttcaacttgagggagaggctatggcggtgttcctccgttcaacttgagggagaggctatggcggtgttctacaggtacaggagcgaggtggataccttctccgtgcccgtgccggagcctttcgtctccgtcgcggagctcaagcgcctcatcacgggcaccgtgcgccacggccatggacattcgcgcggccggggccccaggagagtgtcacgctgtacagcgacaacacccgcgaggagtacgcggacgaggccgagctgatcccggtccagatcaactagaggtgactacaactctaccaggtggacagtgtcgaatctagaacaaaaatagaggggtgctatgtataaaacttacataaaattaagacagccaaatatacatccatgacgtattttgctaatcaaatcgtaaaattaacaaataaatagaaagagggtatcatataaaataaagtaactctagctcatcgtttattatttgaaaaagtacttgttaaccttgcttctccgctttaatgtgcagttatatccactaaaatcaggcaaacaaattgaatttgatatgaatgatgtgccaatacactgaaaggtttccaaacctaatttaccaataaagaggctcacgtttacatactacaacagatggattaatgtccagtctagctggaatacgtcgtagaggccctgacaacaaagatgtaatgaggcactaaacaacaacgtttttatttctgaacctgaccgtgaaatgcacaaccatggagctggggctcaagccccaagaagcgtttcttaaccttgcttctccgctttaatgtgcagttatatccactaaaatctggcaaacaaattgaatttgataggattgatgtgccaatacactgaaaggtttccaaatctaatttaccaataaagaggcttttacatactacaacagatggattaatgtccagtctagctggaatacgtcgtagaggccctgacaacaaagatgtaatgaggcagtag

SEQ ID NO: 53482 - DNA, 9350 bp, Oryza sativa
  unsure (1)..(9350): unsure at all n locations
gaagatggtgatggcaatggcgctggagacgtttcagtgggatcccctcgattctgataagtctcatggtgtctctgaatctgattagtggaatgcaatattctaatctacaaacttgttgttcttattttgttaattaatggtcatgttcttgacttcttatgatgaactatttattatttatgtcaagaactcaagtggcatgtttactatgaactatgaaccgttaaatttataagtatgaactcaagtgccatgtatctgtatgatttaatatgaactatgaaagtatgagttaggaactatgaactccatgtatgaagtatgaattggtgataagctttgaattggtgatgaacttaacgtgcaatgaaataagtgatatgtcaatttttagctcaaattctattaaatttttattgttttctcatattttagaaaaaagctaaatgttttagctgtagctatagccggttatagctgctcttagctattggagagcacaaccgctaagagccttagccagagatttagaatattgctagcgactagtgcggtggcagggaggaaaaaggaaaactgattagggttttgtggactttgcacaaatctcaaattaatcaatggtctgaaatttataagatactaggaggggttttctgtaaactgaggagtagacagtaaaaaaaaaaaaccatatagcattgccaccggccacccattgccttttgttcccctttcgtgattgcccggtcgcggcctcgccgctaaccctaaccgatcgaattcctccgaaaaaatccagccatggcgccggcggcgcaagagccttgggccattctggccgcaatccctaacgtggtggggtacaaggaggcgaagcgcatcttcccgccgggcaccgacatctccgtcgcccgcaaggaggtcccgcgagccttcgtcctgaccgtgccgcgccacatctccctcccgggctgcctcggactctacccctatgtcgtcgccgacgaccgctctggccttctcctcctcggcacgcatcctgtcacctccgcctccgccatggtctcctaccacatctgtgatgcgcacaccggtgaggtagtctccctccgcgactgcaaaccaatgcgccccatgaccttctacggcgccgccaacgtcggtctcatcatcaaggacgacggctgtatggtcgctgagctccagccgggatgcaagggcacaagcaccggtggtgccactctgctcagctacaaggtgggggagtgctgcaagtggcgcgagagggagcttacctgctcgcccccactcccgctggactggtacccggagggcgtcgtctcccacggcgggatgctctggtgggtggacctctcctacggcctcctcgcgtgcgatcccttcgccgaggagccgaacctgatccacgtcccgctcccacaagttcccgacgagcttcctgttgatgaccaggttaaccgcggtgcccaccgctgcgtgaaggtgagcggaggaaggctgatgtacgtgcagatacacggcaatcctgttgtgccggtggtcagcacatggttgctcgacgaatcgacctgctcgcccggggagtgggagtggaacccccagctcagcgcgcccttggccgagctctggattgaccagagctatgtggacaccatgctgccgttgaccattcctgcccttgcgctcccccaccccacagatcctaacagggtatatttcttcctcaaatcttgcatcttcgcagccgacctacggttgaggaagctggtgtcattcaatagttttgagatgctcgacccaccgtgtgaactttggatgaagcgctcctcccacttggtccacgcatggcagtatgatccttcaagcagtcgtatgtatcttttgtctctgcccttctctttatcttgatgtgttcagatgatagctcatatttcgatgttcctgccaattgtcattagcatggataaatcaatctgatccaccgcttatatcaaaactctactcagaccactcagaccctgtataaaatatccagtacccttgaactaaaacaagaccataaatcctatcctggtttctttataattttagcttgaagatccacaacttccggaacaccgatatgagctagatagtgtgataattgtgtgtttatacttgtttaattctgaaccaatgctcgctgctatataccttattcctgtacatattcctgtatagtttgtactgctccatttgatggaatactgctagtataactttagtgattgcaagagtgacgtaggtccggaatagttcttccatattctctagaaatgttccgttgcctcttacaaattaaatgatacagggaactgccaaaccgagtgatgggatgttttgcccttgaatggaatgggtgtaaccaccttgtgacactgggaatgtatagatgttacatcttttacagttgtgcttatgaggcacacggaccacttggttttcatggggaattattgatatttttaggtgtattgtttctctgcagaatatttagccagtttatagtgcttataaatcttagttgaagtgtcattctgttgctctcctcagcttacatataaccactgtaatttctttttttaggttctgactttgtattggcatgcttgaggcaagacaaggcaattgcttctaagagcaggtgaccctatacttcactttaacttccaattagattttcttgcatatccttaactttaacttccaagaagtagattttctttcaatggcctaatacaatctttcttttgattcagcttctctggtataattcctgtcactcgtagaactggtatgtactatataatctatgcaattcttcaattgcaattattggatggggtgtttcttttgtccaggttgtagaaaagtgagcaaatttcaaataacgccagacatagtgttttgtcaaacgtactctgtaaaatttgattgaatacgtccttatggtgtgagtatgttaactgtggtgccatgtttttttcccttcggtccagagtttttgtactgaagagctgatattatctgttgtattttcagctaaaagtttgaagagagtttgggattctgtaaccaggcagcagcaaaagcaggagcagcagctgcagaagcaagctatgtaaggtgcagaatctctgaagaaagcagaatcagccagcctcattaagtatgaaggaagggtagagtatattattttgtgcatgatttgccagcctcattaaccaggatttatgaaaacgatctgatacagcatgagcttacttgtgagttcttgttctgtgccttttcttaggcctatttataagggagacgcttcatgtacagcttgagtacaaacgtgaatcttgactgttggatgcatttatgaggattttaaccattccgatcttgagttgtcccaaataagactttcaatagacagtcttcaatgttaaatagaaacatgttaattagttctacaaccataccatgcatgcatgtgtacgtgacagtcttcaatgcttggacagtactatggctgaatatttgtaactgatgtaacggttaggatgtatcaaaataagatagcttgaaaaaagtccatacttttgttctagaggccaaagaattaccatgttaattgaaaaactaatttcaagtccatacttttgttctagaggccaaagaattaccatgttaattgaaaaaatatattatgaagatggctaaaaaagtgctatcttttatttcggaggcctaaaattaccgtgttaatgaaaaaaaaaactacaccattagataaacatatattttaactgttaaaattaatttataagtataacaaacagcaaattaaatagacaaatactactcaaagtttggaaattactgtataactaaacaataatcatgttcagactctcaggtcccaaccggacttgggctaaacacattctttctagaggcaccacgtttaccgtggggactagaaatacccacattaatcgaaaaaaagaaaaggagagtccaacttgaaatacaatttaataataactgaaattaagaattaaaaataatcactatttaaagaagagtccatctaagaacccaatacgaggttaattaatattcggattaaaaaataaaataaaatccgaaattagcaaaagaagaagagaagagctcgagtagaaatacaatttaaaaataactaaaattccaaattaaaattaagtaatattggaagaagagcccattataaaacctaatacgagattaaattaaatgcggaataaaaaattcgaataaaaaaaagaagaggtccaagtaggaatataatgtaaattagctgaaattcggaattaatataagtaatactaaaataggagtccatataataccccaaaacgagatgtaattaaatttcagaatgaaaaataaaataacatatgaaattggataaattgaaaagagagttcaagtaggaatccgatttttaaacaactggaattgaaaataacaataaaaatattaaaagaacacattatgatattagttaagaattgaaatagaaaataaaaaaaatcttcaattagaacaagagaaataagatttcaactagggatgcaacttataaataactaaaattggtgataaaaaataaagactattgaacgaatagaccataaacacatgatgagattaattaattaatagtcatataaaggtgtaaagtggtggcggttgacgaggcatctaaaactattaataaaacaccaaatagaattctaataacaattaaattaaagggaaggagaacgaacatgtcatgaaataaccggtcaaggaggttggcaagacttctagaaagtaaaaaaaataaacccaattgataatcatatttaatttttaaaatctcaatgatagtaaaaaggagaggcagcgggcgggtcgtacaggagtaaaatnnnnnnnnnnnnnnnnnnnnnnnnnnnnnnngttggtggtacttttagaaagtataaaatgaattccaacgatagttatgttcgacttttagaatctaaataacaataaagagtaggcggcggataggtcatagaggagtatagtggcagcgtttgacatgatttctaaaaattataaaaaatgaaatccaatgagacaacaaattctaaaaactataaggttcgggcttctaaaagtaaaaaaaaaaactccaatgataattatatttgatttttaaaatctcaatgacaataaagaagggagacaatggatgagccgtaaaggagtacagtgacaaagccgctgacgttttgcggaacttctagaaagtaaaaaatgaacccaaatgattattatgtttgattttgaaaataccaatgaaataaatagaataggtagtgacgggcaacatttgacgggatttctagaaattataaaaacgaaccccaatgggacattgaactctaaaaactatggatccaatttttaaaggttccaaggaaataaagaaagatatgacagaagtaagggatatcaattgatgtgacttttaaaaattataaaattagaaacacgaggatgataaggtttggtctttcaaagtcttaagacaacgaggtaactatttaataaattttaagtaaaatattatatttaaaaaatataattttgtattgatgctagccgcgcaattgcgcgggccacccagctagttatattattaaaacagctttgaaaggagatatcacgttcgctgtggaggctaacaattcaaaaatagctgaaattcggaattaaaaataagcaatattaaaagaagagtccatataaaaacccaatacgagattaatcaaaatttggaataaaaataaaataaaattcgaaattagaaaataaaaggagagtccaagtaggaatataatttaaaaataactgaaattcggaattgaaaataaggaatattgagagaagagtccatataaaaatccaatacgagattagttaatattcggaataaaaaaataaaaataaaatctgaaattagcaaaaagaaaaagaagagttcaagtaggaatacaatttaaaattaactgaaattcagaattaaaaataagtaatatttaaagaagaatcatataagagcccgatacgagattaaataaatttcagaataaaaaaataaaataatatccaaaattagaaaaaaaataaaagagagttaagtaggaatacaattttgaaacaactgaaattgaaaaataaaaatattaaaagaacactatacggtattaattaaaatttgaaaaaaaataaattatgaaactagaaaaagaaaaaaaagattcaattaggaatacaatttataaataactaaaattggtgatagaaaataaagactatttaaagaaaagaccatctaaaacacatgacgagataaattaagtaacatgcatgtaaaggagtagagtggtggcggttgatactacatataaaaactatctataaaacacaaaatacaatcctaatgaccattaaaaggagtgacgacaggcaaacaggttaggcggttgtcgagacttctagaaagtaaaaatataaaccccattgataattatattcgatttttaaaatctcaatgacaataaaagggagaagcagcggctggggtgtatatgagtatagttgtagagccgccaacggttggcaggacttctagaaaataaaaaatgaattccaaaagatagttatgttcgatttttagaatcccaatgacaataaagagtaggcggcggatgagccgtaaaggagtatagtggcctcgtttgacgggacttctaaaaattataaagaatgaaacccaacaaaacaataaactccaaaaactacatggtccaatttttaaaggttcggaaattctaaaatgtaaaaaaaaaccccaataataatcatgttcgattttaaaatctcatgacaataaagaagagaggcagcgggcgagtcaaagaggagtacaatggcaaagccactgacggtttggcgggacttatggaaagtaaaaaatgaacccgaatgataattatgttcgatttttaaaatcccaatgacaataaaaagaaaagacaatggatgggtcgtataggagtataatggcagcgtttgatgggacttctagaaattataaaaagaaacccaacaagacaataaactctaaaaactataagatctaatttttaaaggttccaaggtgaatgaatagaaatagtagtagatcgagcaagcaaataaacaaggagatgacagaagtaagaggtatcaactggtgtaactcttaaaaactatataattatgtaactcttaaaaactatataattagaaacacggggatgataagatttggtctttcaaagtcgtaagacaatgagaaagttatgtaataaattttaagtaaatcatttagaaaagaccatctaaaacacatgacgagataaattaagtaacatgcatgtaaaggagtagagtggtggcggttgatactacatataaaaactatctataaaacacaaaatacaatcctaatgacgattaaaaggagtgacgacaggcaaacaggtaaggcggttgtcgggacttctagaaagtaaaaatataaaccccattgataattatattcgatttttaaaatctcaatgacaataaaagggagaagcagcgggtggggtgtatatgagtatagttgtagagccgccaacggttggcaggacttctagaaaataaaaaatgaattccaaaagatagtttggcgggacttctaaaaattataaagaatgaaacccaacaaaacaataaactccaaaaactacatggtccaatttttaaaggttcggaaattctaaaatgtaaaaaaaacccccaataataatcatgttcgattttaaaatctcatgacaataaagaagagaggcagcgggcgagtcaaagaggagtacaatggcaaagccgctgacggtttggcgggacttatggaaagtaaaaaatgaacccgaatgataattatgttcgatttttaaaatcccaatgacaataaaaagaaaagacaatggatgggccgtataggagtataatggcagcgtttgacgggacttctagaaattataaaaagaaacccaacaagacaataaactctaaaaactataagatctaattttaaaaggttccaaggtgaatgaatagaaatagtagtagatcgagcaagcaaataaacaaggagatgacagaagtaagatgtatcaactggtgtaactcttaaaaactatataattagaaacacggggatgataagatttggtctttcaaagtcgtaagacaatgaaaaagttatgtaataaattttaagtaaatcatttagaaaaatatatgattttgtttaggtgctagccgcgcaatttggcgggccacccagctagtttttattttaataataagatctaggagtataatgtttatactccactaactcaactggtaataaagaccacgtcgcatagaaatcacaatatactacctccattttttatatatgacgttttcaactttttcacataacgtttaatcatttttattacgtaaatgtatcagttttttctaggcatgcaacctaataaaagtctttacttataagtgcttatgattttttttttgtgaattttgtgttttgaattttgtctcgagaccttcatgttcttcctcattcgctgacacgtgggacccatggggactactgtcaccgccacagcttctgctttttcgcgcgcaccgcgatagcgacagccactttggcttggctttgcgcgaggaagcagcgcagcgatcccgtcaccgtgacctcatcctcccccgatcacaacacaaacccaactacaccaagagcttggggattgggggagtcagggggaaaaccctactccgtctcgccaccccacacccaaggccggcgactccttcggtatgccaaactccaccggtagtttctcctttctttctctgtgcacctgtgatgtcgtcgtcttgtccgtgcaggctccatagcgggtaagaaagggtgcaccaagatcgccggcggagatcgtcgccttggtcttgacgaggccagtgagccctttctcccttcctgttcttgagttggcgcagatccgatccatgccctgactctctttcctctttgcaggctgccgtgaccccaggcgaccggaacgtgaggagccgaaccagggacaccgagagagaagcccgccgtg

SEQ ID NO: 53483 - DNA, 3380 bp, Oryza sativa
  unsure (1)..(3380): unsure at all n locations
gtaatcgcttgtttagcacttagcagagcatcaggttctggtgccactccaccgggagtttggggaccggtttcccttttctgatgacttcgccgggcgagattacgacgtttgggtagagtacgtacgtggcgctgccgggcgagattacaggcgagtcgccgccatcctgcgaagggggattggctgctcaacgtactacacgattgattgatccatccccatttcgctcaacctactaccgattgattgatccacccccatttcacttcattgcaggacatgtcggagatggtcactgtgcaatttctggatctgagaattcatcgcatgcccgccaacgacgtcctacaacttcgtcgccgtcttcctcctctggagttgaactgcgtccaatccgtggaccaattcaaaagattccaggcgtttgtaagaaaaaatgaggagaaggagaaaagggatgaagaagaggccgagctcaacacttccctaccgatctttcttctaccgttgattcttgctaactgattaactttgctatgtgcgtgtgtttataatgtgacgaattgacactgttcttgtatccagttgccaattgtcacgagtcaaacagatctagcgcgcatatgcgctacaagaggtgaagaactgaatgagcttggtatagtgaaggagtacgacgacgacgacgacgacgacgacgacgacgacggggacgagcactatgtgtatgaaggcttgaatatgttcgagccagccaccaccgatgaagaggacgccaacgcgcaggtggatgctgatgatctttactacctgggggtcagtgacgacgagaatgaggaagtgggaagcgacggcgggactgatgacgacggcggtgatgatgctggaggcgacggcggacgggctggacccctcaggtgggacaacctatgggacgacgacccaccacagtgagtcagtgacggcgtgatgccctgatacaccgatcgaaatcctatcttatttattgcggagtagcagaattgacgaacaaacctagagcttatttatttccttacgactgacttgtgcaaacattcagcatgtcttgtgcaagtcatgttttaaattgcatctggatgacaatgagctatggttaatgcagctataatttcctccaactgtcactgctctttgcctgatgattttctagagacaagaggcagaagatctcgcaaattctgatagtgcataattaattgtttctagatatgatctgtatatataagtgcacttacagtatgtgagactgattgggtactctagaccatttttactggaatcacaagctcatgcatgcattcagcgcatcgaagcccatagcattctacatctacagcagtaaaagggactttatttttgtccctgactactgatgaacagatggttctacacttctactaagtttcatactctccgaaacaatggtattatacatgtattgcaagaatggctctgagctttcactgcagcggaagactgtctactttactgaactgtcagctcttggctcccttctccagcccatgcttaagagcaggtataatatacatttcgagaaaataaaataggagagaggagttagtacggttttgttgactatactattaaacttgcgctggatacattgagcatctagcacaatctcttccttgggaacatcagcccgcaaattcaaattgttggccttcttggtgtttgaggaaaccgtcagtcctctcgcgaagatcgtcgaattgacccgaaagaagccgtgtcacagggtggtgggtcttcgtcggactccggtgcgactgcgacgtcgagctatcgtcacggactctcctgtggtcaacagatcaacaccgcacagctcaagtgggacgcccctcttacagtcacctgggcgtgcactcggggagggagccgcccggagccagaaattaaccgtgtagattcaattactagtttactactgctncatccgactnctaatatgaggaattttgacatttgatttgtactgtttaaccattcgtcttattaaaaaaaatttagaaattatcatttttttcctactttattatccaaagtgcattaagccacacctttttattttttatatgcgtataaatatttgaccattcgtgttattccaactttttattcgtcttattttttaaaaaatttatatataaaaatcaagaatattgggtcagccgaccccacagtttgttcatacatccgacactggagctgtcggccgggtacgtatgccacacaggtgccgcgtcccaaggcacttcatcgagcactgccctaccaacgggcaacggcgacccaagatttgacatctggaggggggctccagctccagcgtcctcatcggcgccgctgcgtggggggaacctgacggcgtcatcccggcggagctctactgcaagatttgccggaacgtgatgaccgacgcgatggtgacgagcaagtgcttcttcagaaattgccgattaagagctacttggagattttcttttcctctcatttgcgtgttgtcatgtagtgtgtgtataagatcaagtagcgtgctatgttgtaatgtagaagatgaactacttcagatctcttttcatcatgtatatactggacctatgtaatacagtacgtattattaattggaatgattttgtcatcctgtatacactgtatacactctcttgtcatcttgtgattctctctgtctctctctacggagtaatatgttaattggaatgatttttttccaccaaaaatctgaaatcttttgttcctgtaagcgtgactcttccccgtacattttgacgtacgatctcggaacaattgccgtggcgcgggcgcgcgccaacgacgatggcgaattggcgatccaacggcgtcccgttcggcctgacacatcatgctaaccattctacgacggcgcaatgcatgacggctctgcccacccgatgccttccccggcgtgcaacatgccagccagcgccaccggccggagcgcactgggcgattccgctccggcgggacagacagaccagaccatggtcgagcctccacgacgacgaggagctgatccggttcacaacgtataaacaagacacaagaatggcaccttacgtgttccgtgtaaccctcaccattgtcagctgatccaaaaatcatacaggaaatacacattaaaactcgtaataattttcaaagcctccaccgattcgcgactcgacaagtaaacgccgacgctcccatcgcgatgcgacggtggtagtagttacaaaagaggcgaatgcgccgcgtacgcgcgcgcgtctcacgatcgagaaggaagaggc

SEQ ID NO: 53484 - DNA, 1566 bp, Oryza sativa
tcggtgcctgtttgggggagcttcttctagaatctccagttgctagaaagctcccccaaacagtccagctttttacccatattctgagaatctgtagttatataatcttaaaaataaattagaagccaaaagctgggtttctcagcttctccagattctcagcagctgcttctcagaatcttaagcttcccaaacaggtcctcagccaagtttccgccaaatgttgctggcaaaacctgcatcgccaattttgacgagtgctggaccagcatgcccgtgctcgactctccagtggccagccctgtcgctgcagatagcaacttcgtgggattcagctatgtgaggccagcgcccttccttcagaggccgagtcctctaggctgaagacctccagttgagaccgaaatacatcttgccactgggtatgaagctgacaaaatttactgtttcgatgattattatgtaaaactacctatttatgttgttcggtttgtctgggaaaaccccagtatcttttcttcgttgaagatactagtaaaagatgaacgtggtacttgttgaaaccagacaaatttgtctattgccagatggaacagttaccctggcttctatgatcaacccctgccccttggcacatttaggttttcgggccgttcacatacatgtttccaaatctaagggcttgtttggattgtagcttaaaaaatgatatggttaaaaatagcatcaaagtgaacatgtccaaattcttctgcatgttgtaacacaaatcctgttgagatgcaaattcaaagcataccgtttatgcatgttgaaatgtaaattcgaacagagagttgctaaatttccacgatgtctataaagtatagtagcactagtaataagaaacggcccgccccaagtaataagctcacatggacagcagcgtataggccgagtcggagtctgagcgttacatgccacgcaccaactccgactccgactccgattcatccttgcctccgcgggcgatataagcgacgccacgccacgccatcctcccagtctccatcacgctcagcaacggcacgcaatccgcctctaccctccatcaccctcttcattccttcttacaacctccggcgatcgcagcagcagcagcaatagcacccctcctccgttcaacttgagggagaggctatggcggtgttctacaggtacagaagcagggtggacaccttctccgtgcccgtgccggagccttttgtctccgtcggggagctcaagcgcctcatcacggccaccgcgcgccacggccatggacgttcgcgcggccggggcccagggacagcgtcgcgctgtgcagcgacaagactggcgaggagtacgcggacgaggacgagctgatccctagcggctgcacggtcgtcgtgcggcgccgagtctccgggcctcctgcagagacgatcgtcgagttgacagtaaagaagccaatgtcggagggcggtggttcttcgtcggactctggcgcgccgtcgacgggagctgaagtggacgacgaggagaaagctatcagctccgtgatcg

SEQ ID NO: 53485 - DNA, 1110 bp, Oryza sativa
caaaattgctaaacaattggaattaatgtgttcaaataaagatgctgagcaggagatcaatgattcagatccaaatgcagaagacaatttgaactcacatgaaaaaggcaatcaacaatctgaggaaaatacagaagaaatattgttggatccagatattgcaaaatccaaaggcaggccagctcaaagatataagacaatcagggaagaaatccagcaaaaagaactatatcattgcagtcattgtcagagcgcagttcacgcatttccaacgtgccctctgaaacactgttgagtttgtctcgccaaggaaaacgagaagaaaggttgaatatacaagagatcacgttctaataatcacacatccatatgaagtgaatttttttaaaaaagtaataaagaaagatattatttgttgcaggatggtgtagagcagaaaaagaaagatgtttcaaacaaaagaaaagatttgcaacaagatatatcacaggagaagcataattctggggctgaattagaaggcaaaaagaagagaaattcatcttcatcaaaaaggggtggcacaaaagaatagaaatggaaatgactgaaaatagagagaggtttacttgaatacaatggaaatagacatattccataagtttctgtaatattccagaacatgtactctggtgtcacaccccaatctgataccgccgtacaacggcacctgacaggagcgtgtcgtagggaaaacggcgtgaaccgtttcctacgaaaccgcgatctcggtaccagtcccaggacatagtgctggtacccacggtgacaaatatgaatcatagcaatccttaaaataaatagaggacttatttaccttaacttaggttgcagctcagaacaatccgagaatgcaaccgacgacacggacgaggaaacaccaacaacagcagcagcagcggaaccaacgaactaacacccaacaccacaggcgacggctgggaaccaggacgaaaccctaatcttctcttcactttatcttctcttcagggcggaggaactatatatatatatatttatatagagcaagggtgagtactttcgtactcagcaagtcacgggaacttaggt

SEQ ID NO: 53486 - DNA, 787 bp, Oryza sativa
  unsure (1)..(787): unsure at all n locations
tgtaaaaccacaaatttagcaccatgtcgaacacatgacacatggtgtaaggtagggttgttgtgcagtaaaaaaaagtgatatcacatgatccatgagctatgactaataggaaagcaagcaactgtactataggtggccagtgggtaggacctatcgaacaatgaaagtttgataggccatgcactccctttttaccaggcaaataacttcgtcgaacactagctcttcgatgctcttatgtggcaccatgaaaattcatatcactcaatcaaattttgatcgatatacaccctatcaaactttgcttattcaatatggtgctaaacttacaattttagcaaaatagtctctacttttgcaatttcccattaatatagtattatttctaaaaaatattatatatatatatatagaataattagccgctgttcaccatacatgcattaatcaacttggttataattttgtcgttcgagcgatacaccgcggtttcgtacgtaccttggcgttgacgccatcgggcacgatgcgtccctcgctcttaagcttgaggtactcgtcgcgcttgaacctggtgaatcccctgaaaaccaataaaaaagtaaaaaccgagacacatcatcatcagatgacacgaaagaatttatatcatcctggccgtccattctgacgaacgtaccacttggcgctggagatgaccctcttgcggccggngaacttgaacttggcgcggcgcanggccttctgcgcgtgcgcgcgttcgcgtcgcggcatcgcacggaga

SEQ ID NO: 53487 - DNA, 1738 bp, Oryza sativa
tttttgtttcatccgttgctcgctgacgggggactggaggatacatatgcctctttataccataatttggctaataatagtcagtttcatttgagcaggccaaattcattggagcagctgttatatatgtttaattggttggcttgagggctagttaaacatatatattaatcatatgcagagggagtagatgagtagatgaaatgcaccacggggatttcgtgtgatggagattaagtgctttgctttgggttgctggtctgttatctgcttgattgatgcatggcgctgggctgtttttcctattacttcatcaagtcaggagtacggctcgaagaaggttccatggccgggaaactacaggggctacgcatgtgttgcgtacgtatacgtccggcgcgatttacgtcttcagagaggagatggagccaagccgctggttatatgcgtatcagaggaaaggtagcgatatatttccttttaatagttagatttgtttagatggaatcgtattcggttaagctatacggtacgtggagttgccgtgcttatcgcacctagcgtttagttgctcctatatatattagggcattgcgtcaatttgtggaaccccgaacaaataatcaatctactattatttttatttttcttggtctttacttttctgttattttctattttgcttaaccctagaatttgggtaatctttgccgttttgcgctgaaaaacggtcgtgcttttccacgaaagcgagaaggttatcctttgctagtttgctcggaaactagtcgttcgtcgtcacgtaagtacgatagaatcttctttactaatttgcttataaattagtcgtgtgattccacgaaagcgaattgatctcgaaatcggtttcaccagccgattttgatctatcgattttgatgactctattgtttacaccgcaaatcgttaggtgatcttgtgttggccacgaaaaagcgtcaacaatgcctacatattttacctcatttttagtatgctttaccaaaccgttaactatgcatttcatacgaaaatttttctatacaaaggttgatttaaaatactaattaaatcaaaattttaaatttataaaaattaaaactaaattaatcatgcattagtgacttttttgttttacatgccctaactccgtgttcttcttgtgagacaagagcaccacttacacaagtaataggttatttagattttattgtgctatgaaatattttatctggtctatctaaatttattgtaatatgaaatatccagttttagattactatattatgagatagaggaagtagcacattttggtgttatcgaattttggtaacgttgaacatggttggtttagaactttatctaattttgataaattttccaagagtagaaatttctatgattactaaaatttggtgtgataatatggataaggatatgttctagttgattgctctaacaaaatttaataatattaaggtttagtagtagggttaaaagtggtaacaaaggtaacagagcccaccattgtcgcttctacagtctctcatgtgggccggctaggctaggacaatgttgcgaccaagtgactcgagctacaaataccggcccagccacgaaacgaaaacctggcaaccacccaagaaaaagaaaaacagaggagtcgaagaaaaaggatagcttcagtaaagcctagcaaagcgcccatcagaaaacctag

SEQ ID NO: 53488 - DNA, 2076 bp, Oryza sativa
aaacggcgtaacgatgggctgggtgccgtgccgtgctgtgctgtctgtgtttggtgtatgcgtgatctggtagggtgttttgggcgtgaatccgcgaccatgggcctcttcaggatgtttgatctgtgtgcttggattgaatcagtgaaatctgtaagagcggattaagcttctgagatgagtgggcttcaaaaataataaaaaaaacatctgagatgagtgataggccagattaagcaatgatttgttttgttcatctttttgtagtagcttgtgaggactgaaccagttagcagtgaacacctatggtgatatttgatggtgtttggacttgtgtctgaatatactgtcagtgctagcctggtcattatcagtgttataatggccctgtcaggatatatgcaccacaatgtgggatttttctgttgattgaacggatgtagagctgtagcctgtaaggagatcaacaaattagattcatcatttgtgttttgagcatggcggtcacatgttatgcctaaggattatcatgtgcaacaaagggttaacatcacaatttgataaaaagcaagtgaaatgttactccgtggtggatttcagcattttatttgtttgtaatcagcctttcacaattatttcttgtcagccttctatatcatttttccttgtaccagcggcttgttgacaatgtttgtgatgttttgtagcttactccttttgacccaaccaagaaaaagaagaagaagaaggttgtgatccaagatccatctgatgaggtggataagttggcagagaaaactgagagcttgaacggtatacttttaatgctgcaaaaaaaaaaggaattgccaagtatgcatttttactaatatatgcttaacttgcttttttttttcagtcgctgagacgggtgagccaagttttacaggcatgaaaaagaagaagaagaagcatgtgagtttagttggttacaaattacaaatgcctgttgcaatgtttgttggattaatatttccttctgtactattctatttactaattttgcaaatttcaggtggagcatgatacatctcttactgaagctggagatggtgaagatgctataggtaattgtggcttgctcatatttgccctggttgcgttgttttgctttgtctgatcatatattgttcagatgatcaaatcggagaggatgaagaaggagaagggattgtgcttggaggtgcaactcgatacccttgggaaggaactgacagagattataaatatgaagaggttaatactccttgcctgttcaaatttttgtgattctatatccttgtcatgttcttgacagatcatgacttgtaaattccatataagatatacatatcaaaatagaaagctgtggagttttcatattatgtcacctgcaattatatttttaagttaaactccctccggttccataattcttgacgttttcgacaaggttgaggtcaaacttttataactttaactatcaataactttgaaatatttagtttaaaggtactagaacagcatatagatttgtcttacaaaatactataataaaagtaaaagtgtatctttttattgtatatgttataatagaaaaatatagtcaaagatgtattttggagaccgtgtcattgtccaaaatgtcaaaaattatggaatcggagggagtagtaatggtggaaggttcattgtctattgaggagaagcattgctcccttttaagtatttttttttattttgatcttcttatgtttttgttgctattgatatggtattagtatctcatgtagtgctcagctcagcttcaactagtattcaattgtgtttctgttaatgaaccctttcaatctatttggtgacagctgcttggcagagtatttaatatcctgcgtgagaataatcctgatcttgctggtgatagacgaagaactgttatgaggcctcctcaagttcttagggaaggcacaaagaagacagtttttgtgaacttcatggatttgtgcaaaacgtatgatctcacttttttaccactccataccatatgctctaggcctg

SEQ ID NO: 53489 - DNA, 2212 bp, Oryza sativa
attatggtgaagctttccttatctgtcttcaaaagagggtttactaatctgttaagagaaatagataaatgttggttttttttaaaaaaacaaagatgtcagagaagccttaccagttgaaattgaagtatccatacagttatctaggaggagttattgggctgttaaccactttactatacattctttaatgccttgggccctatttatttttccacctcccatgtatattatttttttaatgcagtaaggtctagagttaggaagatttggaggggtactatatatatggctggatcgtttattctcttgttccttttatgaggtcctatgtgtgggattgtcattaaagtcttgttgtgctaaacttacatccttttttaatttcactcctttcagatgagtatgtcatatgcaatgggtgcaagagtcctgataccatcctttctaaggagaataggttgttcttccttcgttgcgaacaggtaagctgttcaatatatatttgcatgtccagtcgtgtcaaatgtagttaatttccatacagagagagcttatctaaaggcatctttaatactgcaacaaacatgcccccctgctttgtacagctttacatggttctctagttatattagtccgaagagtttgtttgtgcatttgtggtctactgcaaaccatacctggatttgctcttgagagcattaccttggtctctttttttttgcaaggtccctatcatcaaacatttcctatgaaattgcctacattgtttgcaagtaactaaagttgcgagagctgagtcaattcagcttcttgtcttgcattgctgtaataataataatctatttttgcatatcatatgtatttgataccaatgatgcctatgatgacttgcaagattattgcctacattgtttgacaagtatctttgtgatattaattgcaagtagctgaggcttgagatgctatcacaatttttcttgctgcattgcatcagcactcatacgtcctaattaactaacttgtattgttgccaactagtcattttatttgtttttgtaaatcctgactctctgcttatgatgagttgcaatatcttttgcctacattgtctgacaaatgttgtcatgataatatttgcaacctctgaggcataaagcactgtcattggtttttctttttgttcttctagaataaagaatgtaattcattgtctttctttacctatgatgagttgcgaaatttattgcctgcattgtttgattaaacctgtgagaaaatttgcaacatctgaggataaaaagttactccttttacttgattttctgctggttgttttttctttttttttttcttctagaaaatatgagtgcaattcattgtttttctttaccctatgatgagttgtgaaatttattgcctacattgtttgactaacctgtgagaaaatttgcaacatctgaggataaaaagttacccctttacttgattttctgctggttggtttatcttttattactttagaaaagaagagggcaattcattgccttttttttaacctatgatgagttgcaaaatttattgcctacattgtttgactaacctgtgagaaacaattgcaacatctgaggataaaaagatgtagttcacttggctttctggtggatttttcttaatatatcgagagttttttttgttggcgcccgttagtacaagttgtgacccttgtttaggtgccagtggattgatgtattattgtcatccaaatcatgccatttctcgttattgcttcgtcaagccaaatattgactgctggttttgtttaccctccgcagtgtggttcttcaagatctgttgctcctatcaaggctggattcgttgcccaagttggtcgtcggaaggctggaacctaagttaaacgtccaccctgctcagagcctcggatacactccccaatcatcgctacaaaaacctaatttgccgatttacaacaattattgtccagttttcactgtgtctacaccgttttgtgtatttgtgaccgtaactctgcttccaactctgctgtgaatttcagttttatccgagaccatgaggatcaatgtttgcggccaatcccgtctccttttcgcttattcaccctgtcactttgctagatcattaggatctagggctgatgttcatttgcgagttccggtaaccatcaacgtgt

SEQ ID NO: 53490 - DNA, 1651 bp, Oryza sativa
ccgtccttcagggagatgtactccgcgctcaacgccgtgtcgggccactacatcagcttcggccccacggcccccatccccaacaagcgccgcgcccgcatcctcgaggagatggacaccgcagagaaggccctgctccgcggccggtgaggtgagtgatgattgattgagccgagtgcttacggccaccgatctttctcgtgtgagacgcacgcacgcgcgtgcgtacgcggcacattcactttttgtaactactatactaccgtcgcgtcgcgatggggccgggcgtcggctttgctcttgtcgagtggaatcgaatcggtggaggctttgaaattattactactgagtgtatgtgtattttttttttctgtatgatttttggttcagctgacatggtgaggattacacggttggcttggggacatgcaactccctagagtttccattaattctgtgtctcgtttatacgtcgtgacccggagctccgccggcgtggaatcgcccgatgcgctccggccggtggcgctggttggcatgttgcacgcgccacgccgggggaggcatccggtggggcgagccgtcatgcattgcgccgtcgtagactggttaagcaatggtgtgtcaggccgaacgagatgggacgccgctggatcgccaattcgctatcttcgtcggcgcgcgccccggcaattgttccgagatcgtacgtcaaaatgcccgtcgttagcagaatcaaacaccttgcgcgcatgtcttgtgtttgagcgagaaagtcacgctcacgcagggacaaaagatttcaagttttgagtgaaaaaatatataataccaattaacatgttagtagaggatcacaagacaaaagatttcagatttttttttttggggaaaaccattccaattaataacattattatacatgggtacagccgtacaatacagagagacaagagagctgaatttgttcatctctagcatttcactttgatcttatgcacactatatatcaacacaaaaatgagacgaaaaggaaaatctccaaatggcttttaatcggcaacttctgatcctctccgaagccgatcaccaacatccggttccgggagagacgcgcgccctcttcctgtcacggagctcctcgccgccgtagtagccgttgggtgcaccaccgcagccgtaaggcacgccgccgtagtacatgtaaggatcggctccgaatggcatgccgccgaagaagaaggggtcgacgtagccggtcgccgggcagaacgggacgccgtagtgatcgccgccatggacggcgcgagctccggattctgcagagtggtcgccagccaccgtctcctgcgcctttcttgggccgagggcacctgagatcgtggcgatcttcttcgacgtggacgcgccgccgtcgctgtgctcggccttctctgagctcacgttgctgctgcggctcgcctgcgaagctgcggggctcagcggcgccgccggatgtgccgcgttgctgccggcggagctcctcgtcttgtcggttccacttgaggcgcttgctgccgcgccggtggtggtggcgagcaggttggcgatggtggtgcggagcgtcgtgttggggatcaggtcgtcggcgcgcgcctgcgccccgcacgcg

SEQ ID NO: 53491 - DNA, 5276 bp, Oryza sativa
tttaaatagtattgggttaaaaaattagtgatcttattaacaatcgtaaaataaaggcttgggcattaaaagaggccaaaaaaactctttaaatttactttaaaaaccaaattctaaaatttaaaataaaatgtaatcttttagaaagagatgtgccaagaaggctctaaatcatctcccacgatagcaacaaggatgatagcaacacacatataaggactaaggacccgccaattcagcaacacataaaactcttgcagtctcattgtttgtcctatatgaaattaagcgctgccaaaatttaatttaaaatttaattttggagatgattttaggatatttttgatgtatttactttttcagcatccgacttttaagtctccaaggatatatatatactaatcttgggtcgctaataaatcatttggcattataatgatcagctcgtcgccaatcgatggagctcttgatatttttggattgtccgattagacaaacgatgtaatatatatattcctatatatccgttgtatgcatgcacggccgcacaagcatgacacttagctagctagacacatccaacatcaacacttacttttaaataatagtacaacgtatgtggagaaatatatgtatggcagatcgattgaaagactactccaaaagcactgatatattgtgtgattatactttgtgctcatgtccaattttcgccttttcttctttcgtgagatcgatcgcagagaggatcgaatctatctgccattgatatgtgggcagcgctctctttaagtaatgtccatagaattcagatacgtgctcaaaatatgcctcttcggccttcctttttgtccatataactaatatgttaataatatatataggctttatttttttccttttgcactcccacgtgtggaatcacattttttttgtcctgtttgttagtcgatatcaaaaatatgtccaagcaaaaacaaaagatatcattaatgtatggacttcgtttctcctttcggaatcaaagcaatgcgcataatactgattttcctctttttttttaaaaaaatatggattttcttctccttcaacttgttcttagttgatatacggctgagttcttttttcactttcccaactcatctctctcgtttttcgcacgcatgttttttaaactgctaaacggtgtgtattttgcaagaattttctatacgaaagttgctttaaaaattatgttaatatatttttttaaaaaatagctaaatttaattaatcatgcattaatgcatacatcgtttttaaaaattatgttaatatatttttttaaaaaatagctaaatttaattaatcatgcattaatgtatacatcgttttgtgtaccggagatggactttatttctccctttttcactcggtttcttttacgaaacatttttgtacttaaaattgcagatccaaggcctctgctcgtacattgaatcaaggtgcacacatattcacactctaaataaatatcaattttacaattcttgaggaggcaacatgagatactaaaaatttattataaaatttgatacctaacagtacctaccccctccgtcccaaaaaaaagtccaatcctaaccacgaatctggacacatgcatatgtccatgttagtagctacgaacctggactcgtagctagagtttatctttttctgggacaaggtagtaggtacccagagataccaaatttacaataaaaaaacgtggtacctcatgtacatccttaaagaccgtaaaattgctcctaaataaatggcacactgtcagggttttggttttttgttaccgtcggttagcggtataaccaaaccacttaccaagcaaaaccaataaaaactagacaaattttacacaaaaaatattatcttaaaaaataaaaattaaacttggtgaatatacattgtgatttccgttaccacacactaatagcaaatccctgttgccgaacgtaaaccgacgattatgcaaaccctggacacactatgccaattattgatccgatcgaatgggtgaaagcaaacaccccatgcatctttaccccttttgcacccatgcattgcttgtgaaaaactagtgactacaggcgaccaaagccccatcctgccatccgtatccaatgatcgatgtgactaatttttacacccgaaaaggcgaaaatataatgagcagctaggttgtcgcacgtctttgccgggataagatcggttagttgagagctgcacttcagctagctctcccctgatctgttcattcatcacagaggcgagatggatattcaccaacaaagctaaaacataagggatccgatcaacataatggatagacattgcactttggaggcattgtattattacaccccctagctaacataacatactacctctttttcaaattataagactttctagcattgcccgcattcatatagatattaatgaatctatgtatatgtatatgtctagattcattacatatatatgaatttaagcaatgctaaaaaatcttataatataaaacggaggaagtagcctacatacatgtacaacatgtgtgagtgcaacttccctccttttttttcagtatctttttttttttgcgccaaagtcaccatttggactctagctctcgcaaccccggcccctctccccccccggccggacaccgtctatacatacacgcacaacactgacgaccagctgaaacacgcgcgcgcgcgcccacacacacactcacattctctctgcacacacacaaacacaaacactaggaggagaagcttagttaattaacgtcgtagagagagtcgtagtgagtgagagagagatggaggtgggcatggtggtggtggtggcggcgaaggtgttggtgagcctgtggtgcgtgggggcgtgctgcctcgcggcgtacctgtaccgcgtcgtgtgggtggcgccgcggcgggtgctcgccgagttcaggaggcagggcatcggggggccgcgcccttccttcccctacggcaacctcgccgacatgcgggaggccgtcgcggccgccaggcatcagctggcggaggcgcgacgccgacggcgagcacgcgacagcggcgatggcggcagcggcgccggcatcgtgcacgactaccgccccgccgtgctgcccttctacgagaagtggagaaaagactacggtacgtacgtgctctctcgatcgcctcatcagctgctcgatcgaactcgaacgatcgtttaattaattttggtggtgcatgtgtgcgatttatctatcattgctctgcttacgttggcgttagcgttttaatttattttgttgcctagttagttaatataaaaaaatattcaatgttttcttcaattaattaatcttccaaggaggctgggcacgtactgcatatatacaaaggccaattattagaagaaaccaaaactaacactaatcgcatctgaggtaaatatggctattatcagtactggtgttttcactcaagtttgtttgaccatgatgtactattggactgtttgtctatatatctccgcaaccgttggcgatatcaattatatttgacagtaaatgtaaaagtgagtataagagtaaccataagtatattatattatatttaaaatgtgggttcagggaaccatgggtcccacaaatttaggtactagtagctagagaccaatggaatctgggcttctctaggattggttaaaaataacatcactgagttaacagattatggcagcagccgtgcaactcagtgagtgcaatatactacagtaacagaacacagagtcgctcaatagttgattcattactgagctagccaagccactgagacagaatttcgagtagccaaaacggaaaaggtttaatttcttctttcaatgaaaaaaaaaggtattacgacgttatatatctactgtgtcaccaagtgacatccctttcaggccccggaaatgattacttctaaaattaattaatcaatccaccatttgcatcttgatgttgatcttactttaattgtagccatcccaacgttaacagcttggctaaactactgttcacgtccaactcgttgctgctaattaagcaaccctccccgtcgctgttactgttggatagcaagattacattaggtgagctggccatcaccttcttctacaacttctttggaccctagctatttgatagaaaggtgaagatcatgacaagtatgtaaagatttgaaaggggttaaaatcataaagaaattaagctggaatgagtgtcgaggtgactaattatatatatataagctagtactccctttgtcccataatataatataagggattttaacattttgcttctactgtttgaccacttattttattaaaaataattgtgcaaatataaaaaagaaaaattgtgcttaaagtactttgaataataaagtaagtcaataataataataatttaaaaaattaaataagacgaatagtcaaacaacataagtaaaatattaaaatttcttatattatggaacggggtgaataatagctagccagatcctgtcatgtagttttggcccgaaacgatgcaaaaggacaagtactgctgggatcaagctgagtatacatgctgcaccatgtgcaactctgctcccataaaagtaacctagcctttttccctatttgaaagatcgcagtcgagcatgcatttaattaaatctgttgttcagatgatatgattgcactagaatgcaatcatattaatttgatgtacccggcgattagtcaaatagttttagttaccgcaggaaattgaaatttttgccagcctgttcagatgcactagacttccacttaaaaccaaggagaaacttcttcgttagctttccagatgcccttcggaattgattgattccctaatgtgctctcgtgaaatttgctcctcattctcattcttttgatattttatttgtcctttccgttagctttccatcaacctaccgtcgttagtaggcgggtgaaaacacaactttttccccttaacttgtttcatgcatggtcagcaatttctatactagcttgttatgcacaaaaggttgaatttctctcctgaacctaaatggtattttcgtaatcaggagttatgcgaaattctttaaatttagtatattgtgtgaaattcattcccattgaccgctggtcatcttataaaaaagtcgaatttaaattttaaaacttaa

SEQ ID NO: 53492 - DNA, 1585 bp, Oryza sativa
atgcatgcgcgttgacgagtgtgaggtttggtttcgttgcagctcatcggcaagaacacgttcagcatcctgatctgcttgtcggtggcgatcacggcggtgtcggtgccggtggccggttggctgtacgatccggcgcggcgctacgccgtgtaaaagcggcgcacggtgcagcatctcaaggcggacgccgacctgcggatcctcgcgtgcgtccacgaccagtcgcacgtccccggcacgctcgccgtgctcgaggcgtcgaacgcgacgccacagacgccgctcagcctctacctcctccagctcgtcgagatcgccggccgctccgcgccggtgttcatcccgcacaagctccgccacagcgcctcccgagccggcgccgcggcggccagcgcggcgccgcccaccgactccgaccgcatcatcaacgccttcttccagtacgagctgaagcacccggagggcgccgtgtccgtgcaccccttcaccaccatctccccctactcctccatgcacgacgaggtgtgccgcctggccgtcgagaagcgcacgtcgctcatcctcctccactaccacaagcgccacatgctcgccggcggcgtgcgcgccgccgtggggctccgcgtcgtcaaccgcaaggtgctggaggtcgcgccgtgctccgtcgcggtgttcgtcgaccgcaacgccgggagcgtcggcctctgcgccttcatcccgggcccggtgcaagaccaatcgacgtcctccaggagcaggagcggcgggcacgcggccagcggcagcggccaaggcttcaaggcggccgtcgcgtcgctcttcttcggcggcggcgacgaccgcgaggcgctggcctacgcgacgcgcatggcgcgccacgagggcgtggcggtgggcgtgatccggttcttgccggcgcggggcatcaaggacgagccgtccgaccgccggatcgacaaccgcgccatcgaggaggtgaaggcgctcgcggcgaggagcaggaacatcaaggtccaggaggagctcgtcggcgacatggagaggatcgtccaggtgctgcgggggctcgacgaggcgggctacgaccttgtgctcgtcgggatgcggcacaggtggtacccggtgatgccggcgaacgggatgtcggattggagcgagtgcccggagctcggcgtcatcggcgacctcctcgcctcgtcggacttcgacacgccgtactcggtgctcatcatgaagcagcaggaccagggcgggctgaacgccgccgtgccgggcgcccaggacgtgtggcacgtgaacgacggcggcgccgaggacgcgccagcgccgccaagaaacatgtcaaccgccggatcttagcaggttcaggcagtaggcgattgttctgttctagcctctaggacctggttcaatgtagactttcagattccctttttgcgtccaagtatgttgtgatgtatagctatcaggattagcatcaatccttaaactgagatgagatcttaagattatttcaaggaaacagcattgtgtatagcagcaatggaacaaatgcatccaatgttaatttgacaattcagtc

SEQ ID NO: 53493 - DNA, 1020 bp, Oryza sativa
ctacagtagtcatgtacagttgtacaccatttgtcttacctcatgatttcttcatggaggacaaaatacaaacaatgaggatgaaaggttaagctatgaaaatcaccaataatgggacgcagatattcaccaggatccatgatagaactccacaaaccctgtagtagaagctgcaggctgcagcacgccagtaccataacgtactgatcaactgatcacttagctgctccttcaaacaagtgctggatgcatgcctcaacatcttctggggtgtatttgatgtacaagtcatgcctggcttcgggggatgatttcaatctagaaatcaaggctgtatatactggcattacagcttccgccactgctgccctaacatccacccgcagctgttcatctgctatcacccattctgattgtacttcatagatctcctgaaagtaggtattaaacatccggagtttctgcttcattgccgtggcagggagtccacctactccaggaccgccagtctgcaatactgttgtgaccttgccccatgttacccgctggtaatccatgctccaacgccgcactctgtttgtcatttgcttgatccactcgtcaccaagcaaaacaccaagttcactatcattcaccttctgaatgatgtacttgccattgttcatcaagaagacgcaagcgagtgatggatctcggtatatcttcgactttatatctaaattcttgtgcaagacatccatgatccatgctatgtgcacagcaagcgacgaggtgggacgatcagggtcaactgcagcagccgctccaccaacagcgccgaagtcaccttccatcacctcttccaatgtctgccgcgacccacaagcagcacggagatagttcatgacataccgagtgatgggatgtatgcctccaccttgggctgcaactcgagcaggatcacggcggatgagattttctaactccatgaatatgcctttgatcgatgagccgagggtgttgcacaccgccgtgacctct

SEQ ID NO: 53494 - DNA, 3663 bp, Oryza sativa
  unsure (1)..(3663): unsure at all n locations
nnnnnnnnnnnnnnnnnnnnnnnnnnnnnnnnnnnnnnnnnnnnnnnnnnnnnnnnntaatgtctgccgcgacccacaagcagcacggagatagttcatgacataccgagtgatgggatgtatgcctccaccttgggctgcaactcgagcaggatcacggcggatgagattttctaactccatgaatatgcctttgatcgatgagccgagggtgttgcacaccgccgtgacctctgcacggagcgcagcagagtacgggtcggcgaacacaggatcaaggtcagggagaaggtcccgcacagcctcgtacatgtccaccactcggaagaggcgctccggagcgcggctggaggaagagatagcatcgccgaatgatatgagctgcaaggcttgtgtgcgcacggcggcgacaaaggcaaggtccccaaagggggcgaggccgtcgaagacgcggtcacatagccggcgctcactgggaatcagaatacggaacaccatgttgaaggccgggatccagcgggcgatgtcgaattcgagctcctcccaggaggaggcatggacctcttcagcagttcgtgggcggacgccgaggcgagcaacgctctcgtcgacgaagccgcgacgcgcggcggcatagacctcggcgcactcgcggccgaagccggcatccaccatcctccgcgcgatctggtgcacattcgccaccgaccccggcgagagcgcgtcgatcaccacgtcgtagtcggtcaccggcttggcgattgggatcggctcgtcgccgtagccgtcccgccgacgaagtcctcctcgtcgtcgctcccgtccgaccggaacccaccgggcgccgcggggacccgcgtcgtcggggcgctcatgagcgcccggaactcctcctccaggcgcgccatgcacctgctgagcagctcctccgcgcggtcgaacaggccgcggttggtccccgcggcttccagctcctgcacggtgccgatgaggtcgtcgaccgcctcaaggaacgcgtcggcgtccgcggagtccgcccatatcagcctgtccatcgccacgaactgcgagatctggcggtcgagggtgcggacggtccgctccatcgacgtcacgggcggcggcctccccgcggccgccgccgccgacaccgcagccgctggcggcggtggcagcggcagcgtcggagactccggcatcgagtgctcccctcctccccctaagccgccgccgccgccgccgccagcggccgaggccgccgcggcccgcgcggcgtagagcttgtcgagcgagaggcggccgtcgtagttggagaagaccctgaggatgtcctccgtcatggtgtcgctgctccccagcgtctgcacgatgtgctgcaccgtcgcgagcagcttctcctccccgtcctccgccatcgcctcagtaatccgcgccggggaaagaaaaaaaaaacacaagcagacgtcgagctacctcacctccggggctggaacggcatcccacggcgagcggcacagccccgatctgcacgacgccttcacctccacgcggcttcgcttcggggtggtggttgggcgcggcggacaaggggatgaggaggaggagggcttccttccacgcagcaacgcgttgcggcggtggcgtctgggcgagggcgacagcgcgtggaccggacgctttaccgcacagcggcgcgcaagttgtggccgccgcgtcggggttggttcgaggcggccgtcggatgcggcggcacggacggtcggatgcgtggcctcgggggaagcgaaaggcggatcggaggacgcgcgtgacagaagaaaccgcttttctgacgaggtggggccccgggaactagtgtcagtggagcggtgggaccagacgatcggtgggtttgacgcgggagagaagccggggtgtggaggctgaccgtcggcgtggcggacgatgtggcgcgcgtcgcgtccacggtgcgttttgcagtatggagaaaaatacgggtcacacgcctcacacgcgttgcggaatagccgtaggccgtaggcagtgacccggtgtacgccccgtagtttttttttaattttttacaagagactttacgcccagcttttacttgtaagagttcttattaggccagtagttgttgacttgtgacttgtgagtttaggaaattagaagtgtggaaaagccagctcaccaggttgggttggtggatggttcgttctccgtccacatggatgattcgttggctttggtttggtggtgaccaaacgtccaaaccatgagctcgatggtgaactgccacggatcgaggccgtagcaccgcgacattgcacatcgcactctgctgtacttttagagcccgattaatgaacttggagcaagtttaatagcatagcacatcgcactttgctgtcctttgagagcccgataaatgaacttagagcaagtttaatagcatagctaactactggcttcaaattatctatagctaatctaagagtaagtttaatagtacagcccactactagctccaatttatctatagccaatctaatagccaatacatacaataattgcttactatactattaatatatgatcccacatgtcatacacacagtgtgtcttggagtccgtgctgcagctgactatagatctgtagcccgcttcccttctctctcatcgtttatcttattaaaatatgtttatagctggctaatagtctgctattgtacctactctaatagcccattcatactacaacattaatatctacataaataatatctttgagtccgtgttgcaactggctacaaatttatagcccgctttcttctctcttctcttttcttctcgatatgtgggtatagctagcttataatctgctattgtacttgctcttagggtccgttcggttggagtattggactgttcggagaacaaacaaaatacaaactaggtgatgccctacgttttgctgtgggaattactaagtaatttctactccctcagtttcataatgtaagaatttctagctctatatgtattcatatagatggtaatggatgtagacttatataagtctagatccattaacatctatataaatgtggatagtatatatatatatgtgtgtgtgtatgtatatatatatatatgtgtgtgtgtatatatatatatatatatatatatatatatctttcaacaatcgagcaaagagtaagtatgttgttaattattaacagcaaatataaaactaatttgtcaagccatatttgaagagaaataaatttaataaactttgtagagtattatagatgaaatttatgttgttggccaagatttgtatcgcaagaagcagaagaaaaaaaaagaaatgaaaagctagaatttattagtagtaaacatgaaacaaactaaataatatcttcgctttgatacagaatatatggatgaatgtatgttaagtattataaaaaatgatgaatatatttgttgaaatattatggaaataacgagagaggtgatggttggatctatttgcattttgatttgtagaacaaaataaattatggatgatattacatgtttgcatgagctatttaataggtagttattgctattggatgataaggtgacatgtttgcatgttgagctttacgg

SEQ ID NO: 53495 - DNA, 900 bp, Oryza sativa
  unsure (1)..(900): unsure at all n locations
nnnnnnnnnnnnnnnnnnnnnnnnnnnnnnnnnnnnnnnnnnnnnnnnnnnnnnnnncccttccctgccgccagatcgaggaggaggtagtggcggcaccggcggtggcgggcgcggtgctgggggaggaggccaaggcagaggtggaggaggtcgcaacggacgcccgtctcgtgcggtggccgacagcggcgaccgccaccacgacgttgtcctcgtgctcctgaagcggtggcgatggcggcgccaccgcagcgcggtcactgctccgccggatccgatcatcgttgccatcgcggatccgtcgtcgtcgtcacctctctctctctctctcttatcgccacgccgccggtgtcgtcgccgcggatccggtgtcgtcgcggcccttctttcttttctttcttctcttctcttcgccggtcgtcccctacgccaagcccacacggccacctcttcttcttcctctcgcctcctcctttgcatccgcctcgctcccttctcttcccatggcggctgctactgctctcacatgatcagagatggtgatggctagcgtcggcatcaacatgccgggtgtcacgcccagaaatttagcccaaatttctagactattttgtgtattaaatccatgtccaggcatcaaccaaggtacacaaaacgacaaattaatatacagatccaaacgtaaataaagcgtaaaatacttacataataggcagttagtcctcacaccgaaacgaaagcagcagcagcggaaaaaggcgatcttagcggagcttcagctccactccacaggcaaaactcaactggggtctgagccttggtnnnnnnnnnnnnnnnnnnnnnnnnnnnnnnnnnnnnnnnnnnnnnnnnnnnnnnnnnnnnnnnnnnnnnnnnnnn

SEQ ID NO: 53496 - DNA, 997 bp, Oryza sativa
  unsure (1)..(997): unsure at all n locations
cccccccccccccgccgctttcacgactcgcgtgacgcgcgagtggggccaacctgcagagtcatgtggccggagggaaagtaattcccctctacttcacgtacccctgggcccatatctctgacagtagcccctgacgctatatcagatatcgatttcctgggatcgttctaacatggcgcctcacgactcctcgagctggggttgtgggcccggcagggaatccaaaaggatatcaccgcgtggcctggttggcgtactaaccacaacagcggtttgaccgcctctgactacgctcatgataaagacgcttgaggcacgataaccagggggtcagttagaccacgcctagattctctcgcccgctactcctgcggcggtagcggtgacggtttgcccaacttgtgctcatggccgttgcaccctccacctcgagtgtgccactaacgggcgcactaaaggcggaagcggatacaatgggcgacgtgatgattgggcgcgggatgcgaagagacaaatgcgggcgtgaggatcgtgagggcagttattggctcgcgaaatgaggaggtgagcgcggatgaggcgaggataaaagggggcagagaaggagactctgtcttcttcctttcgccaaccgcccactcgtcctttcgcttctcgaaccctaatattctcgccacctcacactgtctcgtgctccacgctctccatcacctcttcgccggttgccatggcccaagacaccggcgacgcagtgctcccttcctcttgcatcacggcagacaggcaccttagccttccttgcaagatcatgccggcggtccgtcgtgcgggcgggagagtcgaggccgtggccgcgatatccggagcgatccgtgcacctcttgtccttcgccatggtaggcttgatcccgctgttctccagattcttccatgaagtnnnnnnnnnnnnnnnnnnnnnnnnnnnnnnnnnnnnnnnnnnnnnnnnnnnnnnnnn

SEQ ID NO: 53497 - DNA, 1781 bp, Oryza sativa
gactttttcttcaagagtgcggagaatatctctttcttctttgagggtaagtgaatttcatctcttggagttgtggagttaatattcagtaacattcatcagttatgctatctgaacaaggaactggttggtagttaaaaaaaaacaagaagataatgtgtagttagtagttacagacctattattgtcgaactgttcttctggttctgttgttgatttacaatggcagcatgtggaggtttacttggatttggatagtgatttatattttatatattttcctgtttcaattactcacagaaaaggcatttggagatgatggatgcttgaaacaggcaaaggaactttcaattaataaagttgggcacggtcagtatgccaagtagaaattggttatacatgtgtgtagtttgtagaatgattgattgagtcttgcaagattattgtgttgttcatgttgcatgggttggaaccagatgccacttgctatacaagttgtaaattgtctagcaggatgagttgttgtgagaaacagtcggggattttcttacttaaatatagaagtcgaaaattgtaatagacttctctgattgctcaaacaaatatttacattacatctaggccaaaagataacaaagctacatcctaaacaagattgcattcgatccagaggtgctggtggaatagtcttataaccactcatgtagcacttttgtggataatactgttcttctgaacataaattttattgttcaaccttgctatttctgctgtttgcatttccattaatctgggttaagacaaattttcttgagtttggtttatttttgaatttgcctgtttggttgctattttctagttaacgttagttagtattttccatgctttgaaaagcttatattgtttgtatacttgtatatttataacaatatatcttgaggtattgccattcactgctcagtaatttttgcagcgttacatgaacttgaccctgtgttcaaaaagttctcttttggagagaatgtttccagcctattctcttctttacgctacaaaagacctgcagttattcaatctatgtacatctttaaggtatcttgatcagtctctagtttcttgttggcattgactacaacttttattccttattgggttaatttatccacaactcagcaaccaggcattggtggcgaggtggtgccacaccaggataatacattcctatatacaaaccctccatcatgcacagggttgtggcttgcactcgaagatgcgacaaaaacgaatggttgcctatgggcaattcctggatcacataaaagtagattttcgtaccaaattatttcatgtcaagaatcctcttgtggttatctgagcttctgatttgattatcatttgcaatgctttgcaccagatggtctgaaaaggcgaatgatcagagatgaaaatgatactcattttgatcatccttcgccaacctatgatctgaaagaatttgtgccattagaagtaaagtcaggtgatttggtggttattcatggagatcttgtacaccagaggtgaagttaccctgttatattgcatagcttgcaatcaactgcttcattttttttactaatatgttttaactttttttgacagctttgaaaatctttctctggtgtcaagacatgcactgagcttacatgtaattgataccgaaggatgtgaatggtcccaacaaaactggttagtttattttaacacttttggagaattcaaaagttaaaattcttatttgc

SEQ ID NO: 53498 - DNA, 1750 bp, Oryza sativa
  unsure (1)..(1750): unsure at all n locations
tttgacagctttgaaaatctttctctggtgtcaagacatgcactgagcttacatgtaattgataccgaaggatgtgaatggtccaaacaaaactggttagtttattttaacacttttggagaattcaaaagttaaaattcttatttgctctaggtggtctttgcatcacttactgtccacagtagaaatctagaattgcctagaaacaagctattctacttccaagcttgtcctaaattgctcaaaccaagctacttgctttagactgtataatcttatactgcataatcttgtacttgatactgtatgatagttttggcgtagcctgtaacacaggacacatattggttacctgtacctgtatatgttgaaacaaggtattgtgccgctgtttgtatttttacgaatgggaatgatgttttactttatctttcctgtcaatcacttacgaatgggaatgatgttttgctttatctttcctgtcaatcacttagaaactccgaagacagaaatttattggtgtccttgtttacgtcactgttagcagaaaaattgtcgataacaagaactccatcttaaacttacctgcttgctctcaattttgaagtggatactacaccagtacacctcataaaacatcgtaaaattatagctatcgatgtttcataaacttttccacctttatttaaattttgctaacaggcttttttatgcttgctcaggttacaaaggaaaatcccacctcagccactttatgaaaattagtacaagcagttacctatgtgtcaaataaacgagtgatgacctagaagcaatggtcagacaatgtaaataccttgctactctgttttcatggatgttttttatggcaataaatttggtgtacgatgttgagtagctatgcttttttccccgtcttcagacaccaagtcacacaactacgttgctactctgtttccaggggtggtatttatgcctaataaaatctatctccagttcttaatgttaccaaatggcgacagcaaatcagcaatgctcgtcatattttcaaacagacactgattgtctgattagcccattgttcggtgaatcgtggaagcggagcaacatttctttagatttgtttccactgctgttcttgcctgatttttaccatgtcgtctgtagctgatcctaggagcaagcggtccaactccgggagtatctgccgtatggttgttacagttcaacgggactaataaacagtattgcaagttaggctgttaactaatcacatggtcataacatgtacttcctccgtcaaaaaaaaatgcaaatcctaggttttcgtgtccgtcttgtatgaaatttttttataattcgtatttttattgttgttagatgataaaacatgattaatactttgtgcgtgacttgttttttttaatttttttcataattttttcaaataagacggacggtcaaacgttgggcacggaaaccagggtttgtctttttttttgggtacggatggagtattattgcattctccttaataaacacagctctcaacgactctgtgttaagaaatcatgcatagtttaaatactgtgcatcaggatatcctcaatgtttatgcaaaaataaagagtaaggtgagctcgtgtcagatgctacaggacacttaaaaaatgtgtaattagctggtagacnnnnnnnnnnnnnnnnnnnnnnnnnnnnnnnnnnnnnnnnnnnnnnnnnnnnnnnnnnn

SEQ ID NO: 53499 - DNA, 1255 bp, Oryza sativa
  unsure (1)..(1255): unsure at all n locations
nnnnnnnnnnnnnnnnnnnnnnnnnnnnnnnnnnnnnnnnnnnnnnnnnnnnnnnnnttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatagtaaacctgtgagatgacgcggtggcggacgagcttcgcgcggtcctcggcgtcgtcgcagtcgtcggcggcgtcgttcggcatcgtcgccgacgcgatcacggccgacgacacgccgtgcgcgttcccgcgctcgtggtcgtgcgacgacgacgcgtccccgccgcacgcggcgacggcggcgacggcgccgcggctgtcctgcgcgcgctgcaggaagtagcccgtggcgatcgtgtcgaggaggagcgtggccacggcggcgagcatggcgacgagccccgtgaacgggtacttccgccacggcccgtccacgaggcacggcgagccgagcttgtcgaaggacaccgggaggatgtgcacgaacgccgtggcgaggatgacgccggcggcgaacgccttgagggcgaagaagaggctcgtgtccgggcggagcgccgggaacctccggccgagcgacggaatggcgcaccccgctgagctgcccacgaggatgcagaagatggcgatgaccttgagcgtccgggacttggccgcgtcgtggccttcgtcgctgggctggcactcgcagtcggcggcggcggcgagggagaagacggcgaggaggaggcatgcggttagcttgagatcgaaagccatctttttagcctgtggccaaagattggtgatgatcgaacaaccaatgtggagatagtatccgtacagttatatggatataagggcagtctcaaccctccatctagaatggtgtctatggcattaacttcattaccatgtaatacttttagcttatgtggtactatattaattannnnnnnnnnnnnnnnnnnnnnnnnnnnnnnnnnnnnnnnnnnnnnnnnnnnnnn

SEQ ID NO: 53500 - DNA, 1261 bp, Oryza sativa
catcgccttccgatggccgacattgttctatcgcccttagttgtttttcatagtgtcatcggttgtggcttgccgatgtataattgccgatattggtatatcgcccttagttgtttttcatggtgtaatcggttgtggtttgccgatgtacaatgaccgatattgttatatcgcccttagttgttttataattttatcaatgctcttgacattgtaaaactaggggggcacatatatatcaaaatgcagtgcaaaatttttgagcaaattttgaagtcatattaattggcacaaaggattgttaagacaataaagtatcagaatgtcttagccgattacaaaaattctaagtcctattacacaaagattattaagattagtatcgctggatggccgatatagccttctgtctaatctgttctacttcttctatggcttgggcatcctgagcatcggttccagggacaactttcagagacttggtcagttcaccaacatgcttgatagcggatttgagtcttgctttctgttcttcaatagactttgggagatcggctagttttttgtgttccatgtccagctcagcgttgcattcttcaagttgtgctaagagttcaatcttgcgagcctcgagccgatcaatattagacttgaatgggccttcagatagttgatcgagcttggatttttcttcatacacaagttgtcggttggcttggatagtggcctcaatgtccttacgctctcgccattccgccagtcttaacttggctttctccaatttgaattggtgttgctcaaggtaaacggctggggtaaggatatcggctagctcatgtgggattagagcctgaatctcatgtagccgagccctgattgagccacaatcaaccaccaagctatctagcgatgatgcttctagccgacccaagatacttcctagagttttcttcacatcatcagataaaggggctaaggctttgcttgtggtatcttcttctccttcatcaagatagtctctgatgtcaaaagagaaaagatcggctaatacctgcagtgacaatttagaagcagttagaaacagtcatagccgatctgaatgcttgttgagacaaaaagaaacttactgggatagcaggagcagctggttgttcttctttctcgacgtgatgacaccccacaatcggctaagacattctggtcacttgacgattgttgtacaggaggagggtaaggctgaaaggaaactagtgtcagacag

SEQ ID NO: 53501 - DNA, 1686 bp, Oryza sativa
tcccggtgaatcccaatgagttctcgctgatgtcttcgctcgcggaactggccacggcgatggaggagatgtcacgcccgaaatttctatccaaaattccaaacgcttacatgtgtgtgaaccctcgtccaggaatcagccgaggcacacaataacaaattgataatagagtacaattattactctaattaataagtgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgcaaggtgagtatatgacatactcagcaagccacgcagcaaatatgcaagtgcacaggataccaaaggatggcatagtagggtttcatttgcataaacagcatttaataaacatttcagaatttaataaaacggttaagtaataattaaacaatattaatccaacgctatacaacataccctattgtataggccctaccattctgaacaaccatacccggctgtacagatctatctccaaaccaggaatataccattccaaaccaggagctaatcaaattattaccagttatacatcttttatcatgatgagaggtgtgagactaatcacgaaagacattgttaggcgtgcccataaccgcgggcatggctattcgaatagttttactatggccagaggtgtaccactgtacccacaagacacagccccacaacatgtcaccatgtgcctcaataccaccacggtacctcggaaaggagttgtgacaataccccttgcacaacacaatccaccacagcgcacctttcctggatcataatcacccccttataaacaaggcatggactccccagcgacccccgtgggcttatctccgccacttctcagtctggtgctccgcaatgaaccaagctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattgtcgcgaccgagaaaattgcattttcccgaacgctagtgtattaatccccgtcccaggaaaagccgaggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtgtaagccaagactccacctaagacatcttctccaaagcttctcttactgaaggggggagaaagatagagcaagaatgagtacaaccacagtactcagcaagccacaccggcggatgcacgattaatgcaaggggtacaaggggtaatgatataggggttaagttttgcagaaaacagcatttaaaagtcacttagttgcccaaagccattttaaaaagacgatcctagagctacacagtattattaatcaaggtcgttaacccgcacgaacttgccttaacccaaggcctacgatgattca

SEQ ID NO: 53502 - DNA, 1005 bp, Oryza sativa
  unsure (1)..(1005): unsure at all n locations
cctggtacctgggttgctactaggcaccagacactggtaccaatatttgtgagggctgatactggtgcctgggtttagacatgatacctaggacaagtctggtacctagtaccagttactgccaggtactagacttggtacctggtacctggtacttggggttacaggcctggtacctgggttgctgccaaacactgataggcatcagacactgtatcagggtggcatatctatgtggagtaaaaaaaaatgtgtcacagaacattgcatccacacaaaccaagtatctttgaaatgaacacataaaagtgcatgattttataactgcgacagctgctgtcattacatcatgaagatttttcacattactgttaaaaaacaaaaacacaaaaaaagctatcaccacatggtcgcccccctaggtgcagtgaacaaaagcgtcaaatacgtgcttttgacaacgctggtactacatagttaactatagtggactntacatagttaaaaagcaaccatcgctcattttgcacgatgtggatgtaggtcattgaagcgatgctatatcaacctgtgacatagctgcttgcgataggttggaatgcctttctgaggaaaaaaggaaacaatatgagaatccaatgaggtttatctctgtatgaataaaaaaacccaaaaacagaaaaaaaaatggatttaggtaccaagaccacttacagaagtgtatccaacaagacttcggccattgtgacactcgagcattctcagaacgcagaacccgcaatcatgactaggtagagaaaataaaaaaaatgtaaaacttataaatgtgtacaggaaaaactatggtgtaagttagttaaatagaacaaaattgttgatacttacagttctacttggtaaggggtttcagggtactcgactgtggataagtcaccaaatccaaatgggctactattcgttcccgtgtcaagagcaacttggaggttgctacactgtaagaaaaaa

SEQ ID NO: 53503 - DNA, 918 bp, Oryza sativa
ttgtaagagcttggtaaggtgctccatttggctgagttgttgaggggcaccactacaccgcgtagcagattattagggataaccttcattatttgttgttgtttttgtgttggcaatgacagatatgagtggcgctcaaaatcagcgataccaacaaggtgcacgtgatgacagtactttggtgcaacgagtgctaagttctcaaatggaaaaagcggagcaatggcagtatcacgaattatttgaaacaaagtttgtggttaaggatagagcatatcgtactataatcgataatgagagttgcaataacttggtgagttcagatttggttgagaaacttgagttgcctacacaaccgcatcatcatccatattacatcaaatggttcaactcttgtggtaagttcaaggtaaatagaattgtgagaataaacttttcgattgaaaattaccatgatactgccagttttgatcttgtccctatgcaagcatattctttgttgtttggtcaaccatgggtatatgataataatggtttgcataattttgttgctaatacatacacatttagacataacggttgaaaaatgaaattggaaccaatgagtttttctgaaattttcgaagataatcttgaaaggatgaagaatggaatcaaagaaattttcaaagatagtattgaaaggacgaagaatagaatcgatgagattttcagagataccaggaataatactaatattgtgatgccttcaactaagtctgagttgttacaaaatgaacgtaatgttgtgcctattgttttggatactaatattttgtaggcatctgagaacaaccaagttagtaaggaggaagagaagaaagatggagaggaaaaagatctatctatagctacatgcatgcgggaagaatgttcaat

SEQ ID NO: 53504 - DNA, 2250 bp, Oryza sativa
agtggaaccgattgttgaaatacctttgtcacaaaacaatttgcttgatgtttcttgtgataaagaaaagttgtgcgatgcttcacttatatccatgcaacaactagtgaatgaacatgttagttctatagtagagccactatgtgttgagtttaaacatgttattcacattgctagcgagaatgaagagcctaaattgcaatcttctttaaatacttggggttatattcaatttgatgatctttgtccactcaactgcttagagaagaaattatttgatagagttgaattgccatgcccttctgatgtgatttttcatattattggtaattatgatagtaaaggagaatataatgtgcatcgagtatatatttgttcgaatttgactatacctcattttcatgataaaatgtattgtcgagaggaccgcgtgcatacaagtaattctctatctagttcctctagttgtttaaatgagttaagggttggtttgcaaaaaggggagtgttgtggtttttcgactacaaagattttaggatccaatcatatggccatcaagaaatgttccgcacaggatgttatgatagacaaagataagtacaatacactccatgacaaggtgaaaccgaggacggtttccaatcaagaagggaaggatgatgaggacataactagctctgatataaccatgactaccttatgtattaatcaaataaaggtgcatatgttctacattagatttacttgttatatatttgaacaaacgttgctacacaatgagtttcgtgtgttttcatttgcagaggtagttgcttgggcgaaagaaaagagaccgagcgtaactaataaatggatgattgaagaagttgattagggaccaaaccaagacctctccaagtctacttctacctcaccacgtcacttttggtccatagaagacaagagataaagttctacatattttggattcgaattcgggcctcctgatagcatcaacttcaaatggacctagccgctgatctagaaggaatttcgggacccatgagtacttgttggaaagcttatggagtctaccttcagatggttttggtcccacatcaaaattcctaccgagctgccgggaatctgcaaaacaagccacgtatctcatccagtccgaatctgactcgggttttgggccttttaattgtatcgtgggcttagcccaagggggtgtgcgccctagggaaaccctaggacgtccctaatcatattaattcagtagccgtcatcgtttagagttgggttttgcttagattattctgtcaagaacagtttcgctgctagatcggtttgtggaaccccaaattcgagtgcttaatcattcatatgcaatttggttgcaatctatcttgttcttgcttgtgttcttcgattcgcatgcagggattagccttctcggcgaggtcaaccgggtttcggcacgattgataaccagaggagacgtggtgctgcgattgcggggctcagtagcgtgtttgttcagaagccggatcgagttgtgtcgcgactccgcccaaatcgttgtttatcaatacctatcggaagatcgggacctaatatccctcatcagttggtatcagagcgtggttgcccgttaggtaatttatcttcccataaccagaaaattgccacacaaaaatatttattctttacctagacaatttgagccgttgcattgttctattagattttactttgttgaattctaggttgcatcgtcgtgtcgagtgctggtttagttttagatttaatttttagttttgagtattgcatctgttcatcacttaggtctagggtacatcactcaagtgtgtgagttgtacgtcagttttgggtccagtttttcatctcgtcagttgttgccgggaccttgaaaaattgaatcatctcgtcgtcgggtttccgtttttgtattttggagaaatttttatccaacggtttgggagttactcgatttctagagctcctatgttgcattgtgcgcgcgcgtgaggggagtactctgtgcgtctaaggagagactccggatcagatcagatctatctgtgactatccgtattttcctttatagaattgttaagtagcggatttgagatatttgtataaaaatggaacctacatgatatgagcaatccatttttgagatgatccaattttagttttgcactttgcgtttgagtccctatatattcatatttacatttgagt

SEQ ID NO: 53505 - DNA, 1103 bp, Oryza sativa
attcaatatgttcaaagatgatgtgacttgccttgctcgctttcccaaacgccggcttcaacttccacgaagagcggatcctccgaagctgcagcgtctgcacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgcgtcagccgaggggaggggcgcgcggaccgggtccacgggggtggggcccacgcggcagccccacagtccacggtggaccgggcgcacccgggctcacaccggccggcgccgtgggtcccacgcgtcagccgcacccgagggcgcgggcggctgacggccgggccccacatggcagccgcggggcgcgcccgaaggcggccacgccggcacggccgacgggaggcggcgcacccgcgccccgatggtcgcggcccgcgaccaacagcgcggcggagcggcgcccgatacagaatagggaaggggcaagcgaaaggagcggtccacggctcaccccgggtcaacgaggacggcggaaacgacgaccgaagcggaggaaggcgtcggcgcggttcggatcgacgaggacggcggcgctccgacagtcggcgggctaaacgaaggggtggccgaggtcgacggggacgcggcgaagccgaaggaggtgacgccgagtcgggaggaggtccagagcgactacggcggcgaaccggagctcggcggcgacggcggagagagaggaagacggcgcgggcacgaatccgacggggaggagaggcggcgagtggcggaaacggtggaggagagcacgggggtggcttaaatagggttgggagtgagggaaggcggccggaggagatggaaaccggcgcggaggatccggccgccattgatggcgccggcgaggtttgcgggagtgaatccggacgaatccgagggagagagagagggaaaaacggg

SEQ ID NO: 53506 - DNA, 1353 bp, Oryza sativa
  unsure (1)..(1353): unsure at all n locations
aataggttaattccacccaatgacattcgaaaataaatgcaatagttgaatagaaacagtagctttaaacgggatcaacatgctcaaagggttgtttgggatctgtgtgacttgccttgctggccttggaactcttcaaaatcttctcctgcgaaaacagactctccggaaacgtcggaatctaaacagaaaggagcaaaatcaccaaaacagcacataaacaagcatgaacagtacatgtggatatttttaacatgtagatcttaattttagaaaaatttagagacttgaaccaactaaatccgagctaagatgaattagttacgaatttttaaagattaattcggattaaaacacttatatgaattttaattatgacgcaataatgaattatttttgaaaaggaaaagggaattattgcgtcagcggctagggtttgcggtggaccgggcgcacggcagcggttcacggaaacggacggccgagatcgatcttatccaaaacgaacggccgagatcgaccggtccacggccggaccacgagagacgacgacgatgacgtcagcggtgacgtcaccaccggcggcggctcgggcttgcaaactcgccggcgaacgacggcgcgacgacgcgaacggagggcaccagcacgtagagggtgacgcggcgaactcaccggtgaccaaaacggcggcggaagatcaacggacggcgacggcgtcaaggaagaagcggcggcgaccttcggcttgacgacggcggcggtgttccggcggtcgacagcaacggcgaaggggcggacgaggacggcgacgcaacggcgaccacgatggcgacctccccgagcgacggcgatgactggagcgatggcggagcacggctggagcacggtgacgacggcgtcgcgaggctacacggggctagagcgctaccgacggcgagagacgaaagcaaaggtggcgacgggtagcggagacaccgggggtccttttataggggttggagggcggcggcgaaggcccacggcgaccggcgacgcgaaggaaaggttagggttcggaggaaagaggccgatccgaatcgaactcgaatccacgaatttccaaagcgatttagacgatgtttccaaaaaggaaaaggtagaggagatctcgggaaacatttcccctcaatggatttcaccagagaaggaaaggggcggccgaatttggaaggaaacggcggcacggctcagctagggttcgggcggcggcggcggcggcgcgaggttgacnacgaccctgacaggtggggcccacctgtcagcgggagagagagagaagagcagcggctcggttgcggactgggccggctt

SEQ ID NO: 53507 - DNA, 903 bp, Oryza sativa
agcagccagttaccaacaggcccttcgccgatatcacgagaagcgcatcagagcacgcacactttcgattagtgactacgtcctctgacgggttcaaagccaggcagggcgtaacaagctctcacccaaatgggaaggaccgtacacaatcacgcaagtcttgcggccgggtgcatttaagattgcagacggtgatggccgcgagttagcaaattcttaggaacattgatcaattacgtaaattctatgtataaatcaatagtatccatacttgtaagacatcttatagcttcaataagatttatttttaggtaaagattacaatcaaagtgttccttcccgacgatccctcaccacgataacacctagcattgaaacctaacctcatgtccctttacgccgtcttgacaaggcctccgaggaacctaagggaacttcggctggggacactcagagccgataaggccttgtcggatcatgaagggacaaaagaccatgtaagatcaggtcgtgtaagagttcttgccgcgcgtattaaccaagccgtgtaatcggaaattgggttttccaacttcactgctgggggctaggatcagtgcttgttcaaccaaggcaggtcaaaggttcaagagccttatcttcctagaaaaattctccgatgataaggctgggggctagggagagtgtatgactcaagtgactgatcgaagtcacgaagtgagaaaacactcatacacaacgcatctagagtaagaaaacttagttagatagatttcttttctatttcacaactacttcttacagttcgtaaatattccaaaatatattacatgtctccctgagatatttgtcacaggatataaagactaccaggaaggccaacgccagtccatggactggaag

SEQ ID NO: 53508 - DNA, 1860 bp, Oryza sativa
gacgccgccgtcgtccgttcatcttccgccgttgtttggtcaccggtgagttcgccgcgccgcgctcaacgtcctggtgccctccgtttgtgccgtagcgccgtcgttcaccggcgagcttgcgctcccgagccgccgccggagatgacgttgccgctgacgtcatcgggaccgtccgtcgtggcccggccgttgatcggttgatctcggtcgtccgttttggataggatcgatctcggccgtccgtttccgtgaaccgctgccgtgcgcccggtccaccgcaaaccctagccgctgacgcaataattcccttttccttttcaaaaataattcattattgcgtcataattcaattaaaattcatataagtgttttaatccgatttaatctttaaaaattcgtaactaattcatcttagctcggatttagttggttcaagtctctaaatttttctaaaattaagatctacatgttaaaaatatccacatgtactgttcatgcttgtttatgtgctgttttggtgattttgctcctttctgtttagattccgacgtttccggagagtctgttttcacaggagaagattttgaagagttccaaggccagcaaggcaagtcacacagatcccaaacaaccctttgagcatgttgatcccgtttaaagctactgtttctattcaactattgcatttattttcgaatgtcattgggtggaattaacctattgtttgttatagccctttttgttcttgattactttattccttgataccttgggttattataatttgactagttgggctatatatattggttcagctagatattagatgtgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacagctcctttccgaggtaccgtggtggtattgaggcacatggtgacatgttgtgggactgtgtcttgtgggtacagtggtacacctctggccaaagtaaaactattcgaatagccgtgcccgcggttatgggcgggttgagcaatatttttcatgattagtctcacacctctcacaataattatggatgttatacctggtaataatttgcttagctcctggtttagagttagatctgtacagccgggtatggttgttcaggatggttgggcctgtgcagcatgggtgtgttgttcagtgttgattaaaatttctgattaattactccactggtttatttctcttaaatgttttgctaaatgctgcttttgcaaatgagcctatattatgccatcctttggtatccttgggcacttgcatatttgctgggtggcttgttgagtatgtcatatgctcattcttgcaataatcaatcaacctcagttgaagaaaaagatctaggaggagaagacgtttggcttataccccagttgagctgcctgtgggagtggagccggagcttcactagattttattttccgctgcagttttcttcatggtgaggac

SEQ ID NO: 53509 - DNA, 744 bp, Oryza sativa
aactccataccaacagtagggactgcaggttgagattggaccccctcgtctttagtctctccatcttcacgtccaaagtcatcttgtatttcaaacccatcacctgtatcaatctgatcaatgctcatggcacctgtaaacagcccagtttcaagcagtacttccctcaacatatcatcatcatgacttgcttccctcaacacatcatcatcatgacttgatacttgctccatctctctttcaacacaaacatcatccttgtcactctgttgctctttcatacttctttcaccaaggacatcactcccctcatttggtacctcttccataattcttccagcagatccaactgaggaattcattctgcaggtaagaagaagggtcagtaccatattctgactgaagaccgaagatgcatcatttctataattctgttttctgtggacagtgtatgtcctacataactcagttgagaaaattgagatagttttagatagtgtgatttcagttgccaattcacatgattaatacatggtaagaagcatttgtttcttttttggcaccatgaatcctgctagtacaaccatgatatacttgctagaatgtgaaatgtacctcggtttttatttttgaaccagtttttatacatacattcagcatttcatttcatgttcaaaccaacaaattgccgctaatgatgaatgcacaacatggtacacagtggttgcatgatggcactgcatt

SEQ ID NO: 53510 - DNA, 1066 bp, Oryza sativa
tttcaaacatttgtattcaggtaaatatcggttttgtggtaatatatgagtaaattggacatttcaaccagcctaatgaaagatggctaacagttttgtaatggcaatggtacaaaaggaagaaaaaacaagtttctcgatggtatatagaagaatggggtgttcatctatgtatatcattggcttctttctctcataaaatttggcaaattttaaaagggagtatgattcactgttaaaaaggaatacaaagtatggtaaagtaaaggaagaacaagcaagagaaaccagcagatactatttttttaatagcaatgacaatttaaataagtgatacaaaataaaatgttacaataaatgtcaaaatatcaagtacaatgtccatagcaattctaatataaatcaaaaatattgttgttgtaaaatttgtatatactataatctacagcgtcactattagttaagtcgagctgccttctaaaatagaacattaactagtttaaattcagctatatctggataaagtgttcgatatctcattgctacattgtcttgctactaccaacctttacaagaaatacgcatgagaaatataactaatatatacagtttaagaacaaatatgttgaccatttttttcctacatactggacaatgttggagaaatctacacttgaactacatgctagtcagtttaaacctactgatttactacaaatcacaggctcattgtgcgtctccctaattatgcgtatgaagtagaatttcagctatcccagatcttacagagaaactcattagtggagcgtgcagaatcgagttactggaagtacgagaaatgtgcatactggaaacaaaacgccaataaacctctgaaatcgctcgctccaatcaattaatttcctaccaggacaacaatgccaatggaacactgatcgcgttgcggctaagctatttcacccagcggaatgacaatgacgagcagcgagatctcgcgccgaggagcaggagcgacgggcaacaagcggttagatgaaaagctcacctcgccgtgggcaccgagcgg

SEQ ID NO: 53511 - DNA, 773 bp, Oryza sativa
ctgcgattgcggggataagtagcgtgttcgtttagaacccggatcgagttgtgtcgtgactccacccaaatcgattgtttatcaatacctatcggaagatcgggacctaccatcccccatcagaagggaacaatcactgttcaagggaacgcaaagctgtcagtgcaatgcgacaagcagagcctcgacatggtcgagcacacgcccagcccacccgccacagatgagccacccaggaaagtgagcaaaacgaacaagacgccgaaaccagacggcgcaatcaagatcgttccgctctccagtgccaaccccgacaaggccgtcaagatcggggcatcactgggcgagaaataggaactcgcgctcatcaccttcctccgtgacagtgcatatgtgttcacttggcagccgtccgacatgccgggggtccctagggaggtgattgagcacaaactcatggtgcgacccgatgccaagccagtaaaacaaaaactgcagagatttgcaccagatcgaaaacaggccatacgagaagagctcgacaagcttctcaaagctactccatccagagtggctagccaacctagtcatggtgcagaaggccaataggaagtggaggatgtgcgtcgacttcaccgacttcaacaaggcgtgtcccaaggatcacttccctcttcctcgaatagaccaactggtcgactcaacagctggttgtgagttgttaagttttcttgacgcttactccggttaccaccaaatcagcatggcgaaag

SEQ ID NO: 53512 - DNA, 868 bp, Oryza sativa
aggtttacaatcttgcatacaactcggcgcagaatgtcattggcatactttgcctgagttaaaattattccactgatcacttttgctcacttctattccaagaaagtaatgtaaatcacccaagtcctttaaagaaaaagctttggtaagatcctgccgaaaagcagaagttgccctagccatagaactagcaacatttatctcatctacatagattagcacaaacatggtgacatttcccttattatagagaaacagtgaagcatctgccttggatgatttaaaacctagctcatgaaattttgtactcaaccttgaataccaagcccttggtgcctgtttcagaccatataatgctttatcaagtttgcacacataatttggtaccttttcactttcgtacccaggtggttgtctcatataaacctcctcttcaagaactccatgcaagagggcattctgtacatctagctatcgaagactccatcctctagatacagcaatagacaaaattgttctaatagtagcagctttaacaataggactaaaggtgtcctcgtagtctatgccatacctttgcttgaaacctttagctacaagtctggccttgtatctatctaggctcccatctgctttcctctttatcttgtatacccacttgcagtcgatcacgcttcttcccttttctagtggtaccaagtgccatgtctcatttttcatgagtgcatcatactctgcatccatagcatctttccaatttttattagtaaaagcttcatgtaaattttgtggctcacctgaggcagtgaagcaacccccatttgattttgccatcagtctatactttctccttgcatatttcgctctg

SEQ ID NO: 53513 - DNA, 1374 bp, Oryza sativa
aagcaaaaatgcttcagttcggactctagccaagagtgcaacttcagtagcttccactggatgtacccgtgatattacatgtcataggtgacatggcattggatacattgcccgcgactgtccaaatcggcgagctctatttgtgaatggtgatggtgagtatacttctgctagtgattgtgatgatgaatatgctttagctgccattgaccatgcaggaggacaagataacgataacatcgaggaagtccatttgcatccagagtcgctagatcagtatcctagcctaattgtcaagctagcacttagtgctaaagagaagtgtgaagagcaaaaccaacatcacaatttgttccaaagcaaagttcttgtgaaaggccatactgtcaaagtgattattgatagcgggagctgcaacaatttagcaagtgaatagatggtcaagaagcttggcttgactacccatccacatccacatccgtatcatattcaatggtttaatacatatggtaagatgaaggtaacccgtttggttaaaatacctttttctatgggctcctatcatgatcaaattgaatgtgatgttgtgcatatgcaagcttgttcctattcttttgggccgaccatggcaatatgatagagaagttgttttcaatggtaggaccaatatatatatatatttatattcgatggtaaaagaattgttttgcattgtatgactcctgccgctgtcgacggggaatacccgtagaccggatatagagggtattggggtacgctggtatgaggatttacgtagtacgacatcaagcaaacaaaagacagggattataccggttcaggcctcttaataggtaatagccctaatccagttgatatgggattatatgacggaaatcacagattacaaagggaatagtggaactcgataataccgacgagatcgtagttgagttggttcgactagatcacccggtgactcggctcctgtaggctctggcttcgtaagctgtgatggatgtgttggcggtaagattcgatgccttaagtcctcccggggggttgttaacaaccaatttggtaacatcagcgttgggaaagaagattaggtcaaagcaaagtcggaagcggagatcgagtttgaaaacagagcaggaatcggctggagtccagatcggctacgataagatcggctgggtctgagtcgggctaggtaagctgatgtagccgataccgacaatatgacttgtacgcgatatcgggttcaagttaatgtacttcaagatgattgccgcgcacggatagagtcctgggaaggcaattgtatctattaattaggatatcttatgtaaattccttatagataaatgtggg

SEQ ID NO: 53514 - DNA, 776 bp, Oryza sativa
aaccacaagaacaaatcccaatttttccaggaacaaatccaattgcaaagaacatatgcaatgaaaaggattcagagggctcttaggtttttccatttggcttgtcctacagtcaaggtcggctctgataccaacttgtcacgcccagaaattcccgaatagaattccaagcagaatgtgcattaaaatccccgtccaggaccatccggggtacacaaacgacaaagttgacatacagatccacgtcttacaaacattataaaagtcttacaaaaatgcagcggaaaacttaaaggataactggagctaagccttgacttggacttgcagcgggaacaccactccacaggcatcctcgacggcacgggcgaagcctactcctcggaaagaccaccatctgacgcatactcaaattctggggtttggggaaaatagagcaagactgagtactacccactgtactcagcaagtcataccggaataggggtatgatgcagggaattatcaagggatagctataatggttcatttgcataaagcgagcatttataaacagaagttgaaagcagtaaaacagctgtaataattaatcaatattaaccatccactgttcaacgctacaccacgttgcaacaggcccaaccatccacctgaactaatcagttccaacagactacactagggtgaagctaatcatggtgaatctggttgaccgcccataaccgcgggcacggctattcgaatagttttactctgatcagaggtgtacaactgta

SEQ ID NO: 53515 - DNA, 2398 bp, Oryza sativa
  unsure (1)..(2398): unsure at all n locations
gagatgcggccatgaacttcgcgagagcagttcttccgatgatagcattgtatgctgtatcaaattcagcaacatcaaaggtgatctgctctgttcggaagttatttgcttggccgaaagtcacaggcaacataatcttgcccaatggcttggacgatgattgaggagtaattgcatggaagggttgattaatgggcgtcaactcgcttcgtgggattcccatagtgtccaaggtgcaggcgaagagaaggttgatggagctgcccccatcgataagaacccgtgcgaccttggtattctaaatagtgggctcgaccacaatcggatatcgtcctggcgtgacagcagtcttggggtggtcttcatctgagaactcgatcttctgttctaaccacttcatcttggtcgcagccctctgccatgtcgaacaaacttcacgctccattttcttgtactctctctttgaggagtaccccatggaacctccgaagatttgcgagacatggagatcggaatcaggttatgctgagtccaagtcctgagtagctgcctcagcggccttctcgactacacgtactcgtttgcccttctccaatgccagttgctttgcgagcgactttttgaagacgaagcaatcttccaaagagtgtctgtctgacttgtgtatggggcaccatattttcttcgtgtcgttgccttgtgggtcagggtgcttgggagggtccacgtactctgccgcgaggacttccgtttgagctttcgttttcccactcttgtgactcttcttcttgcttgattcaggtgcgtctttggtggtttcttctctcctcccgtcttcggctttgttgttcttgcgtcttagtgcgtcgtccgcgtgagcgcatcaatcgacaatctcgaatagttttcgagcagtcctgatcctccttgtcgccaactcttgggtggtatagcgatctctgaccccagtcttgaaagcgtagatcacggaagcattggtgatctcggggatagtatttctgcactcattaaagcgtcgaacgtagtccctcaatgatttgcccggattctgtgtcaacgcgtgtaggtcgtcttcgatcgcatggcgcttgtaagttccttggaagttagcaacgaactgctgccacagatctgcccatgaagaaatcgagtatggccggaggtgaacaagccatgaacgtgcagatcctttcaacgccactggcaaataattcgctaacgcgttgtcgtccgctccggcagtgtagagtactctggaatagacctgaaggaattcttctaggtcggtgctccaatcatacttctctattgctcccggtcggaatctctcaggccaccggacatcacgtagagcacggttgaaagctttacatctgccgctgggggtggtgggttgtcgatgatcgtatgtcctccgtggatttctgtctgacaatgaggatgatgaggatgatgacgatgacgatgagtcacttggttccggtgtacgattacgaggatgacgtccgggttctcgagaatcctgtcgtcgcctcccgttgatgtcccggcgacgatctccatcgtcatcatcgttatggcggcgtcctcgaccagtatcgcctggcatccgctgttcgcgatcatcatgttcgtggcggctgtggcggttatcacggtctcggttttcgcttgggtgtcctcctcgctcctcgttctcgcgacgtcgtgatgagacgcgatgtcaggaatggttttcattgtctcgcgcgtgtcgtacttctcggcggccattaagatggtcacaaagatcgccggtgccgcgaggtggaggggtgtcttgtcgaggtgatgtccgctgctcaggtggttcaccatttgcaccgctagctggcggttgttctggtttgctccggcagtggcctcctcgaacgcattactgagattggccactgattcccgtagtcattctgtccaccgtgtgaggtcatcgttcagaatgggatcataaggggtttccctcagtattgcgttgatggccccgatgtgctgggccggtgtaaccacttgattctccacttccgcgtcagcacgcgcagacgtgctggtcccgccgatagcaaacacatcgcgtggtgtgcttgtcgacgatgagccctgctgtcacaccctgaagttctttcccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53516 - DNA, 1600 bp, Oryza sativa
atgtgtagcaactattgaattttttctgtgagttttttctgaatttctcaaaacattgctcctatactgatataaaaaatgaagtagcaagtcagcaaccagtaagttcttcattagatgatttttcacatctgtttttcctggctttgtagattggtgggctcgctgctatgctggtagcatactatctcttaggaaatggatgggctacaagaacacattcaccactatgtatcctattttgcagatctgattctgaaataacacgctgcaaaattctatcttttttgtcaattaagacttccatccaaatttcttatgaactcaagtaaatgatgttgaaaatccctcactttgtatagatagctttggaagtgaatcactggagaagggaacacaagttattggaatgaaagaaatggtggtcccacttactgctggaattttatctgctttgaggagagtattagctcggcgggtgtcccttaaggtactcttgatttcattaactttatcaataatgataaagtgttaattattttccttaagaaatactatagttacaggcagtatccatagtaaccaggatagtcattctacagaaggtaattagcatgcaacgagacagatcattttctgcagagtataaaacattgtggaacatgaacatcgatgaaatttctatcgattcaatatgcaaccacatctgatatgcactttttgcaatgtttaaagttctccctctggcacctacttactctgttgatgatatcgtggaatttgaagtattgcggcaactgtttctcaatatcagaatctacaacttaagtgtacttaaagtatggggcaaatcctccatacatctttatactatcaacttattttgagtcgtaagcatagtacaaaaactcggaccggagctcaacccggtcaaagctttcagttcaccggtacggcggtgaaaccggccggtctgccggttcatgtgctgaaccgtcagtcaataaagtgatgcgtgtttttgttctaactccctgtctgcgtgcgctattgtgttttttttgtgtaaatagcacatctgagatggtaatgggccttgatttggcccaataaggaatgtacagcccaaaatttcttgtgctgttggtcgcgacaggtgccagtttaatcccgattcatggtaaaaccgtgcatttcaggcagttcagacttcagagtaggtcaattgcatatccggtcttcccatagaaccaaaccatgggcaacactggttccctttttttccggttggatcgccggtccgatctggtttttacgctatggtcctaagttacaatatagaatttatatgtgaaattaagggaaaaagtctattttacccccctaaactttttcgctggagcacttaatcccctaaacaatttctcggctcattttactcaccgaactattgaaaatgttgtcttactccctcacgatatttatcttttttgtttatctctatataggtcaaattttgcaatgaaatttggtgggattgatatatgcattataactaagtctcaacaatttattggcatttttaatcgctgtttacggg

SEQ ID NO: 53517 - DNA, 1472 bp, Oryza sativa
tcatggtaccactagtatgattttaggtagatgcttcgctggttaattaggtaacattaggtggttttacaactctagaccttgggatattcatatcacctggacactatggaattgttggattattgtggaattggattcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaattgaaggctacacgagctgcggcccagtagtcgagatgtcatggcacagggccggtgtcctgctgctaggggctcaatcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtagaatctattcgaatagccgcgccctcggttatgggcaagccgagcaatgtacccaagttagtgttttaattcttaaaacctgcttaacaactaaaatatggaatggttggcctgggttggcttgggacgagctgggacccagggtcgggttgccagttcggtctgaatcatcgtaggccttgggttaaggcaggttcgtgtgggttcacggccttgattaataatattgtatagctctagaatcgtgtttacaaaatagcttcgagcaactaagtgtcttttaatgctatttactgcaaaccctaaccctttatattataacccccttgtacttccctgcatttattctgcacttgtgggtgtgtcttgttgagtacggtggttgtactcagtcttgctcaatttttcccaaacccagaagaggagtccctagaagatgaaggctttggtgtctagctcgtgcctgccgtcaagcgcctgtggtcgtcgccctagtcttccgctgtttcccgtttgtctttgtgtgtgctgggccttcgccgcccatgtaataaattaactatttacgcttccgcttgttgaactctgaactgtatcaactcttggtgtaccttgcctcctgggacaaggaataatgcacgcacgtaaggaacgcccgttgggttatttccggtcgtgacatccatgctatagaaaaacatcgggtcttctgcttgcaattcttggaagtacttgatggtttcagccatgtcaccattgcatgtagtccggttcctcattgatgtccttatgttactaacatctttcttcgtgaacggtatgttgcgaatg

SEQ ID NO: 53518 - DNA, 1867 bp, Oryza sativa
catgcatgcgcaataaagtaggagatcaatctttgacttaaacaggaaactcggatactttttttttcttttctcaaaccaatctacaaactctaccgggatgaccgcaacaaaactaaccgatgagacaaccagatgcatacccaaaccaagatgaaactagggctaagaccagatcttgacacgacagtagaccaaaactcaataaagcaaaattgaatgaaaattgcaaggttcaaaactaatgtttggtgaaggaaaaagtgatgcagcaatttgtagataatgggtagggaaaataaatctataaaactaaaatcctcaccaggcaaccgatgctctgataccaactgatgacgctctctctcgtggcccgatgttctggtgaggggataactctcactttgatcgagtgcgacgtttgcgacgtggctaccaaccagaacaagtccaggacgccgtgcaatcgctacaccacaaaagatgtcgcgcgcggttgatgatccctacaatgcaaacgagagaacactgcaagaacaagataagatgcaatctaaatattgcgaataggtaattaagcacaaagaaatagttgcgattgaagtggtagatctaatcgacccggcaaataacacaccaactattggggcctctgaatctatagtcgccaactaatcgagcgaggactagagacaaggtgaatggcagttggcaaaattcaactaaacaaaacccaattgtttttgagaatgtacaaagctatttatagaggaaaataaagctagggttaagtgctaattcgtggaggtggagggagacacttccgagatgggtctagtctattacaaggcccaaggcccaagttcggtttcagcaatagcactatcttattttggcgattcccgttgactcgagatgaatttgaacatgagaccggatgcgtttgtaagatagcgagataagctttccacgaagtccaagatcacccaaatcggagttggcataaaggcgttaggtctgtttgaactcagtgctatctccggaggccgaactggacttggacttggaattatcattggaacgtgtgaagttatgtgcgtatccgacgaagtgatgtcctcatcagcctctatcctcttgctcccgccgtctccaaggaagctctcagtgtcatgccatcctttgcaagatggcacaatcgtctcggtcatccatctacctccattgttgcaagaataattagccacaataagttaccttgtcattccgagtctagaaatgagtcggtttgtgatgcttgacaaaaagctaaaagtcatcaattaccctattcaaggtcatctagtgtgtctagtcatcctttggaactagtcttttctgatgtttggggtcctgcccctgattttgttggtaataagaagtattacgttagctttattgatgactacagcaaatttacttcggtttattttcttaagcacaagtcagaagtatttcagaagtttcatgaatatcaagctcttgttgaacgactcactggtcaaaaaatcattgctatgcaaaccaactggggtggagaatatgaaaaactccatccattatttgaaaaaattggcatatcttatcatgtgtcttgtccccatacacatcaacaaaatggatcaacagagcgtaagcatcaccatgtaatagaagttgggcttgcactcctagccaatgcttatatgcctcttaagttttgggataaagcattcctcactgccgcttatctcataaataggacacctagcaaggcgatcaaccttgaaatgccactagagctcctatttcaccaaacacccaattatcaattccttcgaatttttgg

SEQ ID NO: 53519 - DNA, 1115 bp, Oryza sativa
ttaactcatgagtgatattagtcttctccgcggacgacgactcgatgatcagaaaagtgacaccaattagacccaaaaccctcccaattccccccaatccgactgagactgaaccacaacgattcatttttcagaacacttgatggttgtgtcaggcattgactgaaacaaaatgactcgcgtatggtttggtttagtttcgctcgtactgttcgatttgtttgcgaaatcggtttcgttcgtactgtttgttttggtttctactttgtgaaatcactcgtttgctaaatttttggtctcgaaatcgtttccctcgtccggatttgtttactttcgcccgaacgtgtttgtttctcttgtacggtttggttcctgtgcgaaatttctcgttggttgcgaaatcccatattacggatttgatctgaattgattaggggttttaaaatttgatccacaggaatggccgatgtcatcgacgagcccatggtcgaggcgttcgcccgactcgccctgaaggcttccctcgctcacccgagggtgacatgggggagggcaccccgcaagtattttgggaggaatcgactctggcctcgcccccagaatccgcctggagctcgtagactgagacccttctcccgctaccccttcacttacatacccgctgtgagtttatctagtgtgatttgtgctgtgagtttttactactgtgatttgtttgttatgcagatatttgggatttattgatttggttttacatttgatggcaatatttaattgatattctgatttcagtctagttatgtttgacattgatatctctagttcaaagtaatatagacagattacaaactatttcattgttttttttgtccaggtttcagttttaatattctcttacagcgcactgtaacttacaataaaaatcaacaacaattcagtttatataacatgagtttataaaaatcaatagttattgagtttacagggcatgaaagctgactggtatcacaaatgtactaaaaatgaaaagtttatataacaaattaactaaaaatgggtatatgtgagtttatttataaatatgtttgtgatttagcctttggttctatgtgatt

SEQ ID NO: 53520 - DNA, 1133 bp, Oryza sativa
aagtaagtgtgcctgacgtagtgtttattgacatttgggaatctgtacaaattgtgttgttttgggcttaagaacaatgggtagatacttcacattataatcatacttcacatttactaatcaaacggttcaatgtaaaagttactcatgctcaccaatttcataataagttgattactgaaatgttgatttcttctaatattttaatgttatttaaaattggcagaagaatgaattttaactctttccccttgtgcattgttcgtacttttgatctgcttttgctcctgaatttgatctttgaagttttcttgtacctgcaactttatcactcttctccatctccatctttttcttcttgaatagatttgttgcagagaagcttctttcttcggtggatctgagatttcctctaagataattgattctaaatagatctggattttgatctgcttgcgtttttttatctccatctttctcactcttctccatgtccatgcttttttctcgatctggatgctgtattttgttgttaattggtttttctagagcaagtcacgcgattgtctcctcttcttggtagccaaattctctatctttgttagtgttttgggttttgtatctgttgttagttaagctgatgggctaaatttgagtcacttctatattgttttgggcctttaaattgactttaatcttaatctcggctttcatttgatgtaaattttttatttgggctcaatctgggccatttgattgggtcgggttgtgtatgggccctttgaaaatgggcttccaaacctatttgtgtttgtttttttttttagttgtcaaataatattacctttgtatattgttttgtttttatagttcaatgagtacttcttttcagtgccacaggtgacggaatgcttaaagctggatgctctcaataaactcttttatcgcaaattaaatgaggttttttttgttattttaaaccaataattaattaaatgtttattattggaagtgttttattttattttttctaaaattgttttctgcttgtagatcggaatgttgagaaaaatcatttatatgcgcaaggcatatattcctaaaccagctaagaaagaagcattcctcagacg

SEQ ID NO: 53521 - DNA, 1174 bp, Oryza sativa
  unsure (1)..(1174): unsure at all n locations
cttcgccgcttgcgccctaactccttgtttcctgtgccctaccttcgccacacgcgctcgctctcaaacatctcttcctccggcgtcatggcacggggctccgctttgctcgatggtagcgtgctgccgccttcccgcatcgtgagcgagaggcaggccgggctgccgcgccgcttcatgccggaatctgccaccggccgggagatagtcacgctgggcgagggacgcccggcgccacactacccggggcggtccgtcttcttcctcccttttgcaatggcagggctggttccgccattttcttctttcttcatggatgttcaggagttttacgatctccaggtggcgcacctcacccccaacgcagtaatgacattggccatcttcgcgcacctgtgcgagatgttcatcggggtgcgcccatcccttcggctgttccgatggttcttcaccgtacagtcggtgtcgccgccgtcggtggttggtggctgttacttccagccgcggnggccggtgctgaaccgctacattccctgcgtcctccgcaagaagtgggatgactggaagagcgactggttctacacccccctcgccgacgaagcgcgcctncgacttncgagccagcccccggcgcaggcctncagctgggcggcgccgtagatctgggagatggctatgacgccgtnctcgaccgctggcgggcctgcgatcccaggggctcacaggggccatggtgtacggcgactaccttcgtcgccggattgcgccgctccagcggcgcgcccggggcgcctgggagtacaccgggtccgaagactatatgaggacccatcagggagtcagatgggactgggctcctgaggatttcaagatagtggtccaacgggtgctgaatctcagctccgtggaggcatccctcattccccaaggagtcctccccctctgcagcgatccagatcgcgcctccatcctgaccatcatgcaggcggtcggggcgtcgaagaagcgggctcctcgaagccacgatggcgcgggcggaagccgcaggggggaacaatctaccccgggagggggtcgtgcttctgggccccgcgacgggggcccggggagcagccgccctgccgacgcccgggggaagagaaagcaggaaggaacccctcccccatctcctccc

SEQ ID NO: 53522 - DNA, 732 bp, Oryza sativa
cacttagtgatttcaaaatgatttcaaacaaaagatttgcaaaacaaccttgcctctcttccaagcttgcattaaacacctaaattcccgtgacttgctgagtacgaaagtactcacccttgctctatataaatatatatatatagttcctccgccctgaagagaagataaagtgaagtgaagattagggtttcgtcctggttcccagccgtcgcctgtggtgttgggtgttagaccgttggttccgctgctgctgctgctgctgttggtgtttcctcatccgcgtcgtcggttgtattctcgggctgtctgagctgcaacctaagttaaggtaaataagtcctctatttattttaaggattgctatgattcatatttgtcaccgtgggtaccagcactatgtcctgggactggtaccgagatcgcggtttcgtaggaagcggttcgcgccattttccctacgacacgctcctgtcaggtgccgttgtacggcggtatcagattggggtgtgacagtacctgattaagaatgataaaattaccctttaacataagtaaatcgcaagaagaaatctgagaagaaaaccaaaataattaaaagtagtatatgtgtattacacagaccatatacagaggaacatatcacggataaaaaaaaacatttcgttaatctggatatcaacactgcacggacctaaaattaagttgctactcctctttttcacgaatgta

SEQ ID NO: 53523 - DNA, 1078 bp, Oryza sativa
  unsure (1)..(1078): unsure at all n locations
gggtggggtttaggagtaaggtagctagggttgcacccctactcttgaatctaaatatacattagaactgtaaaaacttcaaaaagtagagaattaaaggcaaaactatgtcaattacattagttgagccttagacttggaagaatcctggttctgctacacgtactgtataggtcacactgctccactcgatctctgtagccggccttaccgtatacgtacgtaggcataagtatgacatgtacagggatgggctctatatctcctgatgcgtcacttgtcatgcatggacacacacatcaccagctagctactgtacgtcactccactctctccatgagtcttctcgatccggtcttctctactgctctcctctacgacgaccttcgtacgtgcaaacattttccattggggcacgctcacctgatacagtccctgcttttatatctgaaccctgtactcttttttttgttcataccatacaccaaaaaccatcatacatcaatttggccggctatctcgtcgtcttctcccgccgcaccaccctgaacgggtcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttttgcgtactgagctgaataattgaaatggtttacttcgaaccattttttagaggagtttactgagtcctccctcttataatatctcaccagataagcaggcagtaaaagatgagatactgaaattttgatgcgcgtgagtagaagttacatactcttcagattccttgcctggatatccccattgtctccactaactatgacagcaaccaaataaaaagaatctgaaacac

SEQ ID NO: 53524 - DNA, 717 bp, Oryza sativa
tcgaccgcatcattgagagctgtcggccaatagaaaccctgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtccccttctaccagcacgtagcatttggagatgcgctggacgcgttcactcccttcgcggtcctcgggtagagtcttatctgtgaggtatacttggatctcagcgatccaagcaatcaatctaagggagctgggagcgctcccctcgggtcccgaggcctggactccgacgggcctcgggggccggtcaggcgcgtccgtctcccctaaggggtcgggtcgcgccgacggctgggcaagcctttcttcaaagggccacgccccggggcacggctcggttctgggccccttttggcgattttagccgacccgagcccccgagggcaggattgagcacgagtgacctatttcaagtcaagattcttcaaaaagaaataacagcacagacacagcctttaggaaattgaaaatgcttttattaaaatacagatataagagaaataagaatatgcatgtgtggtagcccccggccaaccctgcacgcccgaggggggtgcggggttggcccgagcccgaaacctgacacccgatccccct

SEQ ID NO: 53525 - DNA, 965 bp, Oryza sativa
gagagagagagacagagacatagaagtagaagaaggaggaggacgagagaagggaagggggtggaatgggaaatgaaggtggaggggaagaggaagaggagaacacgcggcacttagatgtcaccgcgcgagaggagggagcgaccaccgcacggactcccccacttgccactctcgccgtcgccgcggcctatgtactctcctactactagcaatagtggagtaggagtaggattatatatatccacatccacatcatcgcttgatttaattgtccactttcccgtgcgccgaattcggaaaagtcgtctagatcgtctccgcctccagctagcgactccgtcttcttctgccgcagccgccgcccgcgcctcttggcttcttcctccggcgagctaccggcctcctgttccgttcccgttaattttttcctaagccgcgaggattagagcaaattaaatttaatagtatagcccactactaactccaattcatttatagccaatctaacagccaattcttacgataattgtttactatacttttagtatatggccccacatgtcatacatacattgtgtcttaaagtctgtatttttctctcatcttttatcttattataaaatatgtttgtacctggctaatagtctgttattgtacctgctcttatatatatgcgtgaaaaacacggtttctccaacaactttatagaacaaattagtataaacctaatttgttgttaggtttataatgtatgtatactaagggagtgtttgaggagaaggggattgaggagattgggaagatacgcaaaacgaggtgagccattagctcatgattaattaagtattaactattttaaattccaaaaatgaattaatatgattttttaaagcaactttcctattgaaattttttgtaaaaaacgcaccgtttagtagtttgaaaagcgtgcgcgcgggaaa

SEQ ID NO: 53526 - DNA, 1654 bp, Oryza sativa
aattcctgcaccccacatctttatgaccactgaattgctgttgtttcctgaattttagctctttactgatcttgtgattgcacttttgcagccgggaaacgaatggcataactgctattctgatgaacactatttgccaaccctctttaatgtaagaactctcaaaaactcttaaatgatgttttcagttgtgtttacttcccagtgatttcaggccgttattgtacctgcagatggttgatccaactggaattgcaaattggtcagtgacacatgttgattggtctgaaggaaaatggcatcctaaagcttacagggctgttgacacaagctttgaactgcttaagaatatttcggtgagctctggtatacttgtacatgcaaaagaaggggaaacatacatgttttatttccttaatggccaattttcgcaaaaatctgcattcttgggatttgtctaattaataatgaaatttttgcagtccattgatgagagtattcatgttacaagcaatgcaaaggtagagttatttgatcttttcctcttcttgctttctagtactagaatcttcaagttagttctgtgagactgaacaagttctccccttctttactgcatgcatatttgacatgttcctacctagatttaacttgaaattctaatgtgactgactggctgaacaaatttcttgaatcaacactgtttctacaaatcgatttaattttttttcacattttcacaattcttttgaggaggattttgataaattgtttggtcttgcagcaccaagtgatgagaagaccgtgcctatggaatggcatgaagaggccttgctacctatttgcacggaaattctatcccgaggcactcgacaatctgatgaacattttctcaaacttcactatcatctaagggaaggatgaatcaaaaacctagttcgcatgtaacactacagtataggccttggaaaatcagaaacccagagagactcgctgaattgttttttgtgatctctcttggaacatcaaatgattttcctttttcgcgaagatgttgcatggtttgcagttgaaagagcagtcaaatttgttcctcactgcgctgttctgagcaaatgatgtgttgttcataatgaacttcgtagtcatccatctgcatattcatgggtgcagctacctgatcagtttgcctgtaacgctgcagtgttggcaatgttgtagtgtttcattgctgaggaagatgaaaaatccagagagatttgccaattttttcttgaaagctctcttggaacatcaaatggttttctattgcgaactgtaatgatgatgtttgagcacaatgattttgatcaacaacttccctatatgaagaatattcagtttgaagagtaaaattgtttttgttcagcaggaaatcgatcgtatcttccttattaggtaggcatcataatgtgaaatagagtaaattgcactttacactagataaagtgtagcttgtttaacgtatactttcactttacaccaacaccaggttatatcaaaacaagtttttagtttgcattaggttgtatcatataattaaagagagatcttgtaaaacatgagtaaaatgtacgaaatcttcttgaatttagactgttttaccccgtttctt

SEQ ID NO: 53527 - DNA, 1589 bp, Oryza sativa
tatacatttctagagaatcaaaatgcatgcaactctacagaataatgaaagcacactgtgattacgcgtaccagatgtcctgttcttctgtagatgtcgaaagctttgatagcatcaatttttgtcatgtcgaagaactacaacagttcagaaatttaatttgatcaggatcatatccattagatccatcgatgattcaaatgcagagaaagctggtaaataataaaaggtaccatttcgacaagattaatgattccatcattgactgcacaataaatcttgaaactttccttcagcacctgagtaacattttcattcatcatgagcaagagcaattcggataaattgttctaactagtagtatctgaagttcagatatcagaattaaggtcagccacaataccagagctaatgcatactgtataagatagtttccaaatgcggctccttcaggcttcacacacagttacagcattggtaaaaatgagtcagaaactaatctagatcaagcagataacataccacaaagttaggtgtgtacattacctggcagccgactagccgatagagcagctgctgcagtgcaggaagttgctccaagagctcatccttacctaagcttctagttctactctgaccctgaacatcatatttcaattggtacatatttctcaccaaatggaacaaacaaaacatcacaagcaacaagatcactcatgccgaactatcaccaccgaatcattccctgaaatttagaagccataatcacaatttcacaaacctttggagctccctctgctgtcctcagacgctctgcttcaatgtcgtatctcagaactctgaagcactcgagcctctcctccaagaacagcgcgtacgtgcgcacccacgccgagcaatcccacgctgagcaaagcaattggagatttcaaatttgcaatcacaaagaaatgagaacgatcggtgacaaaattttttgaaccgattgagttcatgttaatccagttcagtttatgcaggaattcagattggattgggagctgacccagcggggtggagtcgtccttgaagctggacatctgcaggcaatggccgccgcggccgcgccggtagctgagaagctcctcccggaacgcggcgtcgccttcccgcagcgcgcggtgtatcaccaccagcgtcttgagcgccacctgcatcaccatccatccacccccgtcgtcagcagatcacgcggcggcgagcgatgaggaaaacattggcgatggcggcgtaccacccagttgtgcgtcttggagagacggcgggcgagggcgtggacgcagtaggacacgtcggcgagcgggcgggcgccggacgcggcggcgatgatctctgcggcgacggcgacggcaatcgagttagcacgcgaggtcgcgagcgatggattgggcggcggaggcgaggaggaagaagaggaggagaaggaggcgtactggagaggtggcgctccttgggcgggcgctcgacgtggttggtggccttgacgacggcgacgtcgaggtccttggagtgcgcccgggcgaggcccacggtggtggagtccttgatcg

SEQ ID NO: 53528 - DNA, 2008 bp, Oryza sativa
  unsure (1)..(2008): unsure at all n locations
ccgccgcggcgaggtcgagtcgtggctcgcgagtggctccattttttaaattttcgcctccatatatatatttctcatcctcccaaaatcacactaaactccctcaccttttcattattcccaaacttagaaccataagccatccaaaattgcaagtgttctatcagtccaaaaataatcgacgtttaagtaaagattgaaacttttgaagattttgccgttgatgttatactaaaataaatttgtaaaatctagcaaattttacatttttcaaagaaattccacacgtttttttgttttttttaaaagtaaacatatgagtcattattatcaacatttaaaaatttgatcaaatcttgtcctaaagtcaaatattcatgagcagagataaaaaggctacgaaaagttgtgaaactcacaggggtgtatttgcgtatgagaaacattctgggatgatggcacgacacaatccgataatgcgacgtgcgcaattgattcataaacactattggaataatggcgtgccaggccggccgcccattgtaatttggaattggaatcagttgaaaagatgcaatcttagacgatttttcaggctcccaaatttgatttggttcaagtcaaccccttgcttacatctggtgttcagtgctaatgccagcaatgctcaaccaagtgctgccattagcaaccagccatctggccctcaaatctcaaatttcagattgggccaatcccagttaggatcaatactagcatgaattgagaacgagtacatggtaaatttcagatatttgaactcaggtgagacatgtgcaatcttgcaaatacatgccaatatatatatatatgaatctgctatgaaatgcatttcagtatgggtttctttcttttatcagtttattattattacacagtgcaatcaccacaataggggaatcaatcaatcaataaaatcatgtgcactgttgttttgtggagaaggcatgtcagctgtaatctagtctaactctacattgtagcacaccatgaattttgctccaatgtgcttttcaccaccttggcataggcacctttctttcagcaaaatgtgcttttgttgcttttagaattcccaattatagaataagtgtgctgcgacttccttgtagtttagccattaatatgtgcaccaacagcggagatcgaatttttcagatccaaactgatggtcattgtataccaaaccttggaatgctggttgtgttttcataagaagactcggtttcacccctcattctaacttacggntgtctgcattgaatccgaacgatctgggttgtatatttgttgactgcactcttcaaccacctttgttggagctttgcttttaagcagcatctcattgtactctgcttctggatctgacaatgctacaatagccccgcctgccccaatcgaagcttctccattgtgcaggacaactgttctgatcacgatattcaagtcaaaagtcttgttatatgaaaagaatccaactgatcctgagtatattcctctcggactagtttcaagtgaatcaagaatctccatggatctaactttcggggccccggtcattgaacctcctggaaaggcagcctttacacaatcgacagggcttaggtccgacattttggttccacgaatggtacttaccatggtatgtacagttttatatgattccacatccatgaggcgaggaacatgcacactcccaggttcacaaaccttaccaagatcgtttcttaggaggtcaacaatcatcaagttctcagcttgatctttttcactgttgaaacacataagaaaatatcagtattgtgaggactggtaaaaccaaaatcataatgtttgaacagtgaaaaaagtatctatcagatacttgcctgtatttcaactgcaaacgtaggcattcatcttcctctggtgttctgccacgtgctatagtacctttgattggctttgcttccagaattgcatttcggtc

SEQ ID NO: 53529 - DNA, 1433 bp, Oryza sativa
caagagttataacttataagtcaaactttgtgatagatcatagatgtagcaaaatattattacttctaagaactgaagaccgacttaatattaagattctatcagcaattttttgctaggatcatttttgttgaaattgtttaagttacattattaatttgcactttataagctattatcgtgacatatttaaagcaccagttactcacacttgtcttgacttatttctatgtatatctatatatgcaattgaaggttaaaatgccaagttcaaggtgtcatgccaacttggtatgcagtttgttatttgagtataggttgttgggatgagttttgttgaagtttctagtatacaatccaatgcaatgaagttagatgcatggtgctgatgtttgaatatgtaatctatttagtgagttctgtctgttcttgaacaagtttcacactatcattaatattagtcttacaatctgatgtgcttcctggtgcatggaaagtttcatagctgagcattttgttaattggcaataagagttttaaactttatttgttgacaaacacaggaaattgttggtaatccataatccaaatccataaatggtctgttatacacttacactgaaagcatgggtcttttaaactatgcttcacattgctttctctttctgtttgtttttagtaatccatacatcaagtgatcaaagtacttagatcttatctttaaatttttgacaccttacctcataaatgtggaatctctgtttttctactaaaaacaaatctcttttttttttttgtaggggatgttgagggacctatcaaaagcacctcccacacctattcaagttgtggcatcagttaatgatggtgtaagtcattttcccccattagctgcacatctatttacatactttttgaggattctaattttcacaataagttgaaagtgaaatgactctttggctcagatgagttgaatccttgtttcgttatctagcttactgatgattgtagccatttttaagcagttgctgaaaattttggagaaattaatcaaaatattggtccacaatggcttctcaatattttcttaacttttatgaaggttaaacaagttatggtccattgccaagggattaaaaaactgtggctctagctattccattctaaatttgaggatattagatagtgtgatatactgatattgtttcctgttatactggtcactggtgtgactggttgactttcaatccatagttgtaaacttaaaatcatgacacataattggtttagctatgggaagatttaatgctgacggttgggcatctttgcatgttattttcttctctccttggtattcaaaatatgaaagctgtcctataactgtggcttttgtttactgccggttaaatatgaacttgttttcctttatt

SEQ ID NO: 53530 - DNA, 778 bp, Oryza sativa
tatatggactttttccggcctttgccggtcggcccatggccaccttgcgcgcgggcgagcgccccctcccctcccccaggccgcaacctgggcctgggccgggaaagccgccgccgcgcgctccccacttgggccgatttcggtccggccgccgccggccgtccgatcttagggtttgcgatcggacggccgggcgccgaaaacggggatcaaaacccctcgtgccccggccggccgccgaaaccctagcttctcctctctttctctctctcgggcgggcgcggtcgcgccgagcggcgtcgccgacgccggcggccctcgcgccgctgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcgacgacggccggcgacgaggtaagaattagggttagggtttttggttcttttgatccgtgcggatcttgtgcttttctttctttggatttctttccccgaaacgatctaaacactagggttgctctgataccattgttagactttgctctaggatcacctaggttagatctagtcgggtggttctatttgggtttgatgaacgacattgtagatgaaagggagagggtttagataccgatcgg

SEQ ID NO: 53531 - DNA, 744 bp, Oryza sativa
ggtagagtgcctaacgcccatgagaaccctgtagccatctaactcacttgcatcgtttatgctgggcatttttccatcagtggtactgcactctgactggtttgttacgaataagttatccaatgatccccacaaggtactgctagttatatcaggcttatcgctttcaaggaatgagagcatttttggagaagcagtccatgctattgatataagatcctcagatagagagtctggttctattacaagtgagtgatagcgcactacctgaaaaataacaactgtaagtagagtgttctttgcggtgcatatagaggctgaaaccccaataatatggctagcaacatgagtggtacactaaccttgaatccagagtttatacctgatgggatgtgattaaagaggtagcatccattgtgttcaagttcactgacataaaaaaaaggggtatcaaaatcaagacatgtgttaactacttaactgaaagaacacctagaacttagaagattatgcatgacacacactaatccatagcaattgcacaaaataaaaaataaatgctgtacaggtcagaaagctgaaagtattaagcatgtaatagagttcaaggccttacctaagccggccatgtatagcttcaggagcatggacgattttagcaccatggacaaatcccagggcctgcagtggtaaaacaaaacggccatttcagttcaacctaccaccaaattgtccatgaatttt

SEQ ID NO: 53532 - DNA, 1297 bp, Oryza sativa
gggagaaaaggcggcgggtattttttggggcggtggttggtttggtgggggggaatggttataaaagggtgagaatctggtttgcgcttttttggcgaccgcacctcctatcgtcttggcggctgtgccatcactgccgtcgccgtctccctctccagagagaacgacagcgttgccactgacatatgggctatgaaggtgggactcacctataagagcaagggcaatagtatagccaattaatagttctaattcatttatagtcaatctaatagctcattcatataatagttacatactgcactattaatacccggtcccacttatcatacacacagtgcgtcttggaatccgtgctacagctggctacaaatctacaatagcagactataagccagttgcaaatatattttaagaagataaataagaagagagaagagcagcgtgctacagatttgtagctagctgtagcacagactacaagacgcagtgtatatatgacaggtgggaccagatattaatagtgtattactgtgtaattattgtatggacgagctattagattggctataaatgaattgaagctagtagttggctataccattaaacttgctctaaggaatccacactaactttacgttagaggagctcgctccccaaagatgctacttcctcctccctcaagttcatttagaattgttttattttctactccatccgtttcaaaatataattctttttagacctgacacggtctactagatgctactttgaccaataatatgtcaatatctataaaagtaagatgttttaaatgaaaaaaagttatatatattataataatttgtttaatgataaacatagtaacattaattttatatgattgatctttttatttttttattaatggtcaaagttaaaaatatttgacttgctactgtactaaaaattgcttatattttaggacgtagggagtaccatttattttaaaacaagtttatttttattgtaattactgtattggagtttataaaaatatagaataattatattgggagtatataaaatataaaaatagttgtattgggatatgatataactgaggtattctaattcattttgtgtttattggcatgtgtgatattgtgagatggctgacaaatgaatttatttcaggatggggttagtaacttctatatgtatgaaatacagtttgaaatgtgtgctaatgaaaatcaaggtaaaatctatatcttaattagaacaaaaggggatcttaggtcatcatttttttttc

SEQ ID NO: 53533 - DNA, 1193 bp, Oryza sativa
ccaaaaaaaatgggatttttctctacttactcagcagcagagggaggccgaccttccactgatccccagtttggggagccatctgaagctgtcaattccgatgttgcttcatcaccctttggttttgaagatgtaaactgacctctattgcgctgcatcctacacatacatagaaaatattttaaactatgaagatttcctgtacataatctaagcagaggtaatttagaaaacatgaataacagcaaaatataaatcctactatctgccacggtaatatcaaaactgaaagtaaccacaagaaagacactgatacttaaaaaggtactacctccgtttcatattataagtcgctttgacactgatactttgatctttaagtttgactaagtttatataaaaatatagcaatattttcaacacaaaacaaacttattatcaaaatattgtaaatgttagttctaacaaaactaatttggtgttgtacatgttgctaaatttgtctataaacttggttaaacttgaagaagtttgactacgaaaaaagtcagaacgacttacaatatgaaacagagggagaatagcttaataaaagcagccagacaactcaaaactaaaacacgcttttggtacaaatacaatgtataagttgccaagtttagattatattattcagttcacttccactatattaagtacattgttagcagagtgtattactcacagatcaaatacagcacgcttgactcttcctaattcaggtcaatcagcattcaaataggaacaaaattctatagcatttcagtacgtataaacatccacagccaatgctaagctagcaccaacctaagtgcaacttccttccgaacagaataccggatcttcttatcaaagttgcgctccttccgcttttctctgaaccgcatcaaagatgccacccggtgtggaaaattcaacctctgaaaccaagggaaaaaaaatacacaatgaactccagagtgcacaatcctgtcaaacataatgaactgatactacaaagaaagacagttcaccatcacccgtgccaaccttactgtatggcgcagatgacgatgctccagagcccaaacctgggttcagctcccttccaccgagtagcaagagcactgcttgaacctgcgagaagtaatcgaacactcagccttttttttttt

SEQ ID NO: 53534 - DNA, 1506 bp, Oryza sativa
cagcagcaacatgagtcagtatcctaggcagctttcagtatcagattctgcttatctaactgacgacactgaaattgtgggaaatgctagtgtaactagaagattgacacagtgggtactagaggagagacaagatcgatctgtcatgtccatcttcggcatgggtggggtaggcaaaacaactatagcaagcagtatatttaaaaaccaacaatttatgatggcctttgcttgcaatgcttggattactctatcccagagttatgaaattgaagacttgctaaggcaaatcagcaagcaattgatggaccaacaggtgtacttggctagtaatgtcgaggctatgaatcgaataaaattaattgaggaacttcagatctacctaaagcgcaggaaatatctaattgtcttggatgatgtatgggataaagatgtttgattattcttgaattatgcatttgtcagaaacaatcttggaggcagggtactgatcaccactcgcaaaaaggatgttgctttcttagcagatcacaattgtgtagttgagcttgaagctcttccccatactgaagcatggcatctattctgtaagaaggcgttccgtagattggaagataaaatgtgcccagaaaatcttagaccttgggcagagaaaattgtgaccaagtgtcaaggattgccactggctatcgtagccatcggaagccttctatcataccgtgaattcgaggagcaggagtggaaactgttctacaaccaacttggctggcaattagctaacaatccagagctcaattggattgccaatattctaaacctgagcttaaatgatctcccaagttatctgagaagttgttttctatattgcagcctctttcctgaagactgcaggataaaagaaaaatgcttgttgagttatggattgcggaaggtcttgtagaagaaagaggagatggaacaacaatggaggaagttgctcagtgttaccttacagagctcactcagcgttctcttcttgctgtcatagaaaggaatgcatgtggaagggctagaacatttcgtatgcatgaccttgtgagagagatggcctcaatcattgctaagaaggagaggcttgctttttcatatgacaatgttggtataacccaagttgcccatgaataccgccgtttatggatccaaaaggacgctcagtccctcaggtatttaggaggttctaaactccgatctttcgttctgcttgatatcggagaaccatcttcttggatttatgatgctttatcacgtttcagactgctaagagttctgtgcctgagatttgccaatatcgaacaagttccaggtgtggtcacagaactatataacttacattatctagatttatcgcacacaaaagtgaaacatataccggcatcattcaaaaaccttatcaacctacagtttttagatatcaggtccagctatgtggaagagttgccgttggaaataactttgttaactaatttg

SEQ ID NO: 53535 - DNA, 1107 bp, Oryza sativa
cccctttgttttacaaaccaggcatttgagagttattgattgatagagctttaaaagtaggaccaaatcttgttctaaacgttaaatattcattatcgactatcgagtcgtgtgagtagcccatgcattcagatttggacacattaactccagatcatttcatagaggcttcaaagcccacatatattttacagccaggagcacaagtataacaacatggaaatacagcatcgtactgactattattttctttctactaagctacaaaaaattacagcattcctcagcttgaagctttcagaggcagacatagctctagctcacctggagccacttacattagtctacttaaatcccatagctaccactgggattctcacaaggtgacctcggtcccctttcatggggatctctccaaaactgtaggtgccagtcactgacctggccgtgagggtcgccgttatctctctcgatgcgccggggagcactgtcagcgctggaggtgagacctccagcgcgatctccggcgacattcttgtcatgatggtgtaggtttcggcctcggcggccacgcttgtaactgtccgcttcaccgtctgcgtgcctctaagctgggagatggtgattgaggggatgttgagatcataggggcgctgctgcaccttggagctggagctgcaagttgaaccagttatgtttgatacttcactgtgttccacgtcggggatcgaacacaaaaatgtgatgtaatcttgatgagctaccaacaaaaaaaaattcaaacttagaatggtcttcagattattgtctgaataacatggagcagtttgaatttattaaaaaattgcatacgaaaaatttaacttacttgcatccagaacaaggccaggatccagggcggcttttgggttaaccgcaccactgccataatcaaacggcgtagccgtgtaagtgtcataatttctgatgtagagtactgttgtgctcttaaaggatggctccccttgtccaatgtattagatgtagtcatcaaggcagattttattgctgagggactccacttggggttcttctgttttattagtgccgcgataccagcaatatgtg

SEQ ID NO: 53536 - DNA, 814 bp, Oryza sativa
ctgcacccccagcatagcaaatatatgtgtaaacgtggccacttgaaagttgacacttcatagtgtaatataagagcatctaacattacaagccttgataataccgaattctgcttcacgtactcatacaacacattagtccatatactacaagtagaggtccacaggaagaacaactccagaatgctgtcttattcgcacatatttacataagaggtcacctgggcgacatcgccatagcttaagcttgataggcgcgacaatcgcgaataagatttatacaaaaaaccaacatgtgaagatcttagtgtagcacgttgccttcacatgttcgttcttgcctgtcacatattcactcctgcaacaacctctgggtgatagtggagcatctcctgccacatcatctcccggatcatatccacgccaagattttcatcgatgtcgagatcgatgggcacttgagcaggagggtttgcgcttggatcatacagtggagacatgtaagggtgctccagagcttcagtgacactaatccttttggagggatcaaagacgagcatcttctgcaacagatcaatggcaagaggatgtgcttgcgggtacatactggtgagggggatgccaggagtgtatggaagggtcttgatatacttgcgggcctttgggttgtcaatgaactcaatgtcagcttcactcatggtgccgagaacgttgactatgagcttgagctgattgaggcactcagttcctggaaatattggcttgcggccaagcagctcagcaaagatgcagccaacagaccagacatctatgg

SEQ ID NO: 53537 - DNA, 792 bp, Oryza sativa
ttggtttcctgaggatatctagtccctagttcccagattctgactagtggagttctatcctaaaacggtaagtgcatcgcatcaattgctgttccttgtcttcctttttttctaatggcacagtagaacaatagcttcaaatgctgcattatccgattcaggcctaagtcaggggtgaattatttcagaaacaaatgtagataaatgctgactcgtcccaaatgctgtgaatttccccagatatgaaaactagtagctagttaatgaatccattggaaagcattagattatggccaaaacactataacaagcactaaatattatcatgaatattcgacctaaaagccagagtgtaccaacagctgtactaaaaaaaagggatatggctcacttgtatctttatctgataatagaagaaatgaaactaggcagcaacagcaacatgccagcagctgcaataggtaatgacaacctactggactaatagatggatttgaaccatcaaaacaggctcattttcacttctcaggagcaagaagtacatcacattcatcaatatcatacgtcatggtggaaccgctgcttataacatttcttttggaacaattaataaatgaaatattatgtgaacaggaagtaaacaagaataaaaatggaaacaatggtatgagccttacctgaaaaaggaaatattgacagtggtcattagaaagaggttgagatgatttaattatctggtgtagatctgtgtccatgagttcataaaccaagtatacatctttgaaactcctt

SEQ ID NO: 53538 - DNA, 1138 bp, Oryza sativa
ttcaacttatgcaatcgacttactgggtcaaaattacaccctctgagacccaaaaatagcctaatgtttgtcatcattacacccttgaccttgagacaaagacatgtatgtatatatatattcagaaaagcatgatgatgatgtatgtatatagtacacggttgctgtttgtgtagcattttctgagttacatgttagtagcatttctgcaatctccctgtatatgtctttgccatttcctttcccggccagcctaatttaatcaacaaattccccaacatcatgcacatatgtatgtgcgtggtcggtacgagtggaaccggcaataatagatactccctccatcccaaaatatttgacgttgttgacttttaaaaaatgtttgaccgttcgtcttatttaaaaaaattaagtaattattaattcttttcctatcatttgatttattgttaaatatacttttatatatacatatagttttacacattttataaaaaattttgaataagacgaacggttaaacatgtttaaaaaaatcaacagcgtcaaatatttagggaaggaaggagtaatagctagtatcctaatatctgatatcaacaagttgaagtcgattagagaaataattatatctctctgcatattaaagatttaaagtcagcgaatgctgctaccttgtttcaggctttcagctagcccaagtggctctccgtgaacatatcaacaaggaactgacagaaatgatagattcaaaggtacatacacatagtggacttgcaaggactatatatgaacaacacattgtatatatacatttgattaatctgttcgtcggcatcgtgagttttcagctgaggagagatatctagcctactaaacccaacctgatccaagcccattgtaaagaaagaaaacaaaatcaactttacaccttttcacacaagagttcaacttatgcaactgaattctcttagagtcaaattaattacacatatgatacaaagcctcatgtttgtcaaaattacacccctaggacaaagacatgtatgtgtgtatattatatatagtaagcccgaattcatctgcgccgtccgtgtgtgtcaagatgtgtgctgctgaatcttacgttccacccaca

SEQ ID NO: 53539 - DNA, 2564 bp, Oryza sativa
  unsure (1)..(2564): unsure at all n locations
nnnnnnnnnnnnnnnnnnnnnnnnnnnnnnnnnnnnnnnnnnnnnnnnnnnnnnnnnnnnncaaccatcaattcttcattcaaaacaacaataatgctagcaaaaacaggtcacaagttgcatattattcctaagaaagttccagcatgaaatcttacttcatctgtataactataataattactagtacatatggtagagaatggtaatagtgagggggcagtgctggtggatgatgacatggatttgcacgtttggaacacttacttcatcacctcctaatgtaatctgacattccaaacaattatggcatgagcaagatagccaaagcttgggttcaacaaattctaatagatcgtgtgcacatagtatgacaatcactgccagcactaatatggtgtttgggattattaaatagtgttctcaccagatcttgcaaatatatatatcacgtccatgctgcagcttctagtagatgcaaatgaccttcgtgtgagtagctaactggagctgcctaaatccacaaaagtatacagcggtgagtcagttcacaagaatatgaaacaataagaccaacgattttgcactggcccaaagtatcgaactcgtggtgtgcataaagaaatagagtgctaactattgtaacctgccatcgattggcagaaacaaattcagcaagttcttactatgataagcggtcgttgattggcaggaacaaattcagccagtgaatccatcacggtgaggtggttgctgctggtgctgaaactgaaaacataggggatgcgcgcgggcaaagccgccagggaccacccgttcaacacggatgatgcactcatgccagcgccgcgcggctggaccggatcacgtcagttgacaacatggggctctttatggacaatttcacaaacacattgcatacaagacgagatgctggagaaaaaaacgacagcttagggtggtgataggtgttaccagcgtcttggctccagccgttcgggacggggcggaagttggaccacttggaggagtttgccttgccgaggatggtggcagcggcggcgcggaggccggccgtcacgctggcgtcacgacagacgacgaagccgagagcgcgaacgacccggccgtcgttttcagccggtcccgcgtcacgatgttgtccttgaggatggggacgccatggagcggcccgcagtagcggtggctagaggcgcgctcgcggtgtcngcgcgcgccggctgctggagcgcgtcggagttgacctcgatgacggcgtggagaagcgcgttgaggcgcacttcaagctatttatgaagatagccagactcaaatagaccaatagacgaggaaccgaagatagccagactcaaatagaccaatagacgaggaaccaattgagacagtagagcatggtaaagtcaaataacatagaattaaattaatggatgtgtttaccatttaatacgtttgatcaagaaaatatataatgttttagacaagttccaactaaattattataactttaaatataaatgaaaatgatagtttgcacacataacaaatgatacatgtacatttttgttttgaaagtaatttcttaatctcataaacttattatatttctataaatttatattttataaaagaattgtgatcaaacttccatctcaaaaacaagaatgtagaattaaatctcatgttatatatataaacaaaatcaaaattaccttaatttaatacttacatgtggaccgatttttttaacttatgggctctcgtagttttttgaaaaagaaataccgtactattttttatgagcaatttacatgaaaatacttcccgccaatctcgattttccgtctagagactgccgccaaaatttcacatctaacgaaccggctaatttatctccacattttcagctcacgatataataagtaggggtgaaaacggagcggattcggacagataatagctataccatatcctaaacctttttttaagcggatgcggagcgggtgcggatgacgtgcggatgcggatgcggagcggattatttcggacgtcggattcggtgcggagtcggtgcggactcggttcggaaacggacaaaaagttgtcggatgttaagtttgtattcaatccgtacaacaagagggcggcaatacaattagccgcaatacgatggcaaaacaacatatgaacatgatttcagctctctaggaaaaaccaaccaaaacacatcaataatataattttgcttaatataacacatccatcaaaaacataatataagtgttcagttcagcagttcactgtgttgcttaaaatttaaaaatatagtgttcagttcagtagatcagtagttcactcatcaatacgacacgcatgaggcaatgaggcatacagctatctaggcatacagcacacagccacacaacacagtagcacactgcatacagcacacaatacactagttccatacagcacactgcttacagcacacaacacacaacacnnnnnnnnnnnnnnnnnnnnnnnnnnnnnnnnnnnnnnnnnnn

SEQ ID NO: 53540 - DNA, 1514 bp, Oryza sativa
  unsure (1)..(1514): unsure at all n locations
cacatcgtccagccaacgttgggctggagactccgggtcatgggcgacaggcgggtgacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaggagtgcgagagctcagaagatcactcgcagagtcccctacctggcgcgccagatgacggagcgtggggctcctcatcgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttggtggattcgtgtgtgaaggagctacaaagtatgagccagcctctcccttgttctgggttcctaatctggaaaagtccagtccaaaaaaacctcccatctaagtgggcaaggtcctccttttatatcttaaggggataccacatgcaccatttccctcttttttgtggggacttcccccaccttttcataaatggacggagatttgtatcgttgtcgtccgagtcaccttctgatgggacggcccacaactacctccactttcgccgggagcagatgcgacgtggaatcgtggccgcctgctgacgacatgaccggagtcagaccagtcacgtcggtcattcttgtccaccacatgtcagcttagcaatctacatggtggccctttttcacacaatatcttgcttgtaatggttaggataaagcttggcatatatctgatcaggactaagttgccatctctgggaggtaacacgctagctcaagttgggaacgagcgcctagaagccctcgtcctgacggaatggggcgaggcgtgcgtcagaccgcctgtcgccacctaacccgcgatctgaccggtctgtgactggtcacagaccggataaatgagtgcactgcactgcgttacatgcggcgtgacacgctcagccaaaccgcaataaatgtggttaggtgagccncactgtgctcacctaacccatacacgcggagcgaaaacccacgaggggtcggggcgcctcggccctcggggccgaggcgggtgcggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53541 - DNA, 710 bp, Oryza sativa
acagaaagccacagccattccttttcttaacgggctccattttataatcgtctatagaaaaggttggggccgttgtaaggtcataggctgcctgtgaaaatatgtcaccatcgattacttaagaaacccgcctacactaatgaattcattattatttgcaaattcctagagaatccaagtcagtcgtaagttcataacagttaatatcaatctgaaaatgactctgtacaccacacttgcaattgcaacatagagttgtcgttggttgtactattccatcatcaattctcattgtgatcagttgcatggtttgtgatttgatgttatacttcagatttttctcttcgaacaagatttcttttaatcgatctcctcttgttcctcaatgctcagagaatgcggtgcattctttgttaatgcagagatagacagctgaatttccagttatcttaagaactctacagaatcagattcggaagcaaaataatggacattgttcaccttcttgaaagccacaaccttctttgcttcctgaaatctttgctcatgtactcctaccttctaggccagatgagccaaactttcaaagtcctgagccagaaacttttctctaattggagccagcaaatcctggaaagctagatcggctaactgagaatctaacaaaaccaagctgtaacacggtaccgagctcgaattcgccctatagt

SEQ ID NO: 53542 - DNA, 800 bp, Oryza sativa
  unsure (1)..(800): unsure at all n locations
nnnnnnnnnnnnnnnnnnnnnnnnnnnnnnnnnnnnnnnnnnnnnnnnnnnnnnnnntgcataacagcaagtttgaaggaactaaggctaccacacaaagcaaaatgcaactagttgagcaacagtatgttgttccattacaagtacttgggatcacatgaatagcattgttgttcaaaaaacagaagaccacaaggcaacatcacagggacacgcattgatcattcacttgagtctgcgcaggggctgctgggtcatagctcttctagttccggtggcagaggcgcagcaacattgttggagtggaagaccatgttgtacagcatctgcgaacgcaagtcgttgtactcctcctgcacaaaatgagaacagattcagcagggtaaataaggtggctaaaggttttccccggcaacgtaaatggttgtagcagttttaccgattcagcgacttgtatcaggggggagtcatcgccttcatatagctccatgcgattcaaatagatctaatctacatggcacgaacgtgggcaaccgaacacggtttttgcggacactgggctttgacatgcggtgctcgaaacaatgttccgtgcgcaagtgcgctgaataacgctaccgcataatatattgaatttcataaggaaatttacagaattattggttacatctttgaacaaagaaattcataggcatatcttttaaaaagaaaaaagtcacattttcagcagcaaagctctggtagataaattgtgcaatgtatctatttctatataatcttcgcaaattccttcgctactt

SEQ ID NO: 53543 - DNA, 1775 bp, Oryza sativa
  unsure (1)..(1775): unsure at all n locations
nnnnnnnnnnnnnnnnnnnnnnnnnnnnnnnnnnnnnnnnnnnnnnnnnnnnnnnnnnnnnnnnnncggcgcaacttggcttaaagcaagaagaagtctgcaggtttgtcccactccatacggagggagcagttgtgtgcactctgtactaatccacgtatggcgtcgaaaataaaaacgacaataacaacacactaacacgacattagcatgaggatgggggtttatggattggttcagctaaccgcccgaccgaccaaatgatgttgtgctttttcgtgttgaaagatgattaattaactcgatggcaggaaattctaaccaatgtgctgtgtagctaagatcatcggatggaacttttgttgattgattaggacgttggatatgctgcccatatgctgcttcagttgcagccagcatcagatgcgagccccatacactcaggtggagcacctcaaatgtgaagatgaagctgaaaatgacatttttggtacgtgtttggttctgtttctagcttaaggccctctttatttaggcttaggtttattggcctagacttttaagtcagcttattggtttatatgatttataagccggtgaatttaatgtcctaagtttagtagttgagtcatacatctacctcacataagccaaaaaagcttctccaacctagcttttggcttaatagtattagagtggcttatggtttcaaaaaagctaaacggaaaagctgcttgtttgtttaggcttagacttttcgacttataagttagcttataagcctaaacagagaggcctacagatactactactgtctattgttgatattgaatacggagtactagcatttcttgccttcgtgatggtggtgtatgcaaaaggaaccttgatctgaatgacccaatgaaacaagtaacatagtcagcactcagcacaatgactaaggttttcctcttcttctttttttccttgtaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccatgcaaccacatgttttcatggtaaggacctagcttagtacactgcttagctttggcaccggcggcccaggtggctagatgataggtttttggtttgtaccatgggaactttcacctgtgtggtgtagggaggaccgcccatgggggaagccggtgttagggcgaggtaggggaaacgctttgttacactttggtgtttagcggcaccgaactgtatcttgtgggtaaagttgtacaacctctgcagagtgtcaatctattcgaatagccgcgtcctcggttatggacatgctcggtgacttcacatgaggggtagatttgtgaaagttttaattttgggaaagagttgtgtgcaggaattaatgaatatagatgtgttgtcctgtgtggacaaagaaccttttggtcttgtgtggacacagtatcctttttgggttggttggttggttaaaaatgttgtgattgcaaatgttgcttaaattaaatttatatctatagtgagt

SEQ ID NO: 53544 - DNA, 1623 bp, Oryza sativa
  unsure (1)..(1623): unsure at all n locations
tgtagaagttagaaataatacttctgctcatacacaccaatcctttgctctactggagactcaagtgcaatattgaatccatcaagagcataacaaaatcaaataatagagaggattgtaacagattaccccatcaagttggtgaaataaaggagcaattaggataaccaatagatcagctaatggaacacataatgaacagaaattccttagacctttgttgtcgaagtgacaactgcatacgtcgaaggatgtggttgctcaagggttcttggaaacaacgaagtgtactaatttaaggatttttcttttgaatgcccctttacatggccctaggggtctatttatagttctattacagatccccctattagggtttaggttttacaggggaatttacatggttgccctcatgagagggacacttgtatgggcatacaatgtaattgaaatatatgggcctccaatgggccggttggcgaatgttggcccactggccaatgggatagagcggctgggatggccccttgggcctcctggagctgggcttgataccgcgaagtcatcctccttcggcaagcacccttcaccatttagccttcgcctaggacgcatttggacttgcagggtcccaacgcgactcttcacccttcgccgcctttgcccccatagtcttcgccatggggcttcgccccgacgaaccttgacgccttgagtctgaatcctcgctggttgcatggtttcggcaggtctggtcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaataaagtatggctcatacagatcaataattcatctttccatcagtggcgacctcacccgcgacgatgtcaacttccgctggtccttttgctgcaccatcggctgaattccccgaggtaagtccccatcggctagatcccttgttcttgcagtagattagttctttcttcgctcaatctgcctttttcctcttttcttctatagaacctttctcatcagatcgcaatcccaagtttagttcatcccaatcagtactttcttggtccgatcgacaatttggatccaactgagttcattaatgccgaaaccaataggatcccctttagactagccagttgtgcaaccgggaccccgaatcaggtactaaagatgggcatatagtcccggttgaaataatcgagactaaagatgaatcttcgtaatacgaaccaacactaaagatcagagtgccacgtggctgacgctctcatctttagtatttttttttgttttatttttaattattttttttgctacttatattaatttcaaaccaaactcaacgacaaaatcatccccattcacaaaacatcacaaaatcatcgacaaattcatagatcgaatgaacatactcaaattgacataacaaattcattagctcgaattcgcc

SEQ ID NO: 53545 - DNA, 734 bp, Oryza sativa
aagtggaactagggcagcaaaaactgtgatcatcagaagctattgctgggaccacctccaagcatctcctccctgtcgatgaagcgctcaagaagctccttgttcttggtaacgatgcattcatcatccttgccaaaccaatcgtagcgattctttgcaatgtaatcgtagattgcatcccgcagtggggcggggatgatcagcagggagctcaaagctgagtagggaagaggcaggtacgatgcaactttcaaagcagctgcaaccaaaacatggaagatttagtaccctgattaccacaggaaataagggtgggcaaatatgacatgattaaacagcaaaaagtacataaagaattgctgtttattttttttccctaaatgagtatcattaaaaggatccttcagttagtactttcgatcttccagttagtgctgctatatggacagtacaaccatatctataatctatgtattctgccagattaattggtgtctcagggaatgattgagctacattatgaaaggaactgtggcctctagaaatttgtacttttttgcaggagcacagcaatggctatcattgcaataacttggttgaacaaatgcatgatccaaaaaaaaaatactagagtgtaaagcatgttgctctcatgcattactggtaaataagggggcacacctatctatcacaaacctagcaaatgggtaccgagctcgaattcgccctatagt

SEQ ID NO: 53546 - DNA, 942 bp, Oryza sativa
tgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcata

SEQ ID NO: 53547 - DNA, 1557 bp, Oryza sativa
  unsure (1)..(1557): unsure at all n locations
ataattttgtggattaacaagtagggtccatgagtcattctcagagggaagttatagttatgggcacactgcaggcacagcgaccacgggccatccactagtagtttgatggcgccgagaacaagaggagacaccgggctcatggcggaggacggtgatgatgcagcattgtgatggaaccgctatgtccatggaaaaggggacagcaacaacgctttggcaaccgtccataaggagaagatagcagcagcggcatgagcccctagaaataggcgctgccaacaggacagggaggatttggccaaagtcgacctcgcggcaacatgtgtttttcccgactttaggaggcagcgaagcaaggaagaggagtagcagcacaacggcgtcttggcgttggtgaacaacggtgttgcattatggagtgttctgactgacaacgatggcacaactacgagtgggcgatggcatggaagaaagcagcggcgctgatgttcattcacccgaggcggcattggtggatgtgatggtatagcatcacatatagatgaccaaaaggcccgcccggcacggcccggcccatgcacagccaggcacggcccaccagccatcgggccggcacggcccgatcggcacttcatgccgggctgtgccgggccggcccgaaggcacggatggtccatcgtgcctttttttaaataagtctattttccgtccctcctctttgggctgtgacatatatatagtgaaaataagtctatttccgtccctcctctttgggctgacatatatatatagctaaaataagtctatttgacgtccctattcttttgaccgtggtatataatatgtctatttttactccctattgtttatgtgtcgggcctggactgcggcccatcatgccgtgctagcctggtcgtgctgggccagcccaacgtgccggtggaggggcccaggcacggcccggtggttggccgggccagcacgggcccaacccctgacgggccgtgccgtgcttgggccgggccaaaacaccgtgccgtgggccgggccgtcgggcctcgggccttttggccatctatagcatcacaacagcaagatgaagagtcccagtgtgcacgaataaaataaaataaaaattggagggcaagcgctgctgtatagggaagccagagcagagagcatctcagcatgcgcgagcaaaagaaaaggattgcagaggtgttgttaaatatatatagaggagaaaaggggaaaagtacgagcagccataagatggagagatggtgaaaacagagctaaccgatcgacggtgatagtgatttagtttttgataaataaaggaggaaatgattataaaaagtggaggcagtgcaggtccttaccaaccacgatagtggagacatggcagcaacaatatgtgctagacgacgaggcagtggcgtctttatgtgcacacgacagcaacccgacatggaagaacagaagagcagcagagtgatnnnnnnnnnnnnnnnnnnnnnnnnnnnnnnnnnnnnnnnnnnnnnnnnnnnnnnn

SEQ ID NO: 53548 - DNA, 1653 bp, Oryza sativa
atgcgtgcatggcgccgctcgctcgagtggacactcgctctacctccgctccatccccgtgtgctcccccctcaaggcatgtcgcagccacgactctgcccacgtcgtccgtgtggcggccgcagaggcaagctctctcttcccccacccgcggcggctgccgtccccaccaccattgccgccacaactcaccgccatccccaccgccgctctggccaggtgaagagaaaggccgggggagagagagataagagagagggggaggaggaagaagggaatgagagaagatgacatgtgggccctacatgtcagtgggtaccacaatattatttttgtgaatggcaaataagtcatgcacattcttttttgattttaatgccacataagcgtcacatcaacgccacgtggaatgaagacccggtcaataccgtcaagtaggtgccacgtcagcgaaaccgctctctaaaaccaccaagggagataaaatgcaccggttttaatagttgggggcccggtatatgcgaaacagattcagccattagtgaagggagtaaaagtaaacttattctgaagaatttgagttaagcccagtgcgtatctggacccatatctgccactgttcctttttgttttgaactccaattttattgggcctgaaattagtaggcctacgatatgctgtgcataccattatacacgtgaaatgtcattttcgtactactgtagtactttacaaatatttttgaaagtgaaactgatcctgagtttcttctgatatttccaaacctccctgcgttgttctcatcctcaggccctctaaataacaaaatgttgcaccgcagtgatgactgcttgattaacaacatgctagtatatggttatttagctttatttttccaagaactatgtttaagctttgcactatgtataaattttataccataatatgcaattatccacaccatattatcagctattcctacatctatctcaacggtcaccaattctagaaagaaaaattctccgatgatcgatgatcatacacccggtcgtgcccatggcctacgcccactggctgtcctctccgccatcgccacgctgtcgccgccaaaatccaccgacatggctcccgctccagctcccaccactgccaccggcctcccgtacgcctgcagcaccagcaccgacgccgtcgtctggaagtccttggacgccagcaggtcgccgatcggccccagctccggcgactcgctccactccgccatccccgccgtcagcccggaccccccgggcaccttcccgacgacgaacaggtccttgttccccatggcctccacgctctgtatctcccccaccatctcgctcgcgttgaacacgccgcgctccctgtactccaccgtcgcgccgccgccctcgttcgccctctctaggaagtcacgcaggcacccctcgtcggccttccgctctttcagcgcgtcgaactcgcttgcagtgaagcttcctcccttctggacgaaccggagcaatgtcaggtcgatggtcgggttcctcaccatgcgcgtcgcaagcgccgccacctcccggtcgtcgctcccgccgaagaagagcgccaccacgcggtacccgccacccggcaccgcggcgaggccacgg

SEQ ID NO: 53549 - DNA, 709 bp, Oryza sativa
aaattggggtcttgttcctggatggatgctagaaaattgggatcttattcctctatttcttgtttcatttctttctttcatcgagaaaagctcccaactaagctactgctgcctccacacgtgagcgtggctcgtgctgctagctgttgctgatttccgtcccagtctccaggatgcagccgcagtctcgactcacttgacgagaaatacgaatacacgacacaatttccgttccctgagcaatgaaagaatgagtgattgaactgtagagtagatccgattaaccatcgaagaaaaaaaaaggaaaagtagagtactaagaaaaataaatagtgcatgcctccatgtctatacactgccatatgcattcgtaaatagctagcctagcactcctggagaaaattaaatgtcatacatttttttgatagattgatgactagcacggcaaattggaaatataatctagatcgtaaaaaaaactaacatacatgcacctaaaaaatatcaaacccggctcctgtataccgcataggagcttatcagttttgctatgatgtctaaacctttaagaaattaccacgttaattagagaaaaataaaaaaaaatatcaactgtttgattggagtatgtctaatgcgcaatcaaccgcacatgacatccatgcagtccacacctgccccttactgagtatattatcaaacgaaatct

SEQ ID NO: 53550 - DNA, 1031 bp, Oryza sativa
gcttcacgttgcaaacagtgggggaaaccaccattgcgatctgtcctccccgggcaacgcacggtgggtggtcggtctggtcgaaagtgagggcaacctccgaccaccgcgcctggcgcgtcgcctcatgagtaggggccgcggccagaagctctcgcttcatggccttgaggctccggcgataaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcccgcaggcctcccctttcgggtggcccgcggagcgccctcgacggcgaggacatgaccctcgtcgtcggtatgggctgacctcttcttcctcctcctatcatgccgccctgtctgagcggcggatccgggggcggccgaagctgccacaccggaaccggaggggttccaggtccatgcctcctccttacgagccactcggtccgcgagctgaaaaagctccgcggtagcctggggctctttggaggcgatcttttcgagcatgcggttgtgccgcacaccccccctaaacgcgtaaatcaccgcgtgtgcagggatgcatggtatggtgttacggacttgacagaaccgctgaatgtacgagcgaagtgactcatcatcccttcgctgtactgcgtgcaagtccgcttcctcacctgggcgcggatatgtgccttgaaagttcatggtgaactgtggcacaaatcctcccaagagtggacagatgcgggtggcaagttcattagccaaccccgcgcctgtcctttca

SEQ ID NO: 53551 - DNA, 873 bp, Oryza sativa
gcatgaagaaaaatccaagctcgatcaattatctaaaggtccaatcaaatctaacattgatcggcttgaagctcgcaaaattgatctcttagcacaacttgaagaatgcaacgctgagctggatatggaacgcaagaagctagccgatctcccccagtccattgaagagcagaaagctaggctcaaataggttattaagcatgttgctgaactgaccaagtccttaaaagttattcctgcaaccgatgcgcaagatgctcaagccatagaggaagtagagcagattaggcagaaagctatatcggctatccagcaatacttatcgcagtaatcttactgtaataggacttagagcttctgcaatcggctaaacattcttcatcccttaacatccttctgtgccgattagtatgactgtgagatttgctcaaaaaattttgcactatatttactgcattgtaacagatctatgccccctagttttacaatgtcaacagcattgataaaactataaaacaactaagggcgatataacaatatcggccattgtcaattggcaaacctcagccgattacattataaaccaactaagggcgatataataatatcggccatcacaaggcgatgtacacacatcggctatcatgtatcgacattagtagccgatcacgagttaatccatacactcgagtaatatttcttcaagtatttacaattaagagctcggccataaacttcaccatcaagcccttgcagcatatatgctcccttagaaacaaccttttgaatctagaacggtcctccccaatttggcgaccacttgtcgaatttattatcacgagtaccaatcagcaaaatcaacttccagacaag

SEQ ID NO: 53552 - DNA, 1682 bp, Oryza sativa
  unsure (1)..(1682): unsure at all n locations
aaaaattcataactaattcatcttagctcggatttagttggttcaagtctctaattttttctaaaattgagatctacatgttaaaaatatccacatgtactgttcatgcttgtttatgtgctgttttggtgattttgctcttttctctttagattccgacgtttccggagagtctgagtttgcaggagaagattttgaagagttccaaggccagcaaggcaagtcacacagatcccaaacaaccctttgagcatgttgatcccgtttaaagctattgtttctattcaactattgcatttattttcgaatgtcgttgggtggaattttaaaccctnaattgttttttttttgggggtntttttttaaaaatttctcgcctttttgttcttgattactttattccttgataccttgggttattataacttgactagtcgggctttatatattggttcagctagatattagatatgattgcttagccatgcttagaaacattagcacactattgggacaacttatgactcactattatttaatgatggcttaatgatagctcatgatggttaatcatgattggttaattaattaatttgccaactaaaacctgataatggtgggttgtgagcacatggttttgatggtcgtgctcatgacaattaaggaccggttcatgagtttcggttgtaaaatattaaccgtgccaaccacaagccagcgtgggcaacagctttaccttttgtatagcatggttcattgcggggcaccagactgagaagtggcggagataagcccacgggggtcgctggggagtccatgccttgtttataagggggcgattatgatccaggaatagtgcgctgtggtggattgtgttgtgcgaggggtactgtcacagctcctttccgaggtaccgtggtggtattgaggcgcatggtgacatgtcgtggggctgtgtcttgtgggtatagtggtacatttctgaccagtgtaaaactattcgaatagccgtgcccgcggttatggacgggtctaacaatgtctttcgtgattagtttcacacttctcaccataataaaagattctataactggtaataatttgattagctcctggtttggaatggtatattcctggtttggagatagaactgtgcagccgggataggttgttcagaatgggtgggcctatgcaacagggtatgttgtatagcgttggattaatattgtttaattactacttaactattttattaaattctgaaatgtttattaaatgctgtttatgcaaatgaaaccctactatgccatcctttgttatcctgtgcacttgcatatttgctgcatggcttgctgagtatgtcatatactcaccttgcaatcattcatcagaggaggagttctacagtgatgctgatggtgtgaaggattaggtgtagccctggtcaagctgcctgtggagtggagtcgtctgcgccgtttatcttattttttccgctgcttagatctttattgattgagaggaactatctacctctgtaatgacattttattcgcttattaattagagtaataattgtactctattatcaatttgttattgtgtgcctcggctgattcctaaacgagggttcacacacatgtaagcgtttagaattttggatagaaattccgggtgtgaca

SEQ ID NO: 53553 - DNA, 804 bp, Oryza sativa
gatcatctgatgcaaaaacggccgctgagccaggctgcgaggaaacgcggaaatcggccgtaggtcctcagccaggcccagctcacgccgacgcggggatgagcggatgcaagtgtgggatggacgagaaaatgaacatttagccacgttcgaaacacagttttcctagaatgccatctcgaaaacgcgtttcactaaaattccaatataaagcgcgtgctcatcaccactttgccattttggcccttttgtgcattttcaaaatcatcttcgcttcttcagtggataatgagacgaaattgccctccatccttccccttccatggtggcagccttggcagcgccatcggatgagcccaccaccgctgccgacgacggcgggatggccaacagcgccgtcggatgagtccacgcccgctgccaacgagggtatctgggtgcgtggagcgacaaaaccaccggcagctgcccctgcctgccgcatccggacggcaccgacgaggcggaagcagaggtgaggtcgtcgaggaggcccccccttcgcctccgtcgccgacgaggccatggggccacctcgaaaccctagccgccatcgtcgaccacggcgaagcgacctccgggatgtcgtcgtcgaccgcggcgaggtagtcggcggaggtggcaaggtcgagggaagagaatatgtcggaggactcgccggccacctcgttgtctgggctccccatatagcactgcttcagatgccatccatggaggaggaggaggaagacggtgagctgctcatggtggacatggagatggccg

SEQ ID NO: 53554 - DNA, 1483 bp, Oryza sativa
  unsure (1)..(1483): unsure at all n locations
ccatttatcaaattcatccgacagctgatctaaggtatctgtagaaagcattgaaagatactcttgaaaagcctgtttagacaaagggagggtaaaagtctaagacaagtccattaaggaagtcagatgaactgagtcttttgagtaaattccctatgtaccccctgaaaactcactctatccctttcatgcccctgaaatttacccgatcccttatatacccctgaaatttcaacttgatcccttttatgcccctaccgctacattttcattcatttcactattacgtttgattgcaaatgtcttttttgcccttgatgctttaggtttgaatataagcttgaaaaaaattgaaatttttgtttgagtgcacaatatgtgcattttatgaaactaatgagactaaattttgaaaataaaaacaaatgtaataaattaaaatttctatttgaaattttaataggataatggatttttttatcgggagcattcataaaaaaattattgtgagcattggtagtcctatgtttgtaggaatgctcctctttttgatgactttgtttcaaaaataaatacatattttttatttcatatctaaaaataaattttgtgataaataatgcatcacacaacaaactcataactataatagtctcatgcgacaaacttttacatttttagtaatataattaataaatttctatgttcatccagagggtaaaataatcatttttagaaattagacggtcaactgatggcaggggtatgaaagggatcaaaattaaattttggaggtatacaaggaagtaagcaaaattcagaggcatagaagggattagcttaaaattcaggggtatacaagggattttctcgagtctttttggttccttgcaaaagagaaagctctaggataactcctttgcctaatcttatcattccatagatcagaccaaaacaaacaggttctgccatcaccaattgtgcactttaaaagacctctaaagatatcaacaaactgtagagcatctttccaccaaaaagaaccttttagagataaagcatgtgggactttatcactataataagaggaccatgtcaatttaacccaaggaacaagatgcctattataaaatttatgaagatttttcattagcaaggcattgttttgaagtctaagatcaattactcctaaaccccctttagacttgggttggcaaactctatcccaaaggatcaaggatttcctactggaatttatgtctgaacctctccataaacaatgcctncttgctctattaatagaaaggatgacagatttggccaggaaagagtgcacgtgtaaaatatcggcanagaagaaagcactgattaaccatagtcaatctgtcaccataagagagtatggaagaagtagcacggcaattttgtttcaattctatccacaagaaggctgaaatcaattaccttaggtctacttataccc

SEQ ID NO: 53555 - DNA, 1088 bp, Oryza sativa
cattatgaaacggaggaagtagtaattaactacctttgtacttattttgaatattctacttgttcgttctaactatttgtcagtagagcattctaacgttttacagcttggcaaatttttgcatgtcattatcgtatccagttttccacctaactgaaatccatgtcctgaaattgctttttcataggttgttttctgaagatggctgacgatttgggccctcccactgtgctccagaagatacatgggcagtccatgatgttcagcaagatctcaccttattctttgatgaagaatcccgcactctacaatgccaacacttcttacagtgtgcctctgaagtcatacaatgggatggatgggaacaatgggttctcatctgtcacatctgtatccccagtctttgcttctgccccaaaggagaaaggtctttctgggtttatgattgacttcatgatgggtggagtttcagctgctgtctccaagactgctgctgctcccattgagcgaatcaagcttctcattcaaaaccaggatgaaatgatcaagagtggtaggctctctcacccatacaaaggtattgcggactgctttggccgcacaattaaggatgaaggtgtgattgcactgtggagagggaacactgctaatgtcatccgttactttcctacccaggtactgcatcctactgtctgttttttatttattctccccttggatgttgacttatattgtacatttgcttaggccttgaactttgccttcaaagaccatttcaagcgcatgttcaactttaagaaggacaaggatggttactggaagtggtttgctggaaacctggcttctggaggagctgctggtgcttgctctctcttctttgtgtattctctggattatgctcgtactcgtctggctaatgatgccaaggctgcaaagaagggtggtgggaggcaattcaatggacttgttgatgtttaccgcaaggcccctgcgtctgatggtattgctggtctgtaccgtggattcaacatctcctgtgttggtatcattgttctatcgtggggctgaactttggaatgtatgattct

SEQ ID NO: 53556 - DNA, 1409 bp, Oryza sativa
ctgaacgcgcacgcgtatgtgtaccctattacctagacgggaccaaccgaagtcagtcccgggtaaagaggggaaaaatccccccggacgagggacgagcgtcaagtttgggactcgaacgctggtcggcacggagcgagccactggctcctgccacccgcgctacgcacggtcctcgcatcttggatgctaccaacaacccttttggtcgcctggacgtgtctccgagccaggcccatggaatgcaaaacagcccacggaaacaagacgaatcgagctttgatgcttgtcctggctcgatgcacgccacgacgatgcatccgggtgtgcaaacaccacacccccgagtgcaaaagcggggatgacgggtcaacaccctcccccctactcttctcgtcattcctcctcttctccatcttccgttggtcatcctccctctcttcgctagtcgtgctcgctctatgtgtcagacccctctattctactggctctcaccatcaccctgcactattacaaaaactctaaagggtgccggttgggaaacccccttcggtgccggtttttccaactggcaaccaggaggcggcactgatcacccaatgtcaaaggtgctggttccaaaaccggcacctttgaggtgcccatgagctaaaaaaaatcggctcaatgcatcgagccgatgcattgagccgtcaagccgatccaatatagtacccaaatcccaaaatttcctcaaattcatgaacacaaacatagtctataatcctttaaaaaacaacatatcaacatcacattcatcaagaacacacattatcaagaatcaaacacattcatcaaaaacagacattcatcaagactaaatcggatcgaggaggaggcttgccttcatcaccaccccgccaccgccggatggagaggacgagggcgccgccaccaccgttgccgctgccaaggaagctgtcgttgccacctcccgccgccgacccgccaccgccacttccccttccgccagatctggcggaggggagggcgcagccgccgggccgtcgaaccaccgccgcttcccttcctgccaccgatccgccgccgtcgggccgccgaagccacctcccctcccgccagatctggcggaggagggtgtcgcccgccgccgccgccttttttcccgccgccgcctgttgctgccgccgagtccctcccgccacctccttggggtgcccagagaaagagagaagtcatggctgagaaagaggataatgtttcccctcacctcccacgcgagtggataaggccgtctctcggctcggctcgttgtcggttttttaagaaaaccgaccctttaatatattataggtgtcggttaatttgacacctataatatattataggttccggttttttttaaaaaa

SEQ ID NO: 53557 - DNA, 1083 bp, Oryza sativa
  unsure (1)..(1083): unsure at all n locations
nnnnnnnnnnnnnnnnnnnnnnnnnnnnnnnnnnnnnnnnnnnnnnnnnnnnnnnnnnnnnntttcccctaaaagtgagtttaggtagtgtcctagggctaaaaccacacattaacaatgtcctttagcaaaatttgccttttagttttgcttccttgctccttggcttccttgcagacttgctgcttgctcttgccactgcggcctgtggtgctgcagtagcccgcagcttcgccaaattaacataaaacaaactcaatcgtgagagtgacccaggcgcccagcatgacttcgccgcgccgtcgccctcgggctcacttgaagaagagagaaagaatgagatagagagaaaagaacaaggataaggaaaaaaaaataaagggtaaaatcgtacttacacagctgtttctctctccaattccttcacatataataacataatctggcaggtgtccagcaactaattaccagttttttttgtccactagctaattatacgtttttttaattttctgtagcaaattttgtctttaatatatgcagcaggtatatgactcttggctgattttcttaaaatactcacatgtattactaccaatgtgatctaaaccacaaggcataaccgtgcgagtatttgttcactttaatatttgatactttttatcaacatattgtcagaaatttttatatatttatgttttaaccttgtcattttttttaggcttatgaacctacaacacgcatgcattaatattatattttttactgcactttatatatgatgcagggatatatattgcttcgattaaacatatgggtgcagtgaattcatgttacttttgaattattttaatttttactctgcctgtattatcaaacatatgggtgccgccggagtcgctgccgccagatcgagcaccggccgagcaccaccgccacccattggatctgggagaggggagggggttagaggaagccgctggaaccttcgaggcccggccgtcgtcgtcgtgtggcagccgctgctggatccacccggaccgccactcttcgccgccgcccgcaccccttcccggcctggga

SEQ ID NO: 53558 - DNA, 1895 bp, Oryza sativa
  unsure (1)..(1895): unsure at all n locations
nnnnnnnnnnnnnnnnnnnnnnnnnnnnnnnnnnnnnnnnnnnnnnnnnnnnnnnnttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttatgtaaaactcttgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccatcaaaggtattgctcatacctttgacgggcttctattcaacggcccgtcactggtatcctctcacctgtgacgggccagaaatgaaagccgtcacaggtggcggcccatcacctctgacggcttctaatgtatcggcccgtcacaggtgaggggataccagtgacgggttggaagaaaaactcgtcactggtatacctctgacgggttttcctttcggcccgtcacaggtgaggggatacctgtgacgggccgcggccagatgcctcaccggtgacggcatcccgtataacccgtcaaaggtaatggtcactactgaccaattcgtttgcccgtcacaggtatcccgtcagaggtgtgaggatctggcgtagtgaaggtacccgtggaaaggtactaaaaacgtgtgctaggtattagtttcaggattacgtgtgctagtaattttgtatatgttgattactttaaaaaagcaaggttttaatcgatcgatgcatttcatattattcagatccacttagtattattcggagttccttttgaagatggcggtcggatcttgatagtggatgttatcgtaaactctgcagcaaatagcacttttgatgaggtattacattaaatctatagtcgaagtatctttagatcggatggccatcgtcaagtgagattttctaaataccatgtgtgatgataaatcgaagtgattaatcaattttgcatacgaactcatgataaaactgtagaatgcacaacttgttattacatataaaactgaaaagatagaattttagtttttgaaagtactaatacaatcaattagtcgtacctcaatgcgaatgatgtattcaaaacaaattctctagccaagtaacttactatcatgatatgtgtgtgtgtgtgtatgtatatatata

SEQ ID NO: 53559 - DNA, 7960 bp, Oryza sativa
  unsure (1)..(7960): unsure at all n locations
aatattttaaaacagagggagtatatgcggcctgcgggacagcgggagttgaagcagcgcgcgcggacgtgaaggagagaggtcgatcatcaaaccgctccagcgggtcgtcgaagccgtactgcatggaaagcatcttcgtcgtgttcgccggcccccgccaccgtatagtggccgtcgtacgatgtggcctgggtgacatcgatcgaggacggacggcgatgatgacgtatgaggcgtgtcgatcggtcgcgtcgcgtcgcgccggcactggctgtgatgacgcgctcgactatcttaattttgatcgatgccgctagcccacagccattggctctacccaccagatgctagccttcatatatatatatatatgtatatatatatatatatatatatatacatgatatgtgtgtgtgtgtgtatgtatatattttcttataattgtgaaataaagcaggattaagaatttaagatctattctatttgtgcatattgattataagagaataattatcaacagttaatgataaccattagatgaaacatagctatatgatgcaaggagcagcacttgatggaatttactcaactagcaacgaaaaaataggaaataagttagagattgttattactcaaaaacgacagttaagttatttctatctctaaagcgccctttatgagatcaattttggatgctttgtaacttaagaagtacaaagcaccataaaagccctcattaaaaacatgtgtagcacatttatgtatttgctatcaaatccggtagtctatatacgaaacatttacaacgcggcatatattaggtttcatcaactaattaactacgacaaagttgtaatatccccatatccaacttacgaatcgttccctcctaattatggactacaaacaaagaaatcaccagcctttggataatacatagtaactgaactattgattgttcggtgaaaactttaagttgatttaattttgaagctgttaaccactacatattaagccgagctatttctaatctaacagtttcatattggcatggagtagcctatttgcctcttgcatatgtgttgttaccattctcatcccttgggagagatattgttcatccactttgaacactcaatcctgaatcctaaagtccaagaaatctacgagaaactaaagacaaacaagactagatattatccgtcagtcccatttgccatgcacttcactcttgaacattatgttcgcattctaagaataaagatgattcaagtaggtagcaactaggattgtgtttggcacaacattgtatgcatcaccaatatgaatacaacattgtaattgccaagaaccgaatatttttttatcaagcaacgccactggtttttttatattccatttttcctggcacaaccacatggggcccaacaatgtgcacacacactggtcaatgccatttgtatgatcaatatgtatttgtcagtggacgctagcaaaagctagtagttcttggtgcacacaaaatacaagtggaaactagaaaagaaaaactcgagtcccccttgacttggcttttaagaaagagggtgagggctcaaatgcaacacccatgataaaaggtatatagtttgaaaatatttgggatgaataatatctggttttgaatcttatagatgaatgttagatttccgtgatatgttaaggatgcaaaatggacttaatgcataaaagcacattaatttcctaacttaaaacaagtaaactaacaagaaattacaacacttatgtaacggaaataaccatcaatattgaggaaaacgtcatagatgggcgatttcctactagtgaattcacaattgatcctaatagttcattatatacacacacatatttaattagtatatgtattaatgatgattgggattaagaaacaaccctttaattagcacatattaattaatggtaacatatgtacgtaagagttcatagcagaatgaactgtcgttgtacatgccgtaattataatacaatatagctgataagcatattaattaaatctaattacaagtgataagggtctcaaaattaaactatatttgaaacatgtgttaccccgcaagcacctaatgtgagcataataattagttctcacctggagacatttgtctttatagtttccctctattgtgcatgaattagttaacttgactacatacgacgctaatttttttatattttagcccttttggaagcttcttttacaaatagaaatctggaaaaacttattctagctaggaatagatttttttctcaactctagggttattggcgctaaggctcaatatgatactccttgccggcaccccacccccccccccccttcttcccggtggtaggcaagtcgctgacgttgaaaggtcagcaccaacctctttagcactaaggacctattcggtgctctttggcactatggatctatttgtaagaaaaatatttatattttgacccttttcataaatttatgttaaaacataggccctcgatacaaggatcattggcgccgagggtccattccgagaataagtttgtccaaggatctatttgtaaaataaattttaaaaagaaccaaatgtaaaatctagacctacaacaaacaatagcgagcatatacttagcgcaacgtcatcaagaaaggcacttatgcaagaacagggataataccaaatgttgttaagtgtattctccatgttcttgagtaagtgtattctccctgtggttacttacagaagaatgagatcgacctaagtaacttttagttctagattattatgagtcaacttctgatggtatgtctctgatggtatgtcatatttattgggcctgttcggctgcactcatttagccgtggtgcagccagcctaaacagtgttttgtgtcatcagctgcgacaatgacgtcgcaacacagtggcttcaccttgcagccgaacaggcccattgaatatgacttgtgcatgactaggttgctagaggccaggatctaccaccatgtcagttgatcaagatgtttttgttggacctatagtatagaactagtgtgttgtgtatggaatatgaccaaccattactagtatatgttgtgtatggcatactagcagggacatactagagaagtctcaaataaaactagaattgaaatagagaacaaagatacaacactgatgtttctactttggtgcacagccgaaagaagaaaatctcatttaatgaacagaaaatgttttttcgcttcctcattgagccacgtatacttatatagcttgagacattgaatttggtcaggatggttggattgatggagattaggggaagagtcagaaaacttccatgggaaggatcaatgagtgacatggtggttataaatatcctagtcgtcggtagtaactttgggtagggaaaggaacaaacaatgcaatcaaaataaaagtttctaaatgacagtaaaaggagcaactataataactcaaaatgcataatcgtattctttgatcacctaaagctcttaaatatctttcacatactgtgataacatcttagttcccaacattatcatagctcttgttggtcgtttagtacaaaataccatgcaaacctcactcttttgaaaaacataaattatactcactccagattagaaataattatcgttttagacaaggacatggtctctaaaaaataattttaaccactattttctattacaatatatatagaaatatcaacaaatgtattattttattgaagagctcttaaagattaatccatacatatggtctctatgtttctaaggtaaatattttagaagttatatatagttcaagttttaaaattttgacatcagtattgtcctaaatgacaattatttttaacctgaagcctgaaggaataccaattatagctgtcattatacccaactaaattttaacatatataattattataaattacactttgcacataaatatgcaagtcatagccttgcaattgcatgacttaattggctagttataggtgattgccaaacaattgaatagtgctgctattatggggtagaaggctatggaatggacaaggccattcttgccatgattttttccattctttttcctttcacttatctttacagcttcattctgttggcagagagtgtttctcaactaaatttcagctcaaagaatatggaaaggaaataaaagaatgaacaaaaaatatatcccaataaatgcttgcagcgtgctaaattttccaggttttgcaaaagtgtctcaatcttgctaggttccattcgttgaggtccttaaatttccctatgcatgctcaatagagtaattatttagtcaattgaaatgttggagaaccaaagaggatttaagtgtcgattaattaagaaaaatgggacagcacatctggagttgaaagctagcagggtgggtgcatgagagcttccccagaaaactattctaccacagctctctatttagtcacttaagcgataatattaaatccagttggagtgtatgaaactaaagtataagtcatttacgttagtaacatgaacaagaaaaatactatggtttagattgatgtagtgacacaaacaatatggggaagattttactcgagatgatacacttatatgggttttcttgcttacccttaccatgacctttttttatcacatcttatcttgacgatgggaactatatggtatgcatttttcatattccaattttaattacattgagtttatatttggatacataacaatagataagtatctcaatatgtgcatagttactagtggtctcaatagtacataaactcatttgtttagttttattgcattgaatgccacctaattaataccctccaaacatataaaaatctagagatgtttgcatcaatgtaaatccatgcttctagttatatcttttccacaacaccatattatacccatcatttaagaaaaatatgtcaaacaatcacaccttatccaataagaaaaatttacctcttgcatatgttttgttcccattctcattcctccggcgaaatattttttttgagggaataatgttcatctacttcaaacactcaatcctgaatcctaagctccaacaaatctgctcgaccaaagacaaacaagactagatattgtctagcaaatcttccatgcacttctcttttgaacattatatacatttggcaatagtgtggttgactgtttgcataatattttttactcccccgagtcaaaaaaaacaatattttgcactccctccattccacattaaaaaatgttttggcggtttggcctctccatccctcgtctagattcactaacatccatatgaatttagacacatatatgatatcatgtattaatctattcatactcaaacatcttataatgtgaaacaaaaggaagtactcaacaacagttgccaagaaccgaacaagtttactcaacaagccattaacgtatgcatactccccttctctcatgttggcatggatgccagggctcactcactttgcgagggtgctatccacattgttgatagcggattaatcacaccaattgtaccatgcataagcacctactgtgcccccaccccagcatgatgtgcacgttcccgatcttccgagaagttctgataaacaacgatttgggcggagtcgcgacacaaatcgatccggcttcttgaacgcgcacgctcttgagctccgcaatcacagcaccacgtctcctctggttatcacctgtgtcgaaacgcggatgacctcgccgagaaggctaatccctgtttgccaatcgaagaacactaacaagaacgagatagaatacaaccaaaattgcatatgaatgattaagctcacaagttggggtcttacaaaccgatctagcggcgaaactgttctcgacagaataatctaagcaaaacccaaaccctaaagatgacggcgactactgatatatagagtttagggtcgtgcaaccaacccttgacgcaaccctaataggttccaacacgatacacggcccaaaggcccaaatacgatgacacagcgccggaacagattatggacgtcaacttgttcggtcgattcccattgactcggaaagaatttggacgtgggaccaaaaccaatggaaatcttcttagctttccatccatataaagaacaccccaatacaagcacgtatgcgacctgggcgcccgttttagtgcagactagtcctggactccgagttgcactcgaggtcgacttggtttaggcctccaccttgacttggacgtattcgatgatattccatgactctaagtccttctccaagtgtctccttgtcccctccattgttcctaatcacaatataataattaggtagcaatctattctcaaattcatacaaagaagaacataggaacgagctcacctctgaattcaattgtcgcgcgcgagctcgtgttatcggtccttgaatgaccgttggaggattgttgtgtgtatccgaaggagtgatgtccgcaacacagcatacacgtgcactccggtcactcatttgtatgatcactatgtacggtgaaattattattgcaggtctgacccaagcaggctaggaaaaatcattctcggtgcacacaaaaatccaagtggaaactataaaaaaaacttgatcccccttgacttagctttaaataaggggccaccaaaaccttgcgctcgaatgtgggcacaaatgcaaaacccgcaataaaaagtaaatgctacgaaaagtttagggacgaataatacctggttttatctccaagaaagtcattttattgcaaaagaggagtaagacaaggggaccctttatctcctcttccttttgttttgggagaagacttgttgcaatttcattaacaaggccaatcagaacaaccttatatccatgcctatcctaacactagagaatgaattcccaattgtacagtacgctaatgacacactgcttttcctgacagcatcttcaaaggaactcttttgtctaaaggctattctaaatacttcttcctcttcaacaggtttaaaaataaattttagtaagtcttgtatgattcctctgaatgtgcagccagacaaagttgagcatttatccaagatgtttggctgtttggtaggagacctacctttcacttattggggctgccaatgggtataagtagacctaaggtaattgatttcagccctcttgtggatagaattgaaacaagattgcctgctacttcttccctactctcttatggtgacagattgactatggttaattcagtgctttcttctttgccgatattttacacgtgcactctttccttgccaaaatctgtcatcctttctattaatagagcaaggaggcattgtttatggagaggttcagacataaattccagtaggaaatccttgatcctttgggatagagtttgccaacccaagtctaaagggggtttaggagtaattgatcttagacttcaaaacaatgccttgctaatgaaaaatcttcataaattttataataggcatcttgttccttgggttaaattgacatggtcctcttattatagtgataaagtcccacatgctttatctctaaaaggttctttttggtggaaagatgctctacagtttgttgatatctttagaggtcttttaaagtgcacaattggtgatggcagaacctgtttgttttggtctgatctatggaatgataagattaggcaaaggagttatcctagagctttctcttttgcaaggaaccaaaaagactcgagaaaatcccttgtatacccctgaattttaannnnnnnnnnnnnnnnnnnnnnnnnnnnnnnnnnnnnnnnnnnnnnnnnnnnnnn

SEQ ID NO: 53560 - DNA, 2051 bp, Oryza sativa
gagcattcctacaacaataggatccccaatgctcacaataatttttttatgaatgctcccgataaaaaaatccattatcctattaaaatttcaaatagaaattttaatttattacatttgtttttattttcaaaatttagtctcattagtttcataaaatgcacatattgtgcactcaaacaaaaatttcaatttttttcaagcttatattcaaacctaaagcatcaagggcaaaaaagacatttgcaatcaaacgtaatagtgaaatgaatgaaaatgtagcggtaggggcataaaagggatcaagttgaaatttcaggggtatataagggatcgggtaaatttcaggggcatgaaagggatagagtgagttttcagggggtacatagggaatttactcaaaagactcagttcatctgacttccttaatggacttgtcttagacttttaccctccctttgtctaaacaggcttttcaagagtatctttcaatgctttctacagataccttagatcagctgtcggatgaatttgataaatggtcttatgtttggggtaatgataagtattcatcccagaaagtttgtgctacaaatttcatgcatgtgcaggcacctgcctacttaaagtggagctggaagagtaactatactatgaaagtttaggtttttggttggctttttatgattgataggttaaacacttgggatatgcttgacaaaaagttttgtgcccttgttggaagtaatttaaattgtgtgttatgttcatctggagaaagggaaaccccttatcatcttttttcaagtgctctttcagtacagagtgttgggtgcagtttggtattgtatgggatctctctttgtcctttaaaaatatgttgaaccatgcaaatacatcttatcgatcttcacattttctggagaaggttttatatgcggcctagaacatttggaagcaacgaaatggatttatttgttataatgtttcgccctttgttccttcttggatgacattctttaggaacgatctatcccttctagtttttcgcttaaattagatgagagatcaactttactctcctggttgaaccagttgtaatctatttatttatttttaataaaactatataactgtgggggcttcccctacagtgctttccctcaaaaaaaataatacctggttttgaaatttatagatgaattttacattttattttgtgataggttaagaatgtaaattaaatggacttttcgctttcatgaaacacgtctaatctagctagcatcacgtctagtcacggaaatgggtcattttggatattagtatcgtgtattatattagtgttcgcctagaacatggtatagatggtctagaccacatctagacattagaccatgggttaccatctagttagggcctaaaccgtgaattagactgtttgatcgtctactcggtcaaagattggtctagaccgtctagaccaggcaattagacaacacaaagacgagtagatcataaaattgttgtttagaccatggtctaggaaataaaccaatgcgctatcacatgtcaggagataaaacctggtggcctgcccaaggaccatatagcaaagggttttgatcccaactaaaacacttctctactattcttagacacgtcattgccatgaagtcacgtcacctctcctcagttagttgccaacatggaccttgctcccacctttctctggctcatgacgatgccggttgcttcccttattagcgtcgctagttcttcgatattttatggaacatgttaagtctatctacataagtatcaaaaaaaatgctgattgtatatagtacattatatcatctagacttggattttcttgttccctttcttgttttctttgtgttcctcagttttaaggatttacagtctacgaactcatgtaaccttttagctgtgtatatccacatgtggatatagtggtcgaattttcatccattattaaaagaatatatagtctgcaattttcttgtccgtgtgaaattatagtattg

SEQ ID NO: 53561 - DNA, 1107 bp, Oryza sativa
  unsure (1)..(1107): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctgaaaaggggggaataatagcaaggctgagtacaaccaccgtactcagcaagccacaccaatgatgcaggcgtgcaaggggatacaaggatggcttgaggctatttgcataaaggcaattgtaaaacatttattgagcaaaacagtaaaatagttgattaattaaggtaatattaaatctccactgatcaacgctacaccacgttgaataggcccaaccaacccacctgaactacagtgcattgagtcgatttaataagtgtgtgactaatcacgatgaatctggtcgatcgcccataaccgcgggcatggctattcgaatagttttactctggccaggggatctgcacgacctgtacccaaaagacacaatccaccggcatgtcaccgcgcctgtccggacacgtcaccatgtcgagtgattgtgacaagacccttcatataaccctctctgaccaagccacaccacacctcaggtttcacccccactcctcaacaggccaccgggcagtcccctctcgtgcctaggcaaatcaaaaaggcgcatagactgtcgcagggcccatccgaactccatcacgctcacccttgcctggatgcgtcagagaggaaagctatacttcaagtcagacagttacccattcccgcttgtggtaagcgcggtaagtcttccagtgcatcctgtgaaccggtccttaactgccatgggtgggactagcaaaaccatgcacccacaacccaccattaagtcgcattttagttggataattatgaccaataaaacatggtcggatgtctcgagcacgcagctcgtcatgatactaaaagttctacaagatcagccagtcgtccatcccatgatgaggacaagcggccatatattcctgaa

SEQ ID NO: 53562 - DNA, 1714 bp, Oryza sativa
gacagctttggatgaaccttagcgactgcaaaagtgaacaaggagtatacagatggcaggatacttgcggaaaggacggaatgctgacaagtgcaattaaggtactcactagtttaggccgttgttatttatcactgattattaatcagctgtgactcaaaggattaactctttctttttcatcaaaaagactaattactcatattttggttgtactatattgcagacaagggttaaaatggagaaggcagcacggggagggaatatggcactgcgatataagaaaatggatggggattatgattcagctgaccgggaatgcttttcatgtttttatgatctccatttgtcagctgtcagctgccaatgctccccaaatcgttttgcttgcttaaaccatgcaaacattctatgttcatgtgaaatggacagaaaaaccgcgttgttgcggtataccatagaggagctccatactcctgttgcagctttaaaagggtgatccaactgcggtctacccagtggggacagaaatgatttaggtttaagtctgcccatctggttctactccagtaacaaaaagatggacttgggtgaaaaaccccggaattttccggaattcaagccacccaacgtccatcaatgggtgcagcttaggaaagtcaagaatcaatatcactatgacacccgcaaagccaggcaggataccagcaagagaagggaatccagattgcttcagaaaaacatgataagaacaagatggttgtcaatcttgagtctccagcaacagctagtaatccaagcaggtcaaagtctgactgcagtggctcactgtccttgaatcattcatctgagttaccatcttcaagaattcaaacaggaaattctacgctagcttccattaccacagagaaactgtttggtgttgacattaaatccaatttagcacagtcttctgatggccaagttagtcaattggccaagccttcctcgagccaaactgatgaagtctctaagccagcaatagctaagtatacggttgagctgctagacagtggaacaatgatgattggtaaaaagtggtgcaatcagcaagctatattccccaaaggtatatacactgaacaatgcaatgattatttttgtcttctggtaatatgtacatcctccagaaatatcactaatagaaattcatctatgcaggatttaagagtcgagttacatttcatagtgtactagatccaacaaggacatgctgctacatctccgaagttcttgatgctgggcttcttggaccattgtttagggtacgcttttattataaacgcttcttgtttttctaaatttcaggatttgtctgctttccttcattgtgctcacataagctactgaattaataacaggtgactgtcgaaggtcttccagaagtttcgtttactcacacatcaccaatgcaatgttgggacagtgtaagagacagagtaaatgaagaaatagcaaaacaaataagttttggaaaatctggccttcctgattttctatcctgcaattctttgaatggacttgaaatgtttgggttcttatcctcccctataattaaggtagatttttacgatatccacagtctttatttttgtgaaccctggtcacttcaagtaactagttgaatattacacaaaaattctttgttgttcaacaggaaatcgaggctctagat

SEQ ID NO: 53563 - DNA, 2168 bp, Oryza sativa
  unsure (1)..(2168): unsure at all n locations
nnnnnnnnnnnnnnnnnnnnnnnnnnnnnnnnnnnnnnnnnnnnnnnnnnnnnnnnntgtctttcttttatccaatatatatactcttgtaagccgtacgggaaggggtgacattcccattgttattctcctacgtttgtaataaactcctctatagtgattatagtgattattgccggtcggcgcccatggttttttcccgcaagggttttccacgtaaaatttgtgtctccgttgtgcatctattttcataacatagttattatagaggagctacgtcctcctgtaggttaatctgcaggcttgactaacctacaaagatcacaacataacacatgtggattttcacccccttcggtcagagtacacaatcatgttctttgacctagaggaagacatagttgcttcatatagggaaaaaaaactgcaaaactatggtacgattgaagatgatcgatagggaaattatcttctcgttgagcatcccctttgtcgctaaacttaaatagaaaaattgggccggtgcatgggtcaggttcactaacctagttgtcttaggacttaggagtgcatccccagggggtgtgctgggtatgcaccggcatacccagaaattctgaaaaaagtttaacatgtagtttgcaaaaacttatctaaatgatggataagtgcttacatcaaagctcgagaggcctaggtggctagcaaggccccagcaaacagcaagtcaccacccagctcgtgtgcgtgtgcgtcgatacagtattacttgcctccttctcactggtggagaaaccatctttgatcggtccgctagatttcacaatagtctcggttgtattaaaaatcgggactaaaaatatctttagtcccggtttgaaagctcagaggaattttttgatcttcttttttttttgagaatctatgattcagatctgagacgatttgtgtgtgatgtgaatatgtgatgtatttgatttgtgtatgatgtgaatatgtgatgtatttgtgatgaattttgtagaagttatgatgtaatttttttaagattttgtgatgtatttagagatattgatttgagaatttggagactattctgggacgattgatttgggattttgggatgagatagagtgaatcaatatattaaaaacaatgaagaaaagaatataataaagtagcaatcggagctagcttctttagtcccagttggtactctatcttgattaaaaatgggtttttactcccggtttttttatccgggactaaagataatgatctttagtcccgtattcgtagttccggtttttcaactgggactaagggggttacgaaccgggagtaaaaactccttatccaccagtgtcttttcatgttggccgtgcggcgtgggcaaagcagcaagtgcgacggcggccggcaagtctgtcattgcccactagcccagagaagctgagcccctgcagcctgcctgcccctagccagaacggaggcatgccggccattgagtcattggcagcagcaacgaccagccaggactagcaacgagagattttggagtttgctaaaagactagttttcacctctttacaattctacttccttcaaatatgcgatctcttttctctgaatgatattaaattgaatcaatcaactattagtattaggatgaacatggatcttatttttgtctttaacatgcatggcaccaaaaaataaaataaaataaaataaaaatgcatggcaccaaacaattatgggattcacattctgtatggtgctagatacgtttcagaagccagagatgctctcggaataattgtatcacttgataaaatttactgagattaataaagcttccattatcttaaaaaagaagatacattccagaacaaaactggttttagaaaaataaaaaggaacattatcaaacaagagtactaaagggagtagaaattagtcgtaattggtgttgttttgtactccatttatagataaaaacatcatatatccctacatgaagaatttagttttcctctttagatttgcatgggcacaaccagggtaaaaaccataggtacaccattgggtatggtgttcgattgtgaagtcagcaagtatgtagtcttatcgaggagatcatcgatgtcattatgttatattaacag

SEQ ID NO: 53564 - DNA, 1445 bp, Oryza sativa
ttggctatacttattaaactcgacgttctgattctggctcgatgttcccgttttgagatggtcacgccgccacttctctaggggtcgcgccgcatcgacagttgaacgggcccacaaaccgcctggggtgctgctggcatcggctgcgggccggcgacaggaaagcttcaacgctcttggagcacgcgtgcagcgagtgacaatttagtcgccggctcgccatctctctcctcgcctctatgctccagtctagctttcgaacctacgtgtcttaccttgttgctagctaatccctctctatcgtactcgctctaatagtgcttcaagttgtcaatcatgaagcacatattatcacaccatctataatgaacacattggtcatgattttctatattaaaagtaacgcaagtcctggcaatcacaataacaatcacaataagtaaaagttttactttcttcgtcccaaaataactttatttttaatcttagatatacaaaacgaggtaacaaaagaatcacatataccgaaaagtagtattagtgaatggataattgaggttggtaaggggtattgatagaacaaagctcaacgatttacatatcgaagataagaaagatataaatttttagaacagacaggtaccgttatagggtcatgttactttggagaagcgctgtaaaacccgcgagtcaaatcggacgttatcgacaagcattaaggtactacagtaaactcagtaaacggcagcatatcataaacaggtgtggactgggcggcacaatcgtaaaggagtttgttattgatttgataatcacaattgaacattaatgtcattttaaactatatcgttgtattgtttggtattgataaatatatgactttggtattgataaatatatgataatatttagtttgttactaaattgatcatgcctagagaatatggcaaatattaagtctatcctaccaaaatttgacaatgctaccaatttgccagaagtttggtaattccttcttgtgctggtgcagttgccaactccttttttttcttttttgagaaccatgcagttgccaactcgaatctacagggcataagaatatgtatgtatgagcaacgaaagcatcatctatttggaagtgaaattcccagaactcaaaaactccgccgcccaaaactccacaaataggaagcaaaggtgcccatctaacaaaaagatacaccccagatcctacaatcttgtggaacaaatttcaaactcgtcgcgaaacgttccttaaaatttcggacctaactactctcctgctcattggctgtctgtaaaatcagcatcgatgacatcaccttcctcgcctcctggcttctcggatgggccagcagagccagcggcagcatcagctcctggggtaggtcctgctcctggggcaccctgctggctgtagaggg

SEQ ID NO: 53565 - DNA, 797 bp, Oryza sativa
ggccaattcgagctctgtaccctggaaaacattcctcctttttttcttcctaaaaaatatcacagaaaagtttttgttcttcctttttgtgccactaatttcagaggtgtatccattggtgggaactctgctatttatattgaattggtgactgataagttctttgaataaaaacatataatgtatcttctgcatttgctcaagatactgggtgtgattacttatgttcaaccttgttatatagcattcaccttagtcattggtataccatatatctattcatgtcctactattatagttattaacctgtcaatcactaattgcagtgatgatatttctcttattaggcagttgttgtaagtattgaccctcgaagagtatatgtcaagaatccggaagaggtgcaattcaaaactgtaaaggtgtccaattaaggtgcaattcaaccactcatactgaatctccatttgcatttcaagcattaagatctcatgtacttttttcaggtccattaggagaagaatatgcatggtaccagtgcacagtaagcaatttgtttccatttactgataattttgcgttactctcttatccatgcacataaggggtatttttgtatattcatatgaaaagtttttcccagtacgcaggaatattattacccaaaacgcccataccaaatttcagactgattaaaacatgtgctttctttagatatttggtgtactaccttttaggcaacattaaatgactttatgctggcataatctactgttgcatgcttgcctttaataaga

SEQ ID NO: 53566 - DNA, 1177 bp, Oryza sativa
tctgttgtaggcattttttattgacatacataccaagtgaagtatttgtcaaaaaactaaaaataaaaacattttttcttgctgttatggacaattattttttcagttatttaattacattcagttgtagttctgacagttgtaatgaattttcaaaggctaatgctggtctaaacaactttttgctcagtgctatgaggactctgtatgttcaaatactacgatcttatggcaatagtagcaattttccaaatacgttgtgataatttgtgacaggagaatgattaggttcctcagaaaaggggcatttccagactgaaggaattattatagtaacattatgccgttatggtcacattgtgttgtgttgataagatcaaatctgttctattgaactttgtttatccattcatccttctgggtgtacttcattttggttcgtctgtcaaatgttaattaaattaacacttttcatctcttaaatgagaattcagctcctaactatattttgggtgatgatttcagttcttgaagttggtgatggtgtttttgaggtgctgtctacatctggtgacactcaccttggtggtgatgactttgacaaggttagttttgctttccgagatttcaaggaacagtctttttcaatatataaaattaagtttttagtagtattaatgtgttgatatggactcaagttttgaactatacatatcggaaccgttaagaattgatttagggactcaattagtttcgtagtgaagtatattccatccaaatctttgattatttatgagcctttaattctgggtgattaggggatgataagttggcagtaaattcagtactacatatatatgccctatggtttttcttgaagttcttaatctctagtcaaactggggacagtgaataaataataaatttctctatggtggaaattttggatgcctgaattatttgaatcttcattaaacatgttcgatatgatgaaacaaatggatggaccgactcagtaatcgtaatattataattcatcatttggtaatcatatcttttgcttaatttgaagggtcttacgtcatgtatatttgttataattttcagaagctgctagatcttttagcatcatttcttactgttctacaagatgtatatgctcacaaatcattgtcat

SEQ ID NO: 53567 - DNA, 2722 bp, Oryza sativa
ttaaaattgatatgcgattcggatgccgcaacagattggcatcttcccctaggtaactctgggttctgttgttcctgatttgagattaaaggaataatttcccccaacctatcatgtcgatctgtaaattggtgatgcaaatttgtgtgtgatttcagtggctgtaactaattcgatgttcttggcctattgggggaatttgggatttggcccggcgaaaaaacttggatttgcccttgtgctagtagattgacaaatccatgaattgattatatgatataaatatatgccaatctatgagaaaattctactaaatcaaatcaactttcctcaagtaatgatgttggaactaaagtccattgatcgaccaatcatgaactcaagcatatacatgcggatatgtaaacaaattttgatgaatggtatcgtgcaatattatttattttccattggtaaatgttaaattgttaacttgtaatagaaatttctctgtcctataagaacatccaatctgtggcactttcctgatgaatgaaatattcaaggtacaagctaattttgtaagactactccttttcaggatctctgcccatcaggagcttgcggggacaatgttgctggagctacaactgtaattccttgaaaagttttgattttattagctgaatgttgtcatttctattcctctacagctttattattattggctaattaatttttcatgctattttatcttacttttatgaacagacaaatggaaagtggcatccacatgaatcgtacagacctgaaattgatgatgcccctgttttcactccaacggaagaggtttgtgtacattggggatcctacataactattccatgagatatgctgatagcatagtaatagttagctaatcgttctttcccttcaggagtttaaagatccaattagatatattacgagcattcgtccccaagcagaaaagtatggaatttgtcgtattgttccaccatcttcttggcgaccgccttgttctctgaaggagaagaacttctgggaatgtacagagttcaatacccgtgttcaacaagttgacaagcttcaaaaccgggaacccacaaagaaaaaatcacaacctcgagttcagaagaagaggaagaggagaaagagactgagatttgggatgactcacaggcgtcctagtgcaaatacatcagaagactgcgcagatgcagacgagaagtttggctttcaatctggctcagatttcacactagatgagtttcagaaatatgcagatgagtttaagcagcagtattttggaataaagggaagtgacgaaatccctctttctgaaattaaaaagaagaaaaaaaatggcacccatcgtcgatgaaatagagggagaatattggccgataagtgtatgccccactgacgaagttgaggtatttagttgctatctgtgcatcatcttcctatttaactattaatacatactgataagcatcggactctctttgactaggtggattatggtgctgatttggacacttcaatgttcagtagtggattctctaaattatcttcagattcaaatagacgagatccatatggtttatcttgttggaatttgaacaatcttccacgtattcctgggtctgtactgtcatttgaaactgaggatatatctggcgtcgtagtcccttggctttatgtagggatgtgcttctcatcattctgttgggtaagcttttattttctcattgacccatttttacaatgttatcattctgttggtaatagtataatagccgtttgcctaggtaaaagtaatctaattaacttccttgcttgttgaagaatgaacatattattgctctatgggattggaaaatgctactagcctagtgatattctaacctggcagtgctattcaatcttcttagtggattaacataagatgaatgtttacatagtaggaaaatatgtgatttttaattgattatgataattattcttggctgatatctctctcttgaactttgtagcacgtggaagatcatttcctttattctatgaattacatgcattttggtgaaccaaaagtatggtatggtgttcctggtgctgatgcagtgaagctggaagaagctatgagaaagaacttaccaagattgtttgaagaacagcctgatctcctacatgagctggtaaccatttgaaattgcatgtttgttatgtaatagaattgaccctgtgattctaacaacatgaattcactgattgcaaaataaactttttggatatattgcgaactggaaacaacttagcatccatgtactgaaattcaaaggaaaacattattttctgttccattttagtactctatttattatcattgcctagtgcctactaccagtcacaaattcttgctgacactacacagtggttcatctgagaataattatcttcctgtattgtacaaataaatatgctgcatcttcattcattttcatcctaaattttcatggtgcaggttacgcaattatctccttctgttcttaaatcagaaggagttcctgtttatcgtgttgttcagaatccaggcgagtttgttctaacgctaccgcgagcttaccattctgggttcaactgtgggttcaactgtgcggaggcagtaaatgtcgcacctgtggattggctgcctcacggacaatgtgctgttgagctctac

SEQ ID NO: 53568 - DNA, 2935 bp, Oryza sativa
ctgaagaaggctagctaagctcccagaagaaccagagctaatgacgatgaaaagaagtattcagtagcagtctagtggatcagatagcagtggtatcatctggagtggcaattgccactctccaggatgagatgaacaataatgtagatacatagtgccatgaatagatcagaaatttcagataactcatcctagacagcttccctagggaaccattagaattgaaatagagccaccattggtttgcattcttctagaattgcatttcttgatattcatttcagcttgatcccaattcatttctaacttgatggcaacaagttattgtattctctaattgtttctggattagccagtttattgtgaccaatgtaacaagttgatgtttcctgtcgacataaagcttacatgtacaaaccttggcagctaccaattggaaatgaaaggaagaaaatgttttcggacttatggctatttcttctacttcaatttaaatgaattgtcttttcttaccatataaatgcgatgaatctgtcctcattcagggctaatgttgcaaggggttactttaattgattgttttgtccttaatagtgatgccaattaaatcatactcccaccgatttttaaatatgcgctgtttttggcttttagatataacacttaactaatttttatctaaaagtatttctcatggtgaatatcacataacataaatctcactatgtttaactatatctaaataagtgaaaggtgaaaccctgcatgcaaaactacagtgccacatcattaagtgattataaagcattcgattttcaattcagacattacaggccgttggatcctttaattggcaaaaatatcttcccagtccttttagaaatttattttacaaagagttcctcaaataatagtgttattcttcgccgcctgaacgacacctccccttctctcagacgcctcagtttcctcctccgcaccccatgcagtgacgcaactgtggggctatccttcctgcacctacgcagcatccgctccaccatggtccatgggcattcccaacctcctaggtttagacattgcctatagcagaatgcatatgtgctgttcaatagtccattgaaatatatgattcagccaataactaattaggaaagcaattttgtcctcaaagcatcatttgaatgaatgcagatgtgtagataaatttattcaggcacctcttgcggcaacctgataactcagttatcagtaacaatacccttcattattgcactccacataattggctttcagttgctcaccttgcttatgttggccatttaccttcattaggtttcaattaatgttatattgcgttcatatctggaaataaagaaaacaatataatgagaaagtaatcttagggcatgttcaaagctagagcccagtgcaggctctctacactccatgtcagcgaaaaaactcctatatacaaaggatggtctctttagctgactctccattaatacaggctaataaatggctaataaattcatcatgtatactagatcaaatgtaaattttagccttccataaattgtgcaaacaacaagctattatttaagcaaacagtaagctatcatataaaaaaagacaatgagcataccagcacacacatactattattttaagcaaacagtaagctaaattacattatttcgttatatagagtagttctacttttttccaagcgctgccatatatgtgcaactaaatctttcttgagttgcatatgagttggacgatcacgaatagatgaattccttcgtagtactgcagcaaagcatgggttggggttggaggagttgctcacttccggtggcagaacgattgatgctcctgggttctcattcaaatccaaaggaatttcagtcatttccttttcatcttcaactatcatattgtgaagaataatacaagcttacattatgttgatagcatcacccctctgtcacatccgggctggacgacatacgatgttaaagtgagactgcaacacaccaaaggctcgctcaacatccttcctctcttcctcttgacgggctgcatataatatatcttcatctgtctgagaaagttgtattgtcttcacgaatgttttccactcaggataaattccatcagcaaggtagtaccccgtgttatattggttcccatttacagtaaactgcacacgaggagcttcccctatcaatgcatcaatgaacaacggtgacttgtttaacacattgatgtcgttattggatcctgtagtaccaaaaaaaagcatgctatatgcgaaggtctttcgatgctaccgcttagaggatcatggtaggaactcccttgtcaccacgagtaaattggccgcgccgagagaccgggcaattttttcatgcccaatgcatgcagtctatacttcctaacatgccaggaaaaccacgcgacttagcaacctgtagccaatctttcaacctcatcattccttggagctcgtaagtactcttcactaaatatttcaatgactcctttagcaaatttgcccaaacactccaaagctatactaggaccaatctttaatacctcgtcaagttggtccaccggagttccatatgctagcatatgaatggcggctgtacacttctgaagtggtgaatgtcctgctctaccagtggcatccactctattagtaaaataaggagaccattcactaagggcctcctcatccgaaacctcctatggaacatctcatcggtgtagataggggactcggagaagtagttggccacaagatcctcattgccatcttcttggtttcttggtatatacgggtcttgtaccactttgacgttgacaatgagatggctcagctgttatcttgaccttcattcctgaaataatctgctcactatat

SEQ ID NO: 53569 - DNA, 2113 bp, Oryza sativa
cctgagccaaggttgacaagttgtggatccttgcactccctccattcctctggcaggttgagttccttccaagggcccactagctgtggctgggagtccatggcagagaggtcagccgcagccaagcgccgggcctcagcagagaggccaaaccagaggttgaactcaggcacataatcaatcctgccatggaatggcagtgtccactttgccaacttggctccatgagtggcttgctgtctccaggcagtaggtgccgatgccattgacagataagcaaatgtgtgagccaccgccaagcacagcgtaggagctgatctctgggtctgggctgctgcagcagctgtgacagtgcttgggttcacagacaaaaggcggaggtggaagttaatggcagtgccaggcctttctgtaggaagataatgtagacttgcggtatacgaaggcctcaaactgatcgctgttgaagcccaactccggtttgggaatcctctccatgacaaagaggctgctgccatagccatcatgggaacgaactacgaagacagacaagggcatcgacttgggcttgtgaagactgggcatggttcctacctcgcacgtatctgcgttgacgaggaatgcgcggccagactgatccgtgcaaatcacctcgcggctagcaagcgggaaacagtccatcttcgattggttgttgacgttgagagctgaagctcggaagttgatgctggagaagggaagccccatactatccatcatcgtgccagctgcctgtttaaacttttgccagaattcgccaaccttctgtgtcggtggaggtgttgccggatagaataactgctggtgcatcatgtcgaagtaccatagcgatttgacatcagggttgcggttgcccacgatcagattaagaaaccgccgcgagaaatcaatcgtatcccttaaccagtggcttaacctgattcgtatccctcaccacgatactgcatatcttgacccccccctcatttattaaaaccggtgcaatatgactccctcagcggttttggagggtggcttcgctgacatgtcatctacgcggcggtgttgacctagtctttatgccacacggtattgacgtgacgtttatatgacattagaattaaaaaaaatatgtgagactcatttgtcatttacaaaaaatgatttgtgggacccacatgtcatgatctctctttttccctctcacccctttctcttcacatgagcactgctctaaggcatgttatttatcttctctaccgaatgtcaaactacacatgcaatgcatgattatttcagctctctttgttggggggaaatagcaccaaaagtccaaaacagagatcaaatatggggaggcgaaatatcccgcaaaaaattgaccacgagacaagactaatttacctctagaacgcacgaaattgggggagaaaaactggaaacaaccgaacacgcacagcacaaaacaaccagacgctgctcgcaacaagacccaaaaaaaatgtggaaacacataggcgaatccatctacttcaccgcaaatcagcatcaaattacaaggggaatagtaaccaatcgaaaggcaaggcagaatgagcactcgcacgcgcgaacacacacatgcacacgaggacgagccaagcaatgcagtgcggcatacgagacagggggaggagaggatgaagagtgaggatgaattctaatctctcgggtggatgcccacccgtttcttgcatgtcaattaaataattatgaaaaaatttcaaaaaaattacaagatagattaatatgtaatatatcacttcacaaacatgcaagttcaaattcaaattttacaagttgtaacgaaaataacaaattaaacttttagtatacgtatatttacagtcaaatttgttatttttgttacaacttgtagaagttaaatttgaacttgcatgtttgtgaagtaatatattcatattatcctatcatgtcaattttttttaaaactttccataaccatttagatgacatgcaagaaacaggtggacattcacccgaatgcttaaaacagtttcccgatgaagagttcctcggaagcttcattcgccac

SEQ ID NO: 53570 - DNA, 3497 bp, Oryza sativa
caatgatggcggcaaaggacatgaaaggcaattttatctcatcatccggtggaggagcgaaattgatttcgaaaatgtacaaaagggccaaaattttgcaaagtggcggtaagcacgcacttcatattagcattttagcaaaaacacgttttcggaatggcattagagtgaaaccgtgttttggaagtggctaaatgtccattttctcgggatggacaggtgcagcggcgcgcaggggtcgatgcatccagaagggagggctcgaggggcaccgtcggcgccagcggcactgccatcttctacctcctctcctcttctcctagtagttgtcggcgccgtctccatggggagcttgagctcaacgaaatccagaagaaagagagagggcaggagaagggacggagggagggctaggggcatcgtcgtcgctgccatcttcttcctcctcttctcctagtcgttgccgacatcgtctccctcatcggccaccgcttccctccttcacgagctgtgacgcaccagatccgacggccacaagcttcgacacgctagatccgggagtcttcagcttcgacggcaccggatccgcagccatgaactctgctggcggcggcaaacagcgggactcaaagggagagtggcgagcgtcatgtaggcgagcggcgacggcagttgcgagatggcgatgcatttctctcttccttttttttttcatttttttcttttctttttctatccggttgaccggataatcccgacgattaatttataatagtgtaatttaatgtttggcacaattttttgggacttcctagtttggcgaattttttcgtcattgaaatttgtgcatctccaagaagtcagtagcactgcatgtaatatgttgttatcctctccaatacgaagaaactatactcaatattccgaaaacttcatcttggacttagttaaaactcaatttaatacccatggaggtaaactcaccctccaatccagaatgtatttttgatccaaccaaccaaacatctttcgcatacagtatctttaatacaactaaccaaacaatatctaaccatatgcaggtttattcaatacaaacaaccaaacaatgcatatgtatatctttaaccaggccaatcttagtctggataaaggagatgaaccaggctagaagtatacgagcaaccaaacgcacctaaattggggagtgtttcctgcgccgctcatctccctctgaaagtctggatcaaactagctggctacccaaatagcctctcacgatcacaggctcacaacctcacagatatagtgacaaatcgcacgagctggagctatcatagattgaaggaaagtaaaaaaccaaggaaaaattaataaacagataagggaaagaaataaaaatactactccttccgtattaataaatagatggtgttattgatttttctttatctaacatttcatactcgtcttaggaaaaatataagtaatgattaaaatatctttaatgataataaattatatttatatgtttttcttaaaaaaaatatccaaacatcatatctaaaagtcaacaacgtcatatattaaaaaaactagtgaacgtgcacgtgcaaagcacattgatatatacaattgaagaaaaatgcattcattgctaatgtacatctacatatactcacaaattaaagctcataatcattgataaaaataaaagtattgtaaacattgtcttggtaattcattgaataaaactaatttgttattgtattatatagcgtaacagatgtttttcagtgagaatcttattttcattactttatgccttggactacatgcaatagataatgggtaagcctgtaagagttaaactattatgagaacaaacgacgatagataactcaagaaaaagtgagatagcagccatgtattatcaaaagctagtaaatgtacaaatgcagcttaaaatagatcagtgaatcagcaatggatgtttcccaattttcctctttcacggtctgctgagcattaaatagtttgatttggatatataaacatgtacatgagattttaatgagataattttccacacatttagcagggtaaactcaggccaaaataatgattgaaacaaaacttctctaaattattttctttgggcaaaaaacaaaattcggtttcaacatctcataaagctcacagaaaactgaactgcaaaatcagtactgcaaagtttaggcgcatatattgtgctgcatttgaagttactttattatgtatagatagacattattctttcatttgtaacaacatgattgggcatcattaaaatccccgtccaggaccggccggggtacacaaacgacaatgttgacattcagatccacgtcttacaaacatcataaaagtcttacataaatgcagcggaaaaacgaaagataacaggaactaagccttgacttgatctgcagcgggaacaccactccacagacatcctcgacggcacggacgaagcctactcctcggagaaaccaccatctgacacatacttgtactctggggttggggaaaatagagcaagactgagtactacccactgtactcagcaagtcataccggaataggggtatgatgcagggaattatcaaaggagagctagagtggttcatttgcataaagcgagcatttataaacagaagttgaaagaattaaacagttgtaataattaatcatattattcatccactgtccaacgctataccacgttgcgacaggcccaaccatccacctatagtatccaatttcattagactaaactagggtgagactaatcacggtgaatctggttgaccgcccataaccgcaggcacgactattcgaatagttttactctgatcagaggtgtacaactgtacccacaagacacagccccacgacacgtttccgtgcgccgacatgccaccacgacataccggaaagagaccgtaacaggacccttcgcataaccccctctaaccaagcacaccacacctcaggtttcactcccactcctcacaaggcagcgggcagtcccctctcgtgcctaggtgaatccggaagctgcataggccgtagcagggcccatccaaactccatcacgcccacccttgcctggatgcgtcggctaaagaaaagctacactacaagtccagccgttgcccacgctggcttgtggtaagtacgataagttcttccagggcatcccgcgaaccggtccttaactgccatgggtgcgaccaacaaaaccatgcacccacagcccaccatgtgatttattttaattaaccaacactgaagcggtgtcactaatccaacattaccattagaacctacagtctaaacattaataggatttttccccaatgtgtgctagttgaactaagcatggctaagcaattcctagtccaaagtctattcatgttataacgcaagctaacaaaggagcatggtatcaaaat

SEQ ID NO: 53571 - DNA, 1344 bp, Oryza sativa
agcacgagggagttcggcgagatggggaaaaagagagagggagtggcggtggagcttaaatagggtaggggaatcccggacatggccggtaggggcgggattccgccggccaacgcggggaggtggaggtggagagagaggtgggattcggaattcgaatcctggccatctcgggcgcgggcgcgagcgggagagagggggagtgggtgcgggaggcgcggcgcatgcgcgggcgtggccgacatgacccggaggaggcggggacgttggcacagcggcggtttcggcggtggtggcgacgtggggcgggcagccggaggaaggggacgaccccgacaggtggggcccacctgtcggcgtcccggggagagagggaggggcggcttgggccggcccacaaggaggagggcgcgcgcggcggcggggtggactgggccgacggcccaagaagaggaaaaggagggaaaagaaaaagaaaaggaggaaaagattttccctgggatttaaaattgcatgtgctcaattttaattggttaaaattatttcgagagctctgaaaattccactaaaaatcttgttagcgtatttcgacatgtagaactcaagaaaaattccacatgccaattccgattattatttgcattaatttattaaggttttctcttgatttgcaccggcattttcttaggatgatttataaattcaattttaggcttaggaggagaactttagggtgtgacattgatgctcataggatgctgaggtgactaccacacaagatgaagaccatgtgtgtagttgttcttgatcacttaaagtcgtggtacgtggactgctacgtcactggtcgaagaccagttgtagttgtaccttgtcacgcccaaaaatttagcccaaatttccagactattttgtgcattaaatctctgtccaagaatcacccagggtaaacaaaacgacaagtaatatacggtttcaaacgtaaataaagcgtaaaatacttacagaagaggcacttagtcctcacacccgaaacgaaagcagcagcagcggaaaaaggcaatcctagcagggcttcagctccactccacaggcaaaactcaactggggtctgagccttggtcctctaactccgtctttagctcagaagcactacacttctgaaaagggggaataatagcaaggctgagtacaaccaccgtactcagcaagccacaccaatgatgcaggcgtgcaaggggatacaaggatggcttgaggctatttgcataaaggcaattgtaaaacatttattgagcaaaacagtaaaatagttgattaattaaggtaatattaaatctccac

SEQ ID NO: 53572 - DNA, 2338 bp, Oryza sativa
atcgtatttgtttaatcccgtgggaagattataatagagagaacagtactaataatttatatattactgtacgaataatttataaccaaagtctaagcaggggttaatataattcatagggtacaataacactaagtagaagcattcatcctcttactcgtgattatctaagctaagtggaaagaatatagaaagatcctattcctatacttctaatttacatacatattatatatacatcctagttatagtattacttagctaataccctccatccgatgccctgctggtgcttcgagaagccacccctgattgtcgagttccttacgacaatccgtcatgactatacaaccgggactaaatacggtggagtaccctccccaggaaagtatcttaggactatatacattcgtggaggaatacccatactgagctgtcaccatcagcggcccacctcgcttccacagcatataaccccaaataatgatatctagtaatctaaacactacgcttaaattaccaaatactatctaatatcatcgtcatgacatagagttatcataaatacgattattatacccacaccattgcatctcccagataagctagcatcataataaatataactcgaacatatagtaaagttggtattcatatactcggaaagtaatacaataccaaagtagtataaagaagagtattctaaataaagtacaagtcataaaaaaaagaaaaaaggaaaagctactagagccatacacgaattcttccgaagactctgaggactgaagattttattctatttctattccattatactctagaaactatgctaaacttgagagatgaaatgaacttcttgcttgaggtgtgtcttgaaatggaggatgagagggctttatatagcttgagaatgacggttatgacggttggaaaggtcagtaataccctccaaccgccataggggagcaatcctgaccgcccatccaaaccctgcatcgaacggagccacggtgggttcggctgaacccaatgattcggccaaaccatgggctgggccggcctggtccaaattcggcaggtggcctcctctctcgatcccttctgcagacttatgaattttggcccaattggtcgtgttatttctgagttcttggcccattcgttgataagtctgattctcaacatcgtccgattgattgatcacctgttttgatatcgattctcctccattttatgtcattctctacaagaggttagtaatcctagtgctagtggaatatttattattctaacacaaatatgcattgcaagtataactagttctcctttattttggtagtattgatggtcgaaactgatcgctaacgaccgtcaacattggtcctttgatccagtggtgtgaattgtgggcttgtttgctcgtggtaattccgtgttgtcagcccatctatccacaagtctgattctcgacagcatccaattgattgatcatttattttgctgtcgattctcctccatttatatgtgcttctcctggatacatgttagtagcatagtatatagtggaaggagatattttatttggaaattatgcattgtaagcatagttagtctttatatattgggtaatattaacggtcgaaactggtcaataatgaccgtcaacaataacatcgaaaaaaacgtgtaattagctataggacaccacaaagacgtgaattggctctatgacactctaaaaaaacatatgcttgaggacactgaagacattattttattcttttcaaacaaaacagagaaagagacaaaaagaaaagaccatattgccctttggctctctcggcttggctttctcctggcgccgccgccttcctcgatggtgttgtcgatggccggcagctcggcacggcacattcagagccacggtaccagtgcgtgcaggggagacgcaccacgggtgtccgctaccgcgatttcctccgtgcacaccgtcccagccacgcccaccgtcgcgcacaccaccggtggctttgacaccacagcttacctcccgccgcacgaagggggagggtcctcgacggggaaggactgctcgttgcagctgccctgtgcccgccaggccggagcagctccctcgcagtcggtgtggcccgtaaattatccgcaagagttagtatagaacaagaatatggggaaaaaatctcaatgcatgatagtgtacaacataacattatctcaatgcgagggttcgcatcaattacacaaattttatttcaaaatttccaatcacaaatctgtacactttgaatttgcaatgtgctgaaattctaaacaa

SEQ ID NO: 53573 - DNA, 3506 bp, Oryza sativa
ggcgaattcgagctcggtacccctccgcaccacgagcttcgcctatgctcctccccatcgccggatccacctccacgcgccgtcgttgttaccactgcaggctcccttcacctgtgagaataccggagaggagagggagacggccgtgtatgggagaagaggagagggaggcgactgggagaggagagggatgcggtgggtggtgggttgtgggctgtgggggttttttaataacgcggttgatttttttttgcaagcgctgctctctatgagtatgtactttttgctgtcggaggtccttagtaaccgcccaagcgaaaatcacttaagaggtccgctttataaaaagtccccctatttttacaagcggtactcttaacccagccgccagcgaagatccattttcgctgacggtccttaacgcctcatccctcgttaaaatttcgctaacggtttccacttatggccgctagagaaaacaaaaagtcaacgccatgaaaaatcgattttgtagtagtgtatgcaaatttcatgtttggatccccgatttgtatccattcgtaggggacccaacctgagagcgagaatctcgtttaggcttgttttccccttaacgagaccaaatcaaaggggtatggtaggataacatgaaaaaaaacgtgcatagaagccactcctagacccatactcatctggccgaaccatagaaaaaagtgtgaaattatgttaaaagccatcaaataaaacgaactttcttgtctcatatgcattggttgagacgaaggacataacaaaagacgaaaaattcctttggcttgtactcatggtggtcaagcctaagaatatggcaagaagatgacttcctggttcgtactcattagccgaaccgaacaacatagcaaaagaatacatcaacgtgagcagaagaacgagaaccgagagattctttgactcgcacacaatgaacgagcctaataacgaaggaggagcatgattcccaccttaaacacctctgatcttccagcacagtggagcgaggaagcagaggctgacgagatggcataggagcaaagcggaacggcagcagtattgcctagcaacaagcagcgcttctgcaaagcctacgaacagcacctagcctctacgctaatctcccctggaacttcctttgccgctagggggttaaccagcttttcgtggtttagaacagagtcccgcgcgcatccgtgggcagatcgtgggaaatggactcaacagcatacacctttctttggcttacatgtgggtcccttcattttgactggatgaatgtggcaacgtgcgtgcaggtagtggggtgaacatgagcagaccggtcatgcccctggtcgttacatgctttcccatttattgttatcattctaatctttattactccagttagccttttaattgcctggttattgagtgagagagagcgcgtgtatcctctcactgacatctggccctctcttatttggcgcgtgcgtgtttatatatccgcatcattatagcggtctgcacgtgacatgcatttttatttcacgtcgcaaaaattaggagtataattttctcatttgttgtatgaacatatattttggttttctttttaatttattggatgaccgtagtctaaaactattttatatggtgcgtacacctttcctgaaaatatttaggacatgactattttgggtgagtgggaaaaatcctattccacggccatatgttttaggccaggtgtgtacttagcgaataatcgtagtctcaatatatttatacgatctcttttattatagcacgaatttcatatgtgcacacgaccagaaagctaagtatcagcgttcgtcggtccgatgaaaagcacgtaaaaaatatttgttcacgttttttaattttttgaacgtgtttccaagatgctaatttatttttatatggcacgcgcatacgcatttctatttgcgccggaaatcatttcactctgaccgagcggattttatttttatattgcggccatatatttttggtcgccattttattttatttattcatttgactgttttgactgtttattcctatttttgtttatttatttttttacattatgtttgagattatatattagtttataatttaatacatcttatttaagatacgagccaaaatcagtgtcaacaaatgcccccttgccaaaattttggttttgcatccggagctcgaaacataattttggattcgtagggacatgatgcatgtgaagtttatcctcacaactatcgatgtgcccgttgtttgaaagattgttgagaaaattaaggagcatctctccgattatttggccacgttccctatggctaggggcagtgaggcacttgttcgttgaactcatctactactccagtcttctccctctttctcctcttctgtgcaaggatttgaggagagacttcatcaatgacagcatcaaaggtaagaccttgatttgatcttgcatactgaactggcgatctttttttttgtttcctttttactattattgttggctttcattcctccattaattaattccatttgggtttcttccctatgcacacatgcccgaaacctaccaagtcttaatttcagcgggtgattggtgatttaggtgtggcaagaggaaggtacagagagattttcttcaccctctttcagtcattcattttttttacaggttgatagatacatataactttctttaaccacatttgtatagaatgagttgctcgtataatcggggttcccggaaattttgtgatatgttacgcagccaatccgggttgttaattagatttgcatgtcaaacttgtctaacaataccttttcttcctcattgtatatttaggctgcacctatatacatattccgatatatttttttcatttgtagatgacagatgctggctcttctcgagcaacacataacttgccgctttttagaatggcgcaacttcagccctatgaacctgaaacaagtgacttggggaaccctactattgtggataaagaattgatcggtggtgaattttcgcgtaacactcgtggcaggacttctggtcacgctttcaagggccgctgttttcaccctctcacccctttgccttgagatgataaggcttccaccttagggaataggatagtatctgagggattgggttgggaaaaccataaggtggaatttgttctagctccttcaggatatgcggaatggggtaaagcagtcctgcgtcatcattcccttcatttgcgtggtagcgaagagggggtagattacatttatgggtctatctattgctcccttggtttgtactgtacatcaccattcaccaagtatgctgagatctctgctggaaaaatgggatccacacaccaacagcttcctttttcctcatggcgagaggaccatcacattactcgatatatacaaactctcaggactgccccttgacggtg

SEQ ID NO: 53574 - DNA, 1577 bp, Oryza sativa
  unsure (1)..(1577): unsure at all n locations
tacttctttgaccatacatatataccaggattattcatgcgccattgctgggaatgaatatttgtagtaatgtcgttaagaaataccaactagcatttctagcgctgtttctagggaagattagtaaagagattactataagctaataatcttttatatataattacctctgcataaatcattgtccgttgcaggctaacctttgtgtcatgaaaacagggtatgaaaacaggatagtgcatgactggtaaacctgccagaaaacttcaacgaaaatccagaagctttcttccagagcgtcagaccgagtgtcgtccctccgcagaagaaactttcagctaagaaaccagtcatcccagcgtcaccatgtttcaggaatatggctgagaagacacttcgtgagttcgctgctccgtccgctgacaatgtgcccgtcgggccacaggttaacctcggagacactgacttcgatctcaagagcagcctgattactatggcgcatgcaagcctattttgtggcaggccaaatgaggacgcaagtgctcacttgcagcagttcctagagatctgcagcacctacaccatgaagggtgtcagcccggacaccattaggctgcgtctgttcactttctcactcctgggaaaagtgaagcagtggttttacacgaatcgggttgcagttaacacatgggacaagtgctccactgcgttcctctcaaaattcttcctgatgggcaagacaaatgccctccgcaggagaatatcaagcttccaggagttttacaacgtctgcaggaatatgtagctgcctgtcctcaccatgggatggacaactggctcattctacagagttttacaacggacttactgtttcgtcccggaatcacttggacgttactgctgggggtgccttcttatcaaagacggtcaaaggggccgttgatctcatcgagaagatagtgtcgaacatgagctgcagtgaagaacatctccagacccatcagcatggcatgcatactgtcaaggagacaaaaatgctggccgcaaagctggacctcctgatgaagaagctagatgatcaggagaagaacaacccgtaggccgctgtcaaggcactagactcgcacatcacttgtgaggtctgcaggaacactggacactcggggaacgactgccccgacattcgtgaagaagccatgttcatggggaacaatggctatcatcccaaagaagaccaggggtggaaccagccctgcccgttctaccaaggaggcaacaacaacaacaataacggtaacttcaacaaccagccctccttaaaggtctatgtgggctccaccagaagactcatcgaggtagataagtcaaagtgtcacgtcaacgaaaccactctccaaacacagttgagagagtcaagttacaccggttttaataatttgggtttcaaagatatccggtattatggttcaaacgacatcaattgaggattggagctatatttgagggacacgaattggactnnnnnnnnnnnnnnnnnnnnnnnnnnnnnnnnnnnnnnnnnnnnnnnnnnnnnnnnn

SEQ ID NO: 53575 - DNA, 15427 bp, Oryza sativa
agtaggccaggccgcgctaggagttctggcccaggcagaggagagagggtccagcgctagggttggcccccgctctcttcgccctttgcgccgcttctcctcttctcttctcttctcttctcttgggaacctccacttgtgctcgcctcctcgtcctcctcctcctcctccccctcccggtaaggcggacgaccgagctgaggctgagctagggctagggcacccacctcctccccttccggtatggcctctcccctctcctcatgatttcttttgcgagttcgtccctgcgatcgatttgttaggcgagcgctagggatgcgcagatctgttacctgggtgggttggatggatggatggaacctgtcgattcgattcttctgtttgtttgtttggaacgtgtagatctgcccccaaatgggtgctttggagaatcacgcggatctaccatccgccatgggatgggatgggatgggatgccattttgactagtttgtttgatgcctgtgaaccgcctagatctgcccgctctgtttggtttccttggtacttgttgttagaacaatggaacccctagtggatgagggacggactagtgctgtggatttgggcatatggtccagtacgtgaacacgcatcgtgtaccacatggatcatacccatttttttccctttttcttgtcacgtaccaagtaatctttttcgctagatagattaggcacggctgagatatcactacatcatcatgaaaaattgagatgatttattcctgtggctacttatgttcaatgtgccttacagttggcacctaacaattgagatgatttcgcatggtatgtgcttatttatcgacaatagtgcaatgctccatttatactaatctaaactttttgcgatgcaagtttcatcttgtttctttgatatcatgttttaggtcactggcgtatctggtacacttctttttgtatattttcttgtaaacacactgattagaatactgcaatttgtgagttatggcctagatgaggtgttagataaaagttttgcaccatatgtctttcactatcttcatcctacttttagcaaattagtttacatgatatcgatatgtcaggtatgtcactataggcacatcaatataggatgttgccgtcatggtttacgtgcatgcattaggtcttctgcaaatgcagtaacagcactatcctctaattaggttattgatataatggtcttgtgttaaccacatagatggataaattggcctagttgctattacgcggtcttccacggtttgcatataagaagggggctaggggttgtagctagacaatcaaatctatgctttgtctatgcaataacaaggttccctttttcgacctgtgtaacttgtttaggtagagcattgtggtgagatagcatacatacttctttcaaggagcaagtatgtagtaagttaaggtctgcagtaaggtcaatttaaacagtttttttcagagattgtaatgcatggcaccaaatgtatgcttatttcttttcatgagttaataaaaaaataccattcagttgttttaattttgacattgggggttgattttctgacatatactccctccgttccagaaaaaaccaacttctggggacaaatctagacaaatgcatgtccagatttatctccataagttgattctttttgggacggagggtgtaaatttgcggtgaatcctcctggttattactcaaattcactccacttggatggttagatactgtaaatgaaatatgcacagttgcttctactaattatgatgccataacctcttttattgtacatctcagttttcaatatttgatgcagtatcctggatggctgctggtcggggcattaaccagctcctacggagaacactccataatcagtcctcagtaagaattttaatgaactatttattttgtattacttctgtcaaaaaccgatcgcttaccaatctttttaatatttattttctgtctgatgcctgtatgaaatgttatggtataccaatcttgaattgattattgaaatggcatgtagaaaggtattaccggacatcactataacgtgaaatgtatcagatggggttttggaaagaaatcacagttcacattcttactagttactactgcacagtttttaggggtttctgtttggcaggattgatctttattctactttttacagttaaacctgcattatgcatacaatgcttatttttgctgttctggttgagtaattagaccatgatatcaactacttatcctaattttgacaaagtttataatctgacagtaaccatttgttcaccataagtttcagtacccatgatcatctcctttttagtgtggtgacctgcttttttttaaaacattataatcatgttttcagggctcatctctgctatcctcgttccggataaagcatgaagaatcctccgctggactgagagcattggctcttcttggagttggtgcttctggtcttttaagctttgctacaatagcttctgcagatgaagctgagcatggtttggcagcagctgaatatccctggccacatgctggcattcttagctcttatgaccatgcatcgtgagtcatcctttttcaacttccttacaaaatagagtttagctcattgcaatatttcagagtctttgcatacggtatttggttattattaattgatccatgctcttggttaccccaatccttcaaacctacttcaccaatttagtttcccagtaggatagcgaaaagaatcacaatattcttttgctcccaagaaaatccttttaaccactactaccctattcttgctgtttactcattgtcttatatttgaacacttctatgatcagtattcggcgtggacatcaagtttatacacaagtgtgtgcctcttgccattccatgtcattaatttcgtaccgagatttggttggtgtggcctacactgaagaagaaacaaaggctatggctgctgagattgaggtggttgatggtcctaatgatgagggtgaaatgttcacacgtcctggtaagttaagtgaccggttcccacaaccatatccaaatgagcaagcagcccgttttgcaaatggtggggcatacccaccagatctcagtcttatcacgaaggtaatgatattttatgccattggcgttgcattgtttaatcttccacctttcaagttgtaatttactgtttgactccgtaatgttcaggcaaagggccacaatggcccagaactaatggtgtttgctcttcttacctggttaccgtgatcccacctgccggtgttcaggtaaatctcattctctgtcagttataccttaggcatttgcagttgctacttgctatgtgtatcgcccttaattcctttacaaacaataaagatgctcttgcatgtggattgaatcacttgtgtcacagggatacatattttacagacacatgatattgacatcaaatttgacactgttgtaactctgtaattgcaatactggttgaacttggaggtgctcagcttcaagttgtgttgtcccattgttgtttgagtgttttctctgttaatttacaattattcagcctctcatttgttgtcagttattgtttggaattcactacataatcactatttttgttcataattatgatgttgaactctattttgaaaaaaacctaacctgtcccacgaagtgttatttttctagctgtaatttttcaagctggttgtgttctgttatttgctttctgcagtgtgcaacattagtaaactctctggttgatttgtattctagatccgtgagggtttgcattacaatccctacttccctggtggtgccatagctatgcccaagatgcttatagatggagctgttgaatatgaagatggtactcctgccactgaagcccaggtaagtttctaatgcgttgttgggctcttacagttgtgacatgttgggttagcattaagggcctaagcatgattgttgtcatcctctaccacagatgggcaaggatgtcgtttcgttcttgtcatgggcagctgaacctgagatggaagagaggaaactggtaatcagctcaacttttgtccatttatatattactttcaattcgcaatatttcctaataccaacctactctaatttgatgtagatgggagtgaaatggatcttcctactgtcacttgcacttctccaagccgcatactaccgtcgcatgaggtggtccgtcctgaagtcacgcaagctggtccttgatgttgtcaactgagggaccactgtttcttactttcattaaaatgttttgagcatttaagcggaagcatttcaaataatgagtatgatgtacattctgccactggggtttcccatgcctagaattttctgttttcttcctctgctgcaaaagcattttcttcatgggagcacttgcaatttttgtcaatgttacctgaatggtaccagcaagcttctaacagaactgctaaagttcataaatctttatgttttgaactgtgcacaattcatttgtttcgagcacgctgatgatttgggtttgcgtttttatgtgacggatgcctgttgaactgtcctgttttgtgtttttgtcaagttctgtgtcgaatctatgcgttcattcgcgctcaagctacatcggtattgtcatgcgcatatcatatgtcaagcggtaccaatttggtattttttttccggtagcttcatgtactatgctgtcagaattttgcgaacggtctaatgtaacagaagatacatctaaacgaaatttaacatttgtcacaactcacttttggcaatggctaggagtagagtttacatcgacctgaactcgtaggctctgtttggcaaatgggatgaggagtgtgggaaatggatgttatttccatttttcatatttctactgtttgggtgtggatgggagtgggatatagaatcctgcttgatttgagggtggattgactactaggaaaaattattgaattaccctcaccatttgaacttatagctaatagctgtgctgtttgtttactcatttagcatagtttgaaggggtattttagtcattcttctagaaacttccttttccaatccatccaaccaaatatgggataaaattttccttcgtataaactaccaccacatcctaccaggatattatatccatttcccaatgggtataacccattagccaaacggagccgtactcctaatgagtcactaggcatttagctcgtaagcttatatgccagctcgtgaattgtccgtttagctcaaacagttgtccgtttagctcaaacgagtcgaaccttaacgagccgatgacttgtagtttgtgcttgctttactttggaccatccaaaaacaacaatttgttttgcataaaagaaagcttaataatatcaatttatttttccaaaaaaagttaacatgaatcaatgatgtctcatctaaagttttttttttgtttgagttggagttcgtttaatttgttcttcgtgttggatttatttactagagcttgtagaaatttttttcatggatttatcttgagtttatggagatgttttttttgtcgaatttcttttaattccagtagttcactacatccacaaaatccataaacctaattcaaatacaagggtgtatcaggagtacagggtgctaactcattcatctcgcttagaagacgagggtggtttattagtgcataatccattaagtttttagctaaaatgacttgaaaaatagatcatatatatatatatatatatatatatatatatatatatatatatatatatatatatatatatatatatatatattaaaaaacatactatttaaaagttcagaaaacgtacacgtgaaaataagggagaagttgagaaatacgagtgccaaacacaaccctcataaatattaggcatacacatgcatttcaattaggaatccagtgagcttagcgattaactccctccagttatgagtatctgtgttcaactttaatcgtccgtcgtatttaaattttttttaaaaaattaaaaatttaagtcacgcataaaatactattcatgttttatcatctaataacaataaaaatactaatcataaaattttttaaataagacagataattaaagctgaacacagaaatttataaatgggccagaggaagaacattttactgtaggtctttgtcgaatataatggtgcgtgtgtagtggagtggtgttttcatgtaatccggggaaaaaattccctaaaccctgtcaggccaaatctttccaacccattctattcatctggctgaacccactcttctctgtcttcctccactcatcttatgtatacttcgaggatgagcagagcacctaaaataaataaagaaatatttgccgctactaaactaaactagtatcgccaaaaatactgaaatacaaagtcacaatattaaagaaatatatggtgaggaaaaaaacactttatgcgtgaaacaaatcaaggccatatcttgccatatctggccttatccaatatgtggtttgagtatcagctcttgataaatagtctcaaatgaacatgcaaaggagctcaccgttcagcaagtaaatgtagctaggcaactcaaactaaatcaaagccattctaggtacatcaagatcttaaacacaaagggaagatgaatggcatgcgtcgtttacaggatgcacatctgattttgaatacaaggatctaacacacaagcaaagcatgcttcacacaatttagacaaaccacatgcttctgctatgttgagcttttcctagcttagcaaacaacagggaaaaaggaacggtaacttcattgcttcatgtttgcggtgggggtgtgctgtcacagcctgctggcttctttcctacagctttggcttggctgccttttgcacctctatcatcctcatcagcctcatcgtcaatcagcgatccggagcgcatcagctccttcaccttgaggaattcatcatagtgagcacgacgatgttccttgaaactcagtcttgacttttcagcttctggatctacatgaacaccaacatataactaactctccgatgataccaggaaacatcccacaggaactatcatactccataagatttcaggttccctatggtgaataacagattattgccaattcgtaatgatggtatgtatcccttgcttatgtcgtcaaaagaaagtactccgtatacaacatgattttaagatgaattgacgaaatttaccaacgaggaagcaagaactaaacatttgtctaattatataaaacagatatattaagaagagctgtgtcatctgtcatcagatgcatctaggtcaaaattgaatttgctttggaagttaatagataaattggagctagcttaacatgtggaaataaatgaatattgataatcacttctgttcttttctgaccatcaaactcaaaaaatgtgttttaatcatcatcattttgagctggtacaaagtataaccttcaagatttattttgaactggttctcagaatctctattaaatgcctcctctccagatatgtacgttgctttagtagagcaatgctaagggtttggtcggtgtatgtgctttactattacaaaatgttaacatactataacttccagtaagatttgcgctacttatccaatgacaagacttttcagacatattcatgtaatttcctgataatcaattaattaatttttccatcaaaaacaagatgtcttcaaatgcatttaactgaaacagggaaaatataagagcaaattactacatgcagggtagatatatgaaaatgggaacagggtaagaggcacaaccatcatcttgttccatggcatctgcatcatcatctgaggatgcccaaccatcatcctttggatcagttttgcttgaagaagccacaccatttaaagcagttaaaatagcttcagcattaacagtctcatccagacacttgtcaaaaggacgcgttggtgacaatgaccctataaagaaagcaatggcaagacatattcaacaacgacacagtaactaatatggtcaagtaaaggtataatgagatcagaacaggaaaacatgtaccatcatcatctaccatagggtgatatggtgtcttaggctcagttatcttctgcctaacaggtttatttgattcaatctcatacaggttgtcttcattccacttcacacgacgagagctaaagaaaaacagtaaaatcaaattaagtaaactctaaactcacgcttgtgcagtagttttttttcaactagctcttaacagtccagcatttccacaccaaaaaagaaaaaaagatggtgtatgaatctaaaactccataaagttctttaatctaaaaatcaaacagtttttcgaaacaaaattcatgtacaaatcagcagctatggtgtatctgtctaagcacttagggccttattgtaagttattccaccatggtaccatcatcaaaaggaccgtgtcacctttttcttaacacaaaactttgacaagctctgtttgccctttcatcccttcagttttaacgtatcaggttcctgaaatccaagcagcataaatcaacaaactactatttctgggcctaaaagattgagacatcatacttcaacaatcatacagctctaaattctcaactttttagtatttatagtaatatttgattttactaaacaatcatacaatcatacagctctaaattctcaacattgagtcccatctaaacaatatttgaccctgaagtaatccggaatggaaccactgatttcatcatcattgaaactgctgaatctttacaccacctcatattaataactgcctggctggaaccttaacttttgtaaggtaaaaaggaaaaaaaaaggaaaaacaactgtaaacaaagaggtgctgcttaaattgattctttgtcaagggcccagggttcgtggcctttcttgactagctttgtctgtggtttcttcttagcttgaaaagatgagggggcggtctttcccccgccggccgagttttgtttttttaatttacatatcatagcaactggaaaataacaaataatcctcagaatttaccaaacatacttcttggtaacgtgttatgggcgtgggcctaaggtatgcaaaccagcagaaatatgtccaaaggtaggaagcaagaattgacctcatgattaagcttcaacacctcccagtgatggaaaataaatgaagtttgagaaatcctcactcacgaaagctgccaaagtcatataatgttaaatggcttcatcatgttttcatgcaggaaaattgatgatgcatgatgccagaaagaaaaataataacatatagttggagatatgcaaatacggtaaaaacattagaacattaaggcccaaatgtaatgtgagattttttctggtttgtgtaggaattgaactgatatctgtgaaattcctgtgttttaaattaaaacagagcccaactgtcagtggcataagtgtaagataggaaagcacgtgcaaattcccagttccaacatatcgacacgacttaatatcatctcaagttgatgatcccgaatgactcataatactaacaaagttaatcaaacaattttctgcacatgacaaatgagataatgaactggtagaatgtaacttttttagagagtgcatcatgtgcatggaggtgaatggtcttgcagtgactgaagatcaataaagatatttgagcaggacaatctataaatgcataactaacccagcttggagagagcacccaatattttgaacatagtatgctgtcgagacaagctattggcttaaagaaaaaataaacatagtgatacatttagcagcagcgatggattaactggtgaaaatggttactgctcctaccagctcagagtgatggttccatagtagtcagaaggggtaggatacccctgccctccacacgcacaacacacacacacatcaaaattagcatgtgttaagacagacacacacaaattgtgacatgctgatgttgccacaacgttacatacactatagaaataaatattggcatcatccaacacaaattactcttctggatgtgtgtagatttcataatactgagaagaaaaaccaacaccatatatatatatatatatatatatatatatatatatatatatatatatatatatatatatatagaccattttctggttttcatttgtctgttatgataagagaaaggttttgcagcccacaaacaatttggcctgcatcaatggatgtgggggcacactgggtaccatccccaattcttgttacaagggaaccattagtaataaactatctttaggttaactgaacttttcatggggtcttaaataacaaacccaagctccactggttgaatcgggtcacccatggaccctaagggatccactgattttcccttggtagcgatggccactagacacacttgcatcaatacgcatatattaatacccaccagctacaaggatggtgcgcaatagtttgtgcgtgctcaggaatggagaatgagcaacggcgcaatgacgagcaacgaattcatttattatatagaaccacaagtagtgcgggatggcagtgtaatcaaattttctagtcaggattacgatcgcccatcgactatctctacagagagaattattgccaactgtgttcagctttatcgcaaggcgaaaaaccacaagcggatcataaattcttggcgctcgatcataaatcccccaccctagaacgatgaatccaggtgcaggcagacctaaacctaacacgcgggggcatatggggtttaatcctccgttttccgtttctaacaaaagaaaaagctacaggctagggagagaaacgagatcaaaccaatcgaatccaatccacgccgggatgggggatctccagtccacaccgcccccgctgatgaagtggcgcggaaggaggagggatgggggagaggggggctacgagctgcgagagagaggaataggtaccttccggttcgactcgagcggcctcgccggccgcgcgcacgacggaggcctcccggcgacggcggtgggagggggggggggggggaaggcggcgcgggggccacaagcggctctgcagatcgcgggagagggagagaggagaggagagagcagaggggattggtcagaaacaggggaagaggtgggggtgaatgttgtttttgtcattgctaatttatccatttttttaaaaaaaattcatgacatgaaaaggtcaaacttgtaaagggtgatgaaaggcaaagacgattttgttcacctcctttaaaatacttctttttataaagaacaaacatgatcacaatacgcatccacttatttctatgaaatcatacacgcatacctcatctctattatcatataaaataactgggttggtaaattttcgtatcgaccaagttatcgtgtgtgtctcgttatcgacagatacattatccactactaaaaaaataattagccgtgaatacttgctcctttctcattagtcacaagagttgaggcgtacaatatagtctttgacattgaataaatattttgatcattaatttcttcctaatataggtacaaaacaagaagcattaacaattaaaagtatttttaaatattaatataatgatattatgtcatacatgaaaatagatagggttaattagatacatgccattaaaaatttgctggtttcgaaatatactattactatttacgtatttgtaacaatgctactgctatttgtaatctcaattgcgtatttgtaacgatgccactgctacttatttgtaatttcaattgcgtatttgtaacgatgccactgctacttatttataatctcagtggtgttaatacccacaaagatacgtattttgcatgtattagacgaaaatgcactcatcttttacctctctctcttccctcgtcttctacctctctcttcccgctgctttcttgctccaccgccgctccgttctctccgctctctccgccgccgtcctcgccgttgtgagccacaacttgctctatcgctgccgccatcgccctcgctgctcgagcccatccgattccagcagtcgctgccctagtcgcctcagccgccgccgtcgcaaccgcaacactgcactccgtgtgcccgtcgccgtcgcaggcgtcccccagtagcagcagcagcagcaggcggcggccgcggcgagggtgcggagccccgaggtggagatagcgctgcagtcgcaggcgtccccctaacggcagtgtgaggtggagggagatgcagatgtcgcgtgcaaaataacgctggagagggaggagacaatgactgcaacactcgtatgtttatcgctggttgtgcttgctgctgccgacactaagcatcactggtctctgagctgtggaagaaagaaggggagaaaaaggaagaaggaaacaagggcaatttggtccacattttttcgtaaatgcatctaagaggtaggtagtggcatatcttgaatatgtgtaaattatatggcatggattcaaatatgtaaatgctcgtggcatattttaaaaccggaatatttttaatggcacggatctaattaacccagcagagtaatcctagttgatcttgtaatacaagcaaacaaaaatgataatattttagctggcttgatcccatgtctgatgtttacaagcctattttcatctgtttatttctcttggcacagtgaattcattcgttaggagcaccgtctaccgccataggtaaagagaaataatattgcttttgagatctcacatgtctcactggacgttttgacgagccagtccgtggcagagttgatactacgtacaatccattaattcaagttattagggttttaacatattagatgagcttttaggagtccagaacatgaagatgatacacccggtggtcaatctttgttatttcagactgtcaactgcgaaaaatgactttggcttttttcttttctcgaaaaacacatgagacgttatattttattaagaaaaaaaataaaatatgattagctgtcaaacttcttttgcctgatcttcaacttcccatgatgaccctattaggtgaatggagcaattagcttagtactaccatgaaagagttgctgtctagaaacgttgcaatgttcgtgaaaggtattatggcatcttcatgaaaattacatatgaaacaaggtgaaaggtcgcgtgatttgctattaagtgcaaaatttcaatcagtttcaggcggtcacaagtgcttatcatgttacaaggtcctttgaaactcccagcctgaatgactgagacaggttatcaacaggaaatctacgagtatttgattcgaattcgagcatatcaaattcgcacaatgagaaaccaggtgatccattctccagtctaattgctaaattgacataccatgcagcgccggattcgctcagatctcactgatgtactctaaaagagattcgacctcttgcctcagggcagcaactttctgctgctgggcagcaatcctgttctccacatcttgccctcgcaacttcttttcaaagctgtcaaccacagtggaatgccttgtcatgagcttatcctgcaactctctctccttggcaaccaattcctctacctgcattaaagaaaaaaaggccaactgtaaccactatggcgcatatacttaattagagaatgtgggcaaagaactcaaattcaaattaaatggtgaataaagatgcactagtaagtatctctctcttctaggtggtctatgcacaagacgttgagcaaacctttggccatatctggtaagactgagaggatgactgcagggatgtcaacaatggcttcaactcttttgctaattccttaaactgtgcatcagctgtcttacgagccactttgcatgatttaacatctcctgacctagataactcgtgtaatgaggtctccagtttatcatgagctgctagacattggttgaagatagcctggatttgctggatgatgctctgtacctgtacaaaaagtatgaaatagattgtagaggttagtctgcagaaagtaagaggtctccacaagtttaaagcattcttcaattccagaaacactacaattaatgttgatccagcttaactgcttaaaccaatgatacgcaattattatcttcttaactttgaagtttggattgaagatttaggacttttcaagtaacatttttttccctgtcaattatgaagctcgcttttaacacagcatggactgctctttacctccagattcatttagagcttgttttgcagattctattccaccgtggttaagacccttcacttgtaacttgtccatttttggaccaaagctctcaaaagccaatctttaacagaaaggacagcgttctcacatgattctgatagtaaacttgtcacttatccaactaaaagttctcacatgattctgatagtaaacttgtcacttatccaactaaaattactagtaaacaagccctccccaaaatttaaggccaccattcaaccctgcacattttgagacctttcctagctatttgctcaggccctaatatgtttgtcatctgatatttactagttcaagtttttatcattgcattttttttctcccataaaaataacaccgctacatagtactccgtatgagctagcaaaccaattcgaattatgattcataagtttatttcactgtaattagtgctcatcctaaacatagcagcagtatagtaacaaactgtagttcactagaagaaaggttatggcaagatagatttaaacatttctcgtaaatcatcaaaatccaatcctcaaaggggagatttgactaaaacgaccatacctcatcccactgcacctttgccagataagaaggagaattcttagagattgacatgtcagtgcgcatgtaaacaatacaggccatgaagaggagaaagaagccagttatcaacatcatcggttctctgagtagagagatgttgttgaacctgtagtaaacctgcatattgtagggcattaacaccataagtttgctatggttcacataaaacaccatgagatagacaactcacagaaagtattcatggtgcagtaagccttttgcatagcagattttacatactcttcagtcaggttaataatttagcaacgctcaacttttcatggaggggtaaaattagttgcacaacaaattaagtctgaagacaaacctggaaatatagattatgctctggaataacatcaagct

SEQ ID NO: 53576 - DNA, 1472 bp, Oryza sativa
  unsure (1)..(1472): unsure at all n locations
caattatatttcaattaagcaggagtaaaaacacagacagggttacagaaaagaaaaaaaacaaccacttggcgagtaaactcgccaagtacctcaaccgtggccggtacaaatcacacagcacacggagcaccacacaacttctagccaaactaccacggcgaaatccaaagacaaacatcgacgctgagatgctgaagaagtggcacacgactttgacatcacaaggcgcatgtcatcgttgccgagcttgccgcccagcgaccaagcagcttcgacttcacggcgatcgcaacatcatacaaactttttctgtgtaaaactttttctgtgtatcgattttctagtttacgcatgtattcctattaaaatcatatccttcacgcgtttcaaatcaaagtagccctaagaatagtactccttgtgaaggaaattttacaaaatttgttgaactcttgcaagcaaatcactttgtagtttgtacgatccgattccaaccccaaaggcagattggtcagcatcaaatatggcaggctgataatggtaatggcacctacatcaccaacaaagaactgcgaactgcattgacggccacatcaatgggagaacatttctacgcgcatgatccgtcacaatcttacaacaaggcggccgaaaattccataattactactcccttccctctgttccaaaataccaaaatataagtatttttagctataaatttgaataactatatatctagatttatagccaaaagttattatattttaaaacggggataatatagtagtaatgaataatgatggctagtaagtttttgcactccttcactctgacaggctcttttttctctctcataaatatagtagagctaggcttcatttcgttaagaataagcataaaatcccatttccaaaggagggttcacattcatttcattaagaggaaacataaaaacccatttccaaacgagggttcacaacccttacgcgtactcctaccccaaaataaaacaacaaaacatcataagatgacggaggtagtgctcgtaagatgcatcacataaagatgacacacaaccaatttgataagcactaatccacaaaacatcatctttgccacacaaagagtggcagaacattgaagccaaaaacctgtccatgactacagcaaaatgttgcccacaattgctagtagtaagcaagaatagaatacaacaccaagcaggcataaaacagacaaaagtcccagcaacgggcattaacaccgactgtagcagcacatgcagctgtagtaaatatttttcaggtgatcgcagggaggaccggaggaatagtctggtaggtcaacttattctggaccaagatgtctggaatttatacagttgggcatcaatttggaatcttggttcannnnnnnnnnnnnnnnnnnnnnnnnnnnnnnnnnnnnnnnnnnnnnnnnnnnnnnnn

SEQ ID NO: 53577 - DNA, 2668 bp, Oryza sativa
  unsure (1)..(2668): unsure at all n locations
aggtttcggcggcggcggcgacggcggcggcggcggcggcggaaggatggatggctgtggagcagtgtgaagggatggacggccgcgtggatggtggggaacgaaaagggggagattttaaagcgattggttttggtttgtttttttttcttttcttttttcgatatttgtttacgtgggttttggtttggtttttccaaattaaattcaaattaattttgggttgagtgattaggtagaggattatagagggtttgcgtgttaaattggggttttggaaggaaggtcagtcttccgggtgttgtttgaattgaagattatattatggttgagacttgggtgccatgaaatttcttctcggttaactatcattacaatattttgctgagttggcacgagttttcatatcaaagttatatttttagcagttttatgaactgaaaataaaaaaaaatgtttggactttgtaatgagaggcacaatgccgacatggaaaaacaagtaaaattttgtcagtgaatcactcgaaacgaacgaacaaggtatataaatttatactcatcgatcagagtatcttatagtatatatactctttccgtgttttaacatatgtgccgttgattttatgagatatgtttaaccatttgttttattaaaaaaatatcatttattttattgtgactttatttattatcaaatgttctttaagtaagacttttcaatgtatacaagaaatttgaaataagataaatgatccaacatttattaaaagttaataatattatatattaaaaaacgaagatagtattgtaaatggctccttttgttttatactaatatggctgaatagctaaataaactatacttgtctaaaaagcgttaaataaactatatccccttcatcctcaaatataattattactaactatgtattttgataaaggtatgtctaaatgtgtagctaaaattgactatattttgagatagagacagtaaaaattattcgagagtagtataaacaaatgaattaaatattcgagggtaatattatttgggatggagtataaaataaaaaataaatctaacatagttttatcaaaaaatcatatataaaagttttccgtaaatcactctgtttataaaccttgggaagcatggacatatatcaaatcatttcattaaacataatttctaaatatttagtcatttttcctccttacattaaagaaaggcatatacatccacgacacaagcttaacaaatgtatggatggatcatggaatatttggttacggagtaattaggtccggaagagcacacgctctatttcgaaacggctacttagatcacgtttcatgaaatgctaaatgcttgtttcatgcaaaagattttagttatatagaagttccattaaaaataaataaatctttttttaaaatataatacttaatactcgattaattatgcataaatggttgtctcattcagtgtgcccttaaaatttcaagctaaatagagctccaaatgaagccttaaaacacgagatttttttttctttacagcttgaaagtttgtcctcgcaaaaaggaaatagaaacattcagaataccgtctaaaggagaatcgcatactccatattgggttgattgggttggttccttaaacacggaagcaagctttgggctgtgtttaaatcaaaagtttggatcgaaacttccaattttttccatcacatcaacatgtcatacgcacacaatttttcagtcacatcatctttaatttcaaccaaaatctaaactttaggctaatctaaacataaccttggtcacgtagtatgcgtaaatgtgtcgatatctttttctggatcatgtgacagatcatggtattggcgaatattccacgcaatttggtatcatgataccttgtagtagtagatcgcgtgggggcgtgtgtgttgctaaagaatgtgattcttgtggcacactgctagctctacttgcgatttctatacactaacactaggctgctcctgtctttttcagccttcagaagcgaataaaattatcatcgctaaagtatataaaggtgataataaatgtatatatgttgtcataagagcaagtttaatagtatagccaactactggctccaattcatctatagctaatctaatagctcattcatacaatagttacatactacactattaatacctggtcccacctgtcatacacactgtgtcttggagtccgtgctacagctgtctataaatctgtagcccgctgctttcctctctcctcatttatcttcttaaaatatgtttgcagctggtttatagcctgttattgtacttgctttaatgctctaatgatgggcgatggcggcacggaatgtaagacggattaggacaagtttaacgaaattcgacggagactaatccgtggctaattgtttattgcacagacatgatttttcctccaacaactgcattngattttttccggctccaaactacacgtttgttccaatcttgtttacgaaactgcacctgtttgttgcaaagtttagttttctaaaacaatctgcaacaagtgtacttttgtgtttatataagggaagtgaaaagtgtacttttatgaaaccttagtacctgctcgctcttcacgat

SEQ ID NO: 53578 - DNA, 3451 bp, Oryza sativa
ctccaaactacacgtttgttccaatcttgtttacgaaactgcacctgtttgttgcaaagtttagttttctaaaacaatctgcaacaagtgtacttttgtgtttatataagggaagtgaaaagtgtacttttatgaaaccttagtacctgctcgctcttcacgatattcccgtacaggtgccgttaaatttacttgcataacgatattcccgtacaggtgccgttaaattcatttgcgtaatactagcaggcaaagtgttaattacaaactagcaatacaatactccctccatactgtaggacgccgttgactttttaacgttgataaaaaatcaacggcgtcatacattaaaatacacagggagcagtagttttcttagaccgatcactaggtgaaggtttcttcatctgaattgattataagtagggaggataatacaaggttcattgatttacaatggagcataaagggggaagatgaaatttcttcacagggtgtaactacaatcctgcaatcgtatttcagatgctcagcttagagccgcatagcatcatctacacattttgttataaacctagcgagggaccgcaggtatgattccacaacctccaaaagcaaagaaggtagaaaaactggaagtgcttgaacggcagttggctgggaggctgcaagctggtttgatctctcatggaggagatgttcagttgcaacggtagttgattcagttaatgagaatacttacataatttgaagctatgatctacgaagaaggaatttgattcagtaatttgaagcgtagtagcaattggcagcagagttgaaaaaacatccagtcatcctatagaggttgactgctcctcaatgtcctccctcttattgtcatcgatgacggaaagctaacaagatgaacaaatatgctgaatctgcttcctgacgtgcatgctcggaaggtgtgaaatatgcctactattagtatcaactatcttcaaccacaacggactgaggtgcatgcttagaaatcatctcttattgtttggattgggtacccatgcgttgcaacggaaaaaaaatcaatttaagatcacatgttttaatcactcacgatcccatgtgactaaaatttgagccaatgccataaaagcgatcatctcttactgtttggattgggtgccaatgcgttgcaacgggaaaaaaaaatcaatttaagatcacatgttttaatcactcactatcccatgtgactaaaatttgagccaatgccatgaaagcgaagtaataagtagataatttgcttaataaaaaaaataccccctccgtattttaatgtacgacgctgttgactttttgactaacgtttgactcttcgtcttattaaaaaaattatgtaattatcatttattttattgacttgatttatcatcaaatgttctttaagcatgacataaatatttttatatttgcacaaaaattttaaataaaacgaatgatcaaatgttggtcaaaaatcaacgacggagggagtacttgaaaaaggaagtttaagcatgaaatatatgtatcttgttttatagctgaacaatattactaatgttttattttgaagtacacataacgttaacaatactattttttttttgcgaggaacgttaacaatagtatgaatacatgatcaacgagttcctaaatttttttgaagtacacataacgtaacgttagatcccactccgaacaggtaatgattatatgtatcaaatatacaacgtaacaatcatcctgccatcataaaagctcatgggatattaaaaaaataaaaatcatctcaagagactgtgtgctacatattaaatgtaatgatagaagcttaatttgtacaaaaaattaacaaggcttaaagaacattaaaaaatcatgcttaaagaacatttgataataaataaagatccaaaaaatcaacaaggcttaaaaatttaaaaatacaaccagctactaatttgtacaatttaatattccaagatgacatcttatatgtccaactaatagaaaaaaccatgactacagacatcatgattacagcttacatcttataggtcaacatacagctcggtacccggaatttattgacaatgaaatgccattaggaacatgttagttggacagtaacactggatatttcagcaacataaggacagctacacagactgaaatagattctacatgtgtgtacatatatgaccatataatattcatatttggtgaaatcactctgcaaatctaatcatgcacacatagtgtattaatcttatttttctcaactaatactaatcgaattagttataacaataattgaaaaaaaaagaatgtgataaatgcatgccggatctatcatgtttaactgcatgtgataaaccattgtgtacggtaaatgaaatatgaaataagtttgactgatattccagtaggtaatgatttcaacagttaatataaaaattgcaaagataattagttagtacacaatattctttgtgcacactagatatacctcgtctatgctatgaggacatccttgtacacaatattctttgtgcacgttgtagtatgtttggaccgtttgtttttcttcctctctttgtcctgcatgagagaatcttgatgtttgttcctgaagttgctctagacaacgtgacgtagagctgaccatgagagaacaccggctccgggaggtagacgcctgcatttggaattgtttgtccttatgccttattgatcgtcaattcgaaacatagtctaattggaaacaactttctcttaaagtgaaacgggaacatttcatcatctaaaaggcatagaggtatccgaggaaggaaaactcccttaccagcatgctgccctaccacaatctccacgttaatagcatttcttccgaacccatgaaccactagtggccttgtcccgtttcaaagtccgttggctgggtcaatgttcctcaatagcatgatgggtagtttaacttcagctttagcacatgcggaggtagcccgtttggagttagagagttcaagaattcgggcaggtaatagctatgagggtcatcctctgctcggtaaaaaactatgatatgtcatcatctctcctcgaaatcgctcgatcattttcatgtttattcgatccatgaactcattctgagtggacattatggccctagatgtgatgtagtttgggtccataaggttatcatttaggttggggaacacggtatccatgagcccatcgaggtccgagtcaatccctttgcatggcacacaaatatccgaagtcaggtgtatgtgtccttcctcattcacctcctcaatgccattcccaactcgaaggaggttgtccgcaaacaaaaggtcggtatgcgccctcttattgcgaacaagcttcaactgaactatagaatcccaaagatagg

SEQ ID NO: 53579 - DNA, 3773 bp, Oryza sativa
agtggttcgtgggttcaaaaagaaatgctattgacgtggagattgtggaatggaaacatgctggtaagagagttttccttccttggatactcctatgcccttcggatgatgagatgttcccgtttcgctttaagagaaagcaatttccaattagactgagcttcgcattgacgatcaataaggcacaatgacaaacaattccaaatgcaggtgtctacctcccgaagccggtgttctctcatggtcagctctacatcgcgttgtctagagcaacctctagaacaaacatcaagattctctccgtgcaggacaaagagaaggagaaaaaaaatggtcagctctacatcgcgttgtctagagcaaccgtctaaaacaaacatcaagattctccccgtgcaggacaaagaggaaaaaaaacaaacggtctaaacagactgcaacatgcacaaagaatattatgtacaaggaggtcctcacaacatagacgaggtatatctaatgtgcacaaagaatattgtgtactaactaattatctttgcaatttttatattaactattgaacacatttgatatttcagttgaaatcattacctactggaatatcagtcaaacttatttcatatttcatttgccgtacacaatggtttatcacatgcagttaaacatgatagatctggctatcacactcctttttttttcaattattgttataactaattcgatcagtattaattgagaaaataagattaatatactatttgcctcacttgcatgatcagatttgcagagtgatttcaccaaatatgaatatattgatatgttcatatatgtacacatatgtagaatttatttcagtttgtgtagcttcccttatgttgctaaaatatccagcgtaattgtccaactaacatgttcctgatggtatttcattgtcaataaattaaatccttcctgtatgttgaccaataagatgtaagattgttatcatcatgtctgtagtttttttgttagttggacatataagtcatctcggcatattaaattgtccaaagtagtagctggttgtatttttaaatttgtaagccatgttgatttttttccaaattaatagcaagttgcttctttgatttgtaacccaggttagttctttatttagaaagagttaacatctattacaatagtatgttgacgaatatgctaagagaatacagttttcattctgcaggttttactccttttgataacttaaagcatgtggtgaaggcaaacacgtgaattcgtggcagaaatttttgtatggaaatttaacattgatcagaacaatttgtatgcaaattatgcatcacaaattggcatatatttgatacatatcttcaatgtaccgtattttatcatttaaattaagcttctatcattggatttaaaatgtagcatacagtctatcgagatgattttcattttttttaatatatcgtgagtttttatgatggctagatgattgttacgtcgtatatttgatacaaataatcattgactggtcggattcgaattcacctaacgttatgtgtacttcaaaaaacaattaggaacttgttgttcatgtattcgtactattgtccagctataaaagaagatacatatatttcatgcttaaactttcttttcaagtatttttttattaagcaaattatctacttattacttcccttttatggcattggctcaaattttagtcacatgggatcgtgagtgattaaaacatgtgatcttaaattgatatatatttttttcaagttgcaacgcacgggcacccaactagttcacatcattttatcaattttaggtcatgttctccaagcaattacacaatattttagtgcttctatcccgttagaatggctgactcaattaaaggaacaacaaagaaatgtgtcattagaattttttagaaacaaaaaggtctgcattgttcacatcagtatttttgtttaaaaaaaaaaaaggtctgcatttgtaaactaatgatttttcaaccttcatcttgcatctaaaaatattgatcagccataaaaaaaagacattcgtgaaccagggaatagtgtgaacacatatattatagcaatcaagagttgagaagttaagattctcacctagagatagtagcatgtgagttcacaagatctgaataactggagctgcaatccttaaagcatcaatctgtgaacagaaaaaagcaaaagaagatttcgtgaggtgaaagcatgtgggtttgcaacagttgaaactcgaataaaaagaacaattctcaccggacactatgcacctgggtcagcttcctgtcagccagcttgtaaactctgaaactcgaatcagaagaaatttattgtttgcatatacttgtggtcatcgcaacgcgagatggaggggattatctgaaataccagatgtaggggattaccaaatggttccaaacttaactttgctttttttacatacaggtgatttttacatataggtgattatctgaaataccagttgtcatgggcgttgggccggctaaggcccatcggcagcccatgacaccagttgtgcagacaaatgagtgataacaatctgaatctctccagtagagaacataaagcgaatcaaggttgttcttgttcatgatttttgattatattcaaaaccgtatgatcaacttagtaggaaagaaaatcagcagattttatacgtgttgtgcctatttacaacctgaaacttatactaatgtatgtgatggcatgagctccctaacatggctagtatgtatatatctgctgttattatgaagagaaaacatggcagcatatgcagtcagcagaacttaccaagaagtgtattatactggagaggtagatggcatgatgctgaacttgaacagccttaagagagattgaattgaggaaaattaagagatgatcgaagtgtagcctgaaaaggaaaagcagagtgagaaaggttatccaatttctctgcagatattcattaaaaatatattgcagcgatcctttttaatatatcagactacccaacatacataatcttgattttagctgctataattaaaatcattgaataaacatgagaaattatggttaatagtgaacagtggggatttagtcaacacagtggatttctaaactcgaaagccattatgaatctctatgaatgaatgaaccataccctgcctcgtatgcctcctcctgtacaggaacgggatcgtctgtacactaagtgaacgcaacatttaattcatacatagtaaaacatcaagtacactaagtgaaacatttttcggtggaacaaaaaacaaaatgaattctcttaataggaggtttccaaaatatgtggtttttttgttgcactggaatatttcgttcactgcaatattagatctatatatagtaaaacattgtgagtacactaagtgaaacatttttggtggaacaaaaaataaaccaaatttccttaatagagagtttctaaaatatgtgggttttttgttgcaaaagagtattttaattcactgcaacattagatttataaatagtaaaacattgtaagtacattaggtgaaacatatatttggtgaaaacaaaaggagggagaagtaggtgggcccacgtggggggaggggcgcacggggagtgcctgatccggctctcccgcgccggtcgcgcgacgtagagattttcgaaagaaaggcgatccagacgttggatttcgcaatcgat

SEQ ID NO: 53580 - DNA, 10636 bp, Oryza sativa
ttttctttataaatttgtcatacctatcacgagaggtgataatcttggcaaacatataagagcagctctagcctgcacctaaaatcgatttcaacgtaaaaagaaccgaactatgcacactgtgggaagcgaactgcatgtgtcagatgaaaaagcaactccaaaacaaaagtcgaacactgatgataaaaaattgcttgttgctataggtgggattaagattttttttatgggtcccacccaaaatcgattttaacgttgtaggggtcgaatcgaatgtttatttgacttttgtggactagacttttgtgttcgcaagtgcaggatgggaacacatccctcctgcacgtaaaacggagcgtccttttaacatatgattaattaagtattggctatttgtttttcaaaaatggattaatttgattttttaagcaactttcgtatagaaaatttttacaaaaaaacgtaccgtctagtagtttgaaaagcgtgcggacaaaaaacgagggagaggggttgggaacaggcgttgcaaatacagccttaccgaaccaacctacaaatgccctaagcaaacacacgccacattagtacacgagcgcgttttttttatttgtagctttgattttgttttctgtgtacgagaatctatacgataggacatcaagcacacatgagacaaagattatactggttcaggtcccttgcgaggaagccctaatccagtttatatgggattatggagaaaaccatatagattataatagagaacaatggaaccctgagattgccgacgagatccctatcaagaacggctcgacgagatccaccggtgagttggcttcgcgttctcttgattgtttctgctatggtgtgtgtcttgcgctaagattcgatgccatgtgcccctccagggtcctgtatttatatcgtaggttatcttgacctccagtagaactcggagatacctttctacgtatgggatcacaaatcccctatttcttccgaatatgactcttgtcgacgtttgatgtcgcgattccggtatttgtatggtatggggatcgtcggtgctaggatatatgcgagactgaggtaaaagagatatgtacaaggatttttatacaggttcgggcccctgaattgccaggtaatagccctacatcccgttggccgaagccggtcgttgctcttattcatcataatcacaccagtacaatatttggggtagcctatctaattgttgtcgacatggtggtctgaagttctgactcgtagtcgacaacagggtagtcttcctcttcgaatccgtgcccggcgagatcagagatagagctttcgtttctcctgacagtatccggagacaccgtagggaactagctatgcttatccctgaagtcgatatccgacgtcttgtcttggcgtatgttggcttgtatgttgatcttctgtcttgatctattgttccgtgtatgttgattgtggtgggtgtgtccctctcctcctaggaggccttgtatttatacccataggtgtctccttgtccaagtagaactagggaaaccaatatggatacaatccgagtagtccttgtcgtttccatgtagaactctggttgtcttttcttatccggaactccctccatatccgaggtcagtttccgtataagatatggtatgtggtgggtcctaccaagatttagtcaactactattaggtatgtggtatccgtaaccctgacaacactaacatcttttattcggggagacggtttccttgcggatcggctgttttccttagtttggaggtaacattcccgtatacttgaggatataccgtatttgtatatcttacgaccccaaggataggagatatgccttattcgtaaccctgatagtggaggccggtcgaaccggggttttagaactggtcgctttgggttggtccaacagattagaaaacctttttggataaggtgaatagaccgggccctaggccggtcggtccgggcatgcccatggcgctataaccccctcaacaccttcctcctcggcaaggagacactcttggcaatatttttatatttcacttgatctattgtatttactctcatactacttgagcacttctccattcactgttggtttttgagggagagtaagccaagataagtgtattgcaatttcatttctacccctactttgatgtctaatattgattttacccttattttttagggttttcgtttttaccctcaatttttcgaagtgaatgcttgttttgcccctactttggatggtgaagttaacggtgttaagtgattgagaaaatgacatttataccctctcatgtatgtacattaattatgtttttgtccctattttatacacgtagctttgaaactttatttttgggagtatatttaaaattagatgacgcacattgactaatataacaatttggacaaattctgaatttgatggaattttgacaaaatttcagcattttgatagaacttaaacaaaattttgacaacattttgtaaaatgtaattatatgttccctttagatattagtcaatgtgcttcatttaattttaaatatactcacaaaaataaagttctaaagctacatgcataaagatggggacaaaaacacaattaatgaacatacatgagagggtataaatgccattttgtcaattacttaacatcattaacttcaccatctaaagtaggggcaaaacaagcgttcagttaaaaaagtgagggtaaaaaaaatcctaaaaagtaggggtaaaatcaatattagacattaaaataggggcagaaacaaaattgtcccttgtttgaactattgtggcacttaatcacattcgagcatggttgccacctgttacttttgaaggttgctgcatcctatatggttggaacgagttgtccagtgacctctacgagaagattgtgaaggaggcttgatattagttgtctgtgatgccccagtaataattaggaaaaagaaaaaagagaggaagaaaaaaaaagcaagcagcaaatataatggacgcatagagcaaagctagctagcgtgcagcactagtctggttggcctttgggccttgaccggcccacgcgaggagtagcggtgctatcaacgtatcaggctagcagcaacaggcagccagcaaagcgcaacaagctagctggtcccacatctctagtgaagcttgagatataatactagcttacttatatattaacatcaaaattgaaacttttttaaagcgaggataaaagcacatagtgttacattgtaagtgtgttaacagtgaaatttggtaagcccctaaaagaattatcacatcaccaatagtcagattcctgctatatttggttaagaaaattaatctatcaaagaaagcttatccagaagtgacagagttcaagaaggatgcggcatgacaagttatctattaattagaaataatttattagttttcttttcatctttaggaaagtgtatttaatgtcctataaggacttatatgttttccttttatctttaggaaagtttctttattgtcctacaagtactagtatgtccccataggtataaatatgtacacatggggtcattgtaagagatctccacgatcaatacaattcgggccatcgtcaccttttaccttttctattttattttatcgtccgacgggatttggcacctaacgcggggctgcatcgcttttcgatctccggcgaaggggtaggtcaaatgttccgccggcctagacaattatatcgtctacgttggcgtcgttcaaggctgcatcaatacattcgacctcttggattgctcaggtttggatgatatatttgtctgcctttttatcatatgtcttagttaatctattcttagtatatcaatttagctctatcggttgtctctcgctttagggtttctgccggtatcggctaaattgttttactagattagattagataaggcatctaccaccttaaaaattaattagtcaagggcttgattgtctagatattatgtttcttttcatacttagtgctgcatcagttaagtttgatctactaaaccgtgtttagaaccataatctctagcctgcttcttgactgctaataagggtttcatcggggtttcagccaatgaggtatctagatgttgcatcggcttacaagcattacatacaagttggatttagctaattgcaacaaaggtttcactgtttatccaatcttgtggattttatgacatcagacctctagccgatgtatgctttaatcttcggatcagtgcttattctatcatatcatttctagccgactggtttctactggattatattgtttaattatattgattatcggccgattgtctttatatcattatatacattggacgtatagccgattactcgaaaccctatcgctatcggctggtatcggtatcggctagaactactccatcggcttgtcaaccgatcagctgttttatctattgtttatatatcttgtcggttgcaggatcaaactgactggcacgctcgcatatcatcaagatttggacctgcactggagctaagcagatctcccaggtcagtgtgtatttttagcatcaatagtatggtccaacaaattgagttgcgcctaaatccgcctttagaccctaggcatcacaaccaccttcagctgaaggaataaccgtcctagtgatcgagccttatatgaacaacttcaggtttggcttccaccttacccattccttaactaggggatttggaggtttgacggtttgatcggtgaggttgggctcttgtgtaaaccatttggaaaccggctcccaccttaccgtgagttcttcctgctgtgtagttgaacatccaaaaccctcggtacgcattcactctgtttcgtatattcaatctattcatgttttacgtactgtctagttttagtttacatgtatagattgtatgatacgattatgctagtttacatgttcaatcttatgatttatttatagaataaattaaatcaatatgtatatttttaacaagggtcaccctgactcttcgttggtatttgattagtgttgttccattaatcatgatgtgtactttgccggattccaaaagctgtttaatccatgtgatccaaactgaattaaacccctgtgcgatagtatggtgtagagacattcccagtttaaccatatgcacaattttagggtaaataaacatttgcagtgtatctactgcattacttctatgtgtttattctttctttattcacttttcagggtgctcagattgttggaatggttgcagaagcactgaatgttccagcaactgccaaactatttgattaaggccaatgatgtactgggtatcccccaaccttttattctatcaatgtgatttcacctgtttcagagtacttgttctgccatgttaccaagtttctgtgctctactccaaagttgaaaaaaatagtgatcatgctaatgtttttaaatcaatggaccaaaatttgttggatctttgaatcaatggaccaaaagaaaagcttgattcaattaggtttgttgatgaatctaggggttgtttagattgatgacattttaaaccataccaaattttctaaagttaccaaagatgtgcatacatttagttttgtaccaaatattgctaaatacataaggaatcctgcaaaaacttggcaatattgataacttaccaacattctagcattgccaaaatttgataatgtttattttggctataatctgaacagcccctagttaaacacctctatattttcatcttgcaatttctgctagaagtctagcccacaatttttttgagaattcccagctatgattttatcaacaattgtttgagtgccaagtatgacatatttcagatatggttccggttattgtcagttaaaaaagttgaattcttatggtagaacaatactttttttagccatctatgtatgggacttcctccgtttcataatgtaaaattttctagcattgcccacatacatatagatgttaatgaatctaaacacatacatatgtctagattcattaatatctaaatgaacatgggcaatgctaaaaagtcttacattgcgaaatggaggaagtaccagccttgcagctgtagaagcactgcgtgcacgtgattgagaccaaaatgtaattgactctgtagatgtcgcatgcagtctcagcttatgagaatacactgcacttgcatttgctggtgttttcaggtaattcctttgtcatgttcataaaatcatgcatattttgttttgaaacaataagcacgtgggttccttgcctatcatgggggtgaacatatatacaatggtttgatttgatcgatcttttgttaatacctgtaagatggaattcctaattgaagcatcatactttttcattctgctatgtgccaagtttgtatacttaatcatagttctaaacatgcagggatggtttgaagctgtcaagcttagaggagaatccgtgctggtcactgtccaaaaaacactgagatatctctaccttgatttttttttttaccttcgaaatcgataagttttcattatctgtgtaggatgcttcagatgctgccagcagtgctatggttagtgtgttggtctagattcagaaacggtgcaacaattatgcgatgctgcaatgacgaagtagatgaaaaagaaagagttcaaatagctagcaaacttactgtgtcaagtgtttcatttgatgttttcggttccctatttggtaccattgtcatgttgtgttattttattgcagggaaattacgctgtttgtggtgatgtgaagggtattgaagaagttgaagtcccttaaggccagaacgatggttaagtgttcccatgcatctatatgtgttacctgactatcataacttgatgtgttgtattttggaaatgcagtaaggttaatctactgaatactagctcctttgctagaaagaatatttgctcccatccagcagctctcccggtaccgaatctcggcccttcatcctgcccgatcgaacggttggaaacatacggtacctccaggtacatatttttttatgagatggtaccacctgtattgagagtggtggaaaggtatttttttgttccttttcgtggtaagaattaagtttttttctaaggcttgacccccctaggtttttaatttcccccttgggtgggggaacggcggggggttgggaaggtaagcgagggccctggccggtggatttgggtgcggggggtggggtcccgactacggtgatgaggtggtggtgctgtgggcggcggtggccggtgcgttagcgaccttgattgtgaggtggtggcgtcgagttgttgcggccgcggtatattaaggtggtcgtcggagtcggtaaatgacttagctgaggatttatcaataatttcacagcgcgcacagagattgttggtaatgttctttcatcattgcttgtatggcattgccaggtcaatgaaggaaaaggcttttcagataatccccatgagaaataaattagagggaattaaaagggattagttccaggtatatgaaatttcctttcgattttcttgtgaaaggaattgaccaaacaagatctaagagaaataataaattaataaaggtacttgaattgagaacattgatgcgtgagatctgtaagtatcctaatgtatcgaatgttagcaacaggggttttgtggcaaactgtcagtagcccatagttcagagtttttttttggggtttcatgtttatttacaccctgtggttctttgactccaggggcggattcaacgtgggtgtagggggacccacaagacccatagatacccctcggaacacctcctttaattttttcaccatgactgataaactaaagatccctaaatgactggaggttaaaaaaactgtgtaattgaatccccaatattttgttcctggatcaacccctgtatgaccctccacgtgtgtgcatgtgcaacggggtacaaacaagacccataaatactgctatagtttacgcaaaaatccttaatgctgctcctacgctgagactgatataaattatatttgtattcagaaactattaagaagtggagtactccatattatcatttcacgaattatactcctggtcgcaaatactgttgttgtggataagatttaatcaaacttttgatgcttcgactgtcaatggtttatgaaatacttaatttgaaaaaaatatattttatgtatatttgttttaaaaatacagtaagtataacttatagtaccttataaacttaggctgctttcagaggtggagattcggagcttcatctccccgcacgtaaaacaaagtgattcattagcgcatgattaattaagtattagctaaataaacttgaaaacaaattaatatattttttaaaattaattttttatataattcttttaaaatctaccgtttagaatatggatagcgtatatgtgaaaaatgatggagtagaaattggtaagaggtgtgtatataaactaattcgaatataaaatttgtggtcaaaatcgcatctcaagctcagttaatgaaagtcaaacgtcgaagtctttggtgactgaatggatcactttaattggagaactattaaagaactgcattgtagcctgtaggtatcgaagcagttcgcagtttcagaaagaagcaccttttgttgcaatgtttagtattctcaatcggtttataaactggttaggtaagaagcatggatggctgaatcgtcggcgttagttagctcaatcgattggtcaagatagagaaagaacatcgacaatggatgtgctgacatttgaagaaacagcccggccaagaaaatggatacagatttacagtaacagataaagaaagtgttcgaaattttagcaaaaattgggttatctgaattgaacagctcagctgtctttctactaggagtatgcctcccaacaggctgaaggggcctcaacctttctcgctgtcttctttatagccaatacatgatcggattgaactgagtttattagaattatttgaggcccaaacaaatgaattacatattaaaaagattttttttaaaaaaatatcgtttaggagattgaaaaacatacacacgataatcaccaaatccataaagagagaaaaaaaagtaggcatctccatctccaatatttatggccttaataacattaaggtaggtctcactatttcttggttattgccacaatgcttaaaacaagagtgtatactaagatggacctcacaagtgtaaagtttattacctttatcaaccatcttagttttacatattactttattgcttgtggttgagccataagtttggagttatcctttgcatttagaggttgtttggttacctcctaaactttgccaaacattgttacacctcatgttaggcaagtttgatcaagttagctcattgtttggttcatgaccacacttgtgataagattctctttcatttctcatggtcccatatgtcatcaactcaaaagtgtatggcacacttttcttttgctagctaaagtgtggtttacattttgttggtcataacttagctaaagtgtggtacaaaagtattataaatttgtaccggttaaaaactacaggagaaacgatctttaataccggttgtagcaaccgatccagtaaatcgagactaaatatctcgatctcaagatgcatactaagacaaaaaaaagtgagatgtggaattcgaactcaagagctctcacctcagccctgctttctttttaaactaaccctggaggcatctttagtatcggttggtaacaccaaccgagaataaagatgtttctaggtacttcgactttaactagtactaaaacatctttggtactagttcttaatctagtcgagatatttatgttttgggacttaggataaaaaatcgtttctcatatattaaagaatgaaaatgttaatatagcatccaaacaaccatttagtgtattgtggcttacctccataatgtatatggtcaccataaggtctttttataatcactttttggctgctcatatagtatatgtaaggttgtcagtccagtttttggttttcttctttcggggaaccactatatttctgtatggccattttagctgatcgtatgctttcttttatactagaattaactaggataaaaatagtttgataccctgattgggatttgacactagagtagtactactattttttatataaaataaaaatcaagggtgcatcatacattcaccaattcacgtcacagacgaaagaatgcactggccctctttaccagcaaaccaaactcatcagtgcctaccgatcgtagcaagtgaaaacaatgaaggcaactagtacaattatttcttttccaaacacttttttgccatcaacctctattgtcatatactacctccgtttttcaatagatgacgccgttgactttttatcacacgtttgaccattcgtcttatcaaaaatcttacgtaattataa

SEQ ID NO: 53581 - DNA, 1706 bp, Oryza sativa
gatcttggcccatcccaaaacctaaaatacatactcccgccgtcccaaaatataaacatttttttagtatagtgataaatcaattatttctaactttgaccattagtaacaaaaaaaataaaaaaaaagatcaataatgtaaaattgatgttactagatttatcattaaacaaattatcataatatgcaatactttttattttaaaacatcttactttacagatattgttggttaaagtagcatctcagaaaccgtgtcagggtctaaaaatgcttatattttgggacggagggagtagtattttgctagttttcataattgaatagttattattattattctaaaataaaaatgtataaatattggtatttaatttattttttggacttgtttaggctttggaataggtttttgggtgaaaatataggccaaagctagcctatcaggctccgtttggctaataggttatacccattgggaaatggatataatatcctggtaggatgtggtggtagtttagagcaagtataataacaaaatttcagtcagctataagcctgtacagctcagcttcgtctgacgtggtggagagaggcaagatgagagagaggggatcgggcgcttatgcaatcgccagccttggcacaggcgcctagaaaacttagccgattatcttcatcagccatttactctcatgcatgcattggatgatggtgggccctcctccatataataaaatgaatgattagtattggagtatgtgttatgcagctggttgatacaaagatctatctatttgattgcttttagatgacgtgtcattggcttatagctaactgatgactctcttattaaacttgctcttatatgaagggaaattttatcccatgtttggttggatggattggaaaaggaagtttctagaagaatgaccaaaatgccccttcaaactatgctaaatgagtaaacaaacaacacagctattatctataagttcaaatggtgagggtaattcagtaatttttcctagcagtcaatccaccctcaatcaagcaggattctatatcccactcccatccacacccaaacggtggaaatatgaaaaatggaaataacatccatttcccacactcctcatcccatttgccaaacagagcctcaaatgcaggctgcccataaacaggtctaggcaatggtatttctgtaaacattatatttagctaccgctctttacggcatgagctcatctctatctacatcaatcaatgcacttcctctataaaaatatctcttgaaataaatctagaaaaaaaatcagcatataatcttttacaactaaatttgtcccggcatttactaaacgccatatttacaccaaccaacacacaactcaagtgacacttgtaccactacctaagtgacgctggattccacccttgaatccacatatcaacagatcatattctcccatctaaatccctctttgatttaagtttactaggattctctttccttccacgagcgcaggggtggtgatggcaaacctcaacacaaaacacagcacaactattaagaacgtttacaacttaggtgatccgtagttgacaaggaggtagatgttcttgctaaaacgacatggggtaacttcgtcttgccgtgctgaaaacacaggaggcatgaggaggggtactaaaaaacattcgcc

SEQ ID NO: 53582 - DNA, 2623 bp, Oryza sativa
aaccgtaaaaccagataccgagggtcccttaactatacaaaaccggtcagaataggtctcttggcggttttgatcccggttttgtcctacgtagctgctgagtcagcgtgggacccacgtgggccccacatgtcatcgtgccacgtcagcatactctctcttttcccctcttctcatctctctcactctatcttctcaggacggagggggaaggagcggaggccaccagcaagggcggcgtaggccaccggcgaagaagcagccgaggccatcggcgagggcggcgtaggcggaggtgaggctgcgcatggcgtcgggggcctcctagtagaggaactcgaggagggcgatgaggcagaagccctcggcgagaccgttggacaccgattgccggtgccgcacggcctctcactgccgtcctcccacgccgccaccgtcgccgggggaggagctgagcgcgaccgtcgggggaggagcagggtgcggccatcgggggcagagtagtgcgcagccggcgacatggagcttggcgcgggcggcatggttaccaggagaggagctgggtggcggcgggtgagggtgggcgcgggaggccgtcgccgcggttctcgccctctcccctgccccaccgtcttagggtcagagaggcccaggaggtgggagaaagaggaggacgtcggcgtcggcgggggcagcgccgttggagaaggggagggtgtcgccgcgcaggcgagctcgagggtgttgatggcgatgtcgtggccgtggttgagcttgatggcaccgtcgatggagccgccggcgtaggtctggcagaagctgtagaggccgtcgaagacgggctagtcctcgccgacattgaagcgcttgagcgcccgaatctggtcctactgggtctccggcacacccgccgcttcgccccgttgacgccggtcccgcctcgccccaccggcctcctcacatacactcgccttcctgccaccgtcgcagtgcccgggtctacgccagccatggcgaactgggcagagacggcgcggccgtcgacgacgacgacgtcgtcgcggcccacctcacggagcacgtggcgggcggtggcgcgggacccgcgccccactggcctcctccccctaacgtcggctagtctacgccaccctcgccagtggcctccgctccttcccccgccgccctgagaagagagagtgagagagatgagaagaggggaaaatagagagtaggctgatgtggcacgatgacatgtggggcccacgtgggtcccacgctgactcagcagctacgtaggacaaaaccgggatcaaaaccgccaagagacctattctgaccggttttgtatagttaagggaccctcggtatctggttttacggttcgaggacgttcttgtatcccgatttcaagttgagggaccttcggtgtacgttttcctttaagctacgatgggaggccggaggcccagttaattaagcacaacttggcatgggccagggcccgtttagcccaacacagaacatggataaatacaccacccattcgccaaagagcaaggtaggcaaggcacgcgagccctagccgccagccgactcgaccagcgcccggaggcggagcacccgccgccgccgccctcgccatcgtcggcttcacccctcatcggcaacctagtgcaggtgagctccatctccacccctcctcatctcctctcctccccacaccatctttcctagtctccctctgttgcttcctcggatctgcttcgctctcgtgctctacgcctcacacgacgcgctcttcctcgtcgccaccaactttgttgctgcgcgcgcgtacgtcggtgcgctgtgcgcgttctacttagtttgccttgtgatgctgctcttagtcgggttagtgcttcgtgctgtgctcgctggtttggcgcttcagatctgtgtgctgtttgctctcggagacgctagatccatagtcgtcgacttgcaaatgctgcgagctaatatgattcttgttggatttcttcgctcctagcgtgagaaatccgaagaattgggagaacacggtctttttttttgtcccaataaattggttggattgttctagtatatattttttattatttttttctcccaaattgttggaatggcttctccctctttcccaactggttggattccaaattgttggaatggcttctccctctttcccaactggttggattgaggtgaagcgtgcttactgtattttttccacctggatttggtactatctttactctctgaactagttgggaacggatattccaatctcctgtctcttcgtgtgacttctttctgcttccacgtggggttctggaatcttcaattcactgtagtataagttcatatcttatttattctcatagactatgatttggtcgacttcgctcatatattgccgtgtagtagagggtttttacaattattcacgttcttggattgctgagatatcatggttagttgtgctgtttgaactggttatggccctcccgctgtgaattgccaaggtgtctgaatgttggtgattttgtggatagttcacgtgttggacaaagaatgcattataggagtgacaaatatg

SEQ ID NO: 53583 - DNA, 1153 bp, Oryza sativa
gtcaagcgcttcatcgcccgcaagatgaacgaagtcgacgaggagtccaagcaggtctcctaccgcgtcatcagggacgacaacggcaacgtcaagctcgactgtcccgccattggcaagcagttcgccgccgaggagatctccgcccaggtataggggtggcttacgctttgtgattgtttaccatgtgttggaattgatcatcaattgaggggttctgacggctagaatctagaaagaatgctttggaagatggaatcctgttgcgttgcttagatgtggccagttttgatttctagcttataggatcgtgacggggatcatagagtcaagctctatggaataatgggttaatggttaattgcttaatctcgccttgacttctcttgatgccaacaatagcacagcttccataacagtgtttttggtgtctcacaaatagaatcccatcctgtatgctttgtttagcatattcttcacaaaactatagaattcttttttttttttttaaaacggcacttcacaaaagggaatgcaggtagtaggatatttgtactgaacagcccttgctctttgtatatatctaaatatgtgcacgtggatttttgatgcagtctatatatatatatggactgagttagacatcttatatgctttgagcttgacagcttatagtgcaaatcctgtgggttcccttcatgtttgctttgttttcatcagtacaatatttcctactggtgttctttcatcaattactaggcctagatgggtaattttggtggagtcgaatgtgccattttcttttggggatctgttggcaaaaactgaaatagcatgtgcatgcaaatgttttatgtatgcctgcaaaataagttttatggttcaaattgtttttaatccgagtgttgatcattttatgttctccaggtgcttagaaagctggtggatgatgcatcaaagttcttgaacgataaagtcacaaaggcagtgatcacagtcccagcatatttcaatgactcacaaaggacagcaacaaaagatgctggccggattgctgggttggaagttctccgcatcataaacgagcctactgcagcatctttggcatatgggtttgaaaagaagaacaatgagaccattcttgtttttgacc

SEQ ID NO: 53584 - DNA, 1037 bp, Oryza sativa
accctgcaggtcgaacggcttcagcaccggaaacaagtccgagacgttgggcgttccgaggagctcggtgacctctgcgacgagacccctgaactcgctccccaccgccgacctctcgctctcgcttccgatcgttcccccccacatggtgcccgtgatcacattcatggtgttcaggaacatctgcgcgccgacgtccaccggctcgccgggcttggagtggaggtaccggagggtggacctgaactcgcgccgacggaggccgtgcacgctggcgagccccgcggggctcatcatctcctggacgcagacgcggcggagcaggcgccacataggcccgagcgggttgcccacgatattctgtgcgccgccgaaggagacggcgtcgccggcatccagcatgacccggttggcgaagacggagtcctggtcgcggagcacctcgcgggccagctgggcggaattgacgacgatgtccaccttggaaccgaggcggatggagaggatgggcccgtgcttcgcggcgaggctagcgaagtaggtgtgcaagtttgggtcgatgaatgggaggctgccaacgagaggaagccccaccggtcctggtggcaaacggcggctgcgccgccgggtgacggcgaggtacagcaccgttggcacaagcaatgcagcgtagagaagatttgctgttgccatgggctgcatgactatggagatgcatcactgtgagaagtagtagcagtatcttatcaaataccacgctctacccaagcgatctatggatgccactgtcagctagcttcaggccggatttgaaaggtatcagtcgatgagagcaattgagattgttgttttgtcgacaacgtaaaaaaaaatcattctcacccttccattcctcaatctattatagatgtggatttttatccctacagggaacctcccctcattgtttacatgtcatctgaatagttattaaaaaaattaaaaaaaattaacaatatagattaataagaaatatatcactccataaatatgtatga

SEQ ID NO: 53585 - DNA, 804 bp, Oryza sativa
ccaagcctacttgtcggtctcccgagccgtagccactatcacgcgtcaccgccatgaggtccgcaatgcgcctgcaccacccacaccaccatgcctgctcccgtgccgaaccgcctctttggcacttggctcagtgacgatgaaagcaaagagcaaatttaattagcctgaggataaatttctctactcggataaaatctaacgtcatttactcaaaatgagacggaaatgctacttatcagaaggaaaatcggtgacctgtgcttttaacttaagaggaaaaaaaacgtgtgctaatttttttacccttttttcagatcgaattttctctcaaatttttagtcaaagctatagcacgtgccacgtggaaagaggtgatacaatattttatttttgcaggtctcatcggatgaaaaaaatagataatggtggacttaggtgatatgacttatctatagctagcagttatagatagttcaatttgtacatgctataagacaagatttgattcattttttctttttttaaaaaaagaacagagcaactaggtagcgcctcaaataagacaacagtatggtcgcagctgctcgaaaaaacagaatgcatcactctggtatattccttttaagtttgagggaatctggccagccggccatgcatatagaacccacttaggctgtgttttccctttaaacttctaacttttccatcacatcaaatgtatggacacatatatgaagcattaaatgtggatgaaaaaaaccaattacacaatttgcatgtaaattgcgagacggatctttt

SEQ ID NO: 53586 - DNA, 1054 bp, Oryza sativa
  unsure (1)..(1054): unsure at all n locations
atgaaatgcagcagcatcaacattatgcttgaaaatcctaattgtacctcactattattaaagaagtacaattcatatattgttttggatctgtaatttgatgcttcgagtaacataaaccaatctttgtagatgacgacggatggcactccgtggcattccaggtggtacaaatatccaatctaacgggggatcattggcaacaaccccctcattatttgtcacggtgttgcaagaaattggacggctgtgcgaatccagggtatttggatctttaagattatatttgttttctgccattgcccttatgagctgagagtaatctcctgttctttcttcattaggtggagttcaggtctactgtaagcagtggaaaaaacatgcaattttctgttgaggttggcattttgaatttttacatattatacttcgtttccatgtggtcttggcaacagcttgggctgaaattctaattgagaaaaatatatatttagaatgttgagacacatttcctttggcgtctcaactctcaacttcagcatcagtccagtgcttttgctctgaagctgtttgcttgcgggtgcattaccagatttgtatagcaatgctgtgatatctctacttaatcatgtgatcctcatgttacctatacatatgatgttccaggttctatttagtaatgaaaaaatcgggatcggcattggaaaaacaagagatgaagcccaagtactagctgctgaaaaagctctccagaatttggaaagtgagtataatcctttacatcttgattattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53587 - DNA, 7194 bp, Oryza sativa
acataagcttcggctaaacctcgttaacaaatattgtgtgttcttgtgtcgttatctgacgtgtcttgggtgatcattgattgaagcgatcgagaaaattagtcgtcgttccgctatatcgactacttcctccgtttcataatgtaagccattttagcattgcccatatttatatagatgttaatgtgagcaatgctagaatgacttgcattataaaacggagggagtaacttttatatataaaaaaggtctctacgagctgcaaacatcctaattcaatcatttccatttgagttttcagatataccaacacaaagtgctttgctggctctgcagagctgaagccgacgacaagccactccgaacagttaaaaaaacattacggtaccttatgcatctgcattaaagttttaaataatataaataattatacgtgtgtctaaaagttcatagtgttatctattagaaaacggagtgttctaaagttaagagcgttatctcttataaaacggaggaatacaactttttcaggttcaggcagtgtccaacatggcgtgtccaacatggtagtagcgccattccacacgcctgtatataaccgcgcccattgctccccaggacaacatggaatgcatctttctaccagaagatagagctttctctgccacgaaatattcagctttactggataccgtctacagccgtctccattcatcgtttcctttccatgatggtgtgacagaattggcttttgtatcgtgttcgttcgtccagtcattttcgtgtgctaagcttcgcaggtcacagacatgcctcgtcaaatttggttttagtcatagacatcacgtaaaatcgaccaactgctcggcaggccaacagtaatgatctcatgatcacccagctgaaactaatcttggcgtgcaatgcattcgcaacaacactttacgccagctaaagagcgagcgagcactgaactgaaggttccgatttccatatcaatcctgagctgatcaaagtgcttgaaaaaagattcttagtgcttgccattgtggatcccgactagattagaagatgcgaggccgaggattatggcgggggaaacacactgcaaagaataaataatcactggagttctagttgtcgtagtggtggacagagacagattaatccagcggcaaacgcgacgactccacgttgccgccgtgccaatgataatccgagaaatcgagctgcacggcggaacaaaggagagcgacgtaaaccggattaatccaaacggcttcgaccatctgaggggatcgagtgaacaatgttaaacatgtgatatgtatttgtgtgatgcacacggcatggttagatggatagatatgattagataaggctagattgagtttgttgtaacagaataggagcatatctatccatccacctgcgccgatctctgtaacccacagcggtggttattatcgctaatataagattaacaaaggtgcggcccgagagggttgaacgcttctgaacctctgatgtttgatatggtatcagagcctttccactaaacaaatcccgatccaatctatggccagctcgtcgtccaagatggcagccactaatcctttcggaggaaacacaatctcagagaaattagccaaaaacaactatgcgctatggaaagcgcaagtcctggcgtcggtgagaggagctcgtcttgaagggcatctcactggcaccacagcagcgccggccatcaccatctccgtgccaggcgagaaggaaggcgacaaggccaccagggcggctaatcccgcctacgatgaatgggtggctacggatcagcagatcctagggcttctactgagcaccctgtccaaagatgttctggcgcaggtggccacctgcggcactgcagctgccgcctggagcatgctggaggagatgtatacctccatgacaagggcacgcttcatcaacactcggatcgctctctccaacaccaaaaagggcgatctctccatcacagaatatgtcgccaagatgagagcacttggtgatgacatgacggcggctggcaaggtcgtcgacgacgaagatctcatctcctacatcattgccggcctcgacgacacgtatgaaccggtgatctcctcaatcgtcggcaaatctgagccgatgtccttcggggaggctttctctcaactgctcagctttgagcagcgcaacaatctccgtcacggcggcgagtcgtcagcaaacctggcgaatcgagggcgcggcaccaccggcggcaacggaggccaacgcggacgcggtgggaacaaccgtggacgcggcggcaatggaggcaacaacagcgcaaaccgcggcaagggtggtcgcgggaatggcggcttcaatggaggacgtcaaggaggtggcgtcgacactaggcccaagtgccagctatgttacaagcgaggacatacggtaatcaactgttggtatcgttatgatgaggattttgttccagatgagaagtatgcaggttctgcagccacctcctatggtatcgataccaactggtatgtggatactggggcaactgatcacgtgacaggagagttggagaagctcatcgttcgtgatcgctacaaaggacatgatcaagtgcataccgctagcggtgcaggtatggaaattagccatattggtcactctattgttaaaacccccagtcgtgatattcatttacgcaatatttaacatgttcctaaggttaccaaaaatttagttttgctcaacgtcttgtttctgataattctgcctttaaggaactatattctaaatatttccatcttaaggatctagccacgaagaaacttctgcttagggggccctgccgtggtcgtctctatgctcttccatctacaccgccacatgcacactcaaccaaagaagtttatggagtctccaagccatcttttgaaaggtggcacagtcgtctcggtcatccctcctctccaattgtagagaaggtcattagcaaaaataatctcccatgtttagttgagtttaataaacagtctgtgtgtgatgcttgtcaaaaggcaaagagtcatcaattgccttattctatatcatctagtatatctagtcatcctttggaacttatttattctgatgtttggggtcctgcccccacttctgttggaggcaaacagtattatgtgagttttattgatgatttcagcaagtttacttggatttatttaattaagtttaaatctgaagttatccaaaagttccatgagtttcaggctcttgttgaacgattgtttaacagaaaaatcctagcgatgcaatctgactggggaggagaatatgagaaacttaattccttctttaccaaaataggtattactcatcatgtgtcttgtcctcacacacaccagcaaaatggctcagctgaaagaaaacataggcatattgtagaaatgggtcttgctcttcttgcttactcatctatgccattaaagttttgggatgaggcttttacttctgctgtttatctcattaatcgtactcctagcagactcttgaaatatgcaacgcctttggaacgtctgtttaaacaaactcctgactataatattctttgtgtatttgggtgtgcatgttggcctcatctccgaccatataatgctcgcaaattacaattccgttccaaacaatgtacctttctaggttacagtccccttcataaggggttcaaatgtctagatccttccaccggtcgcgtttacatatcccgtgatgtaattttttatgagaatgtttttccctttgcctcacttcatcccaatgccggtgcaaaattgcgttctgaaattttattattgccatcccatcttgatattcctattattcctggggtgcaacaaatgagtaccactgtggctaatgttcctactaatcctgctaatcaaatttctggagatgaattatcgctacaggaaaatttggcagcaaataatgcagctccagatggtgcggacgcagccacagctgccacgaaagatccagcggctgactcccctcacacctctgacgcagcgtcttcgagcgtcctccagcgtcgtgtggaggccaccgtagagtcctcctgctctcctgatcggttgcatgtcgagctcacaccggcgcactcacccgtggccatgcaatctccagatgccacgtctcctactgcttcctctgactcacaggagccatccacgtctcttgatgcttctgttgcaggggaggtagatacacagcaacaacagcaccaggtaatatctagaccggctacgaggttgcaaagtggcattattcgtaaggaaaaagtttatactgatggtacagttaaatataggactacttttctcactgttactggagagccagaaaatttagatgacgctttaaaagataataattggaaaaaagctatggatgcagagtttatggctttacaaaataataagacctggcatttagttccacctcagaaaggtagaaatgttatagactgtaagtgggtgtataaaattaaaaggaaacaagatgggagtctagacagatataaagctcgcttagttgcaaaagggtttaagcaaagatatggcatagattatgaagatacttttagtcctgttgttaaagctgctacaatcaggattattctttccattgctgtctctaaaggatggtgtatgagacagttagatgttcagaatgcttttcttcatggagttctcgaagaagaagtgtatatgaaacaaccaccaggttatgaggacagttctttgccagggtatgtgtgcaagcttgataaagctttatatggcttaaagcaggcccctagagcttggtactctaggcttagcaagaagttatatgatatgggattccaagggtccaaggctgatacttctttgttcttttataacaaaggagatttgattatatttgtactcatttatgttgatgatattattgtcaccagttctagacaggaagctgttccagccttgcttcaggatttacaaaaggagtttgctctgaaggatcttggagatcttcattactttcttggtattgaggtaactaaagtgtctggtggtatagttcttactcaagataaatatgtcaatgatttgttgagaagagtaaatatgtttgactgcaaaccggttagtacacccctgtctacaagtgagaaattgtctataaatgaaggagatcctttaggaccaaatgatgcaacacattatagcagtgtagttggtgctttacagtatctaacattgactaggcctgatattgcttttcctgtaaataaggtttgtcaatttttacatgctccaactacacaccattgggcagctgttaagagaattttaagatatttgaagcaatgtactagacttggacttaagttaagcaagtctagatctatgttagtaagtgcttgttcagatgcagattgggctggttccctagatgacaggagatctacaggaggttttgcagtattcttaggagataatcttgtgtcatggagtgcacggaaacaagctactgtttctagatctagtacagagtcagaatataaagctttggctaatgctacagcagagattatgtgggtacagactttattggcagaattgcaagttgagagtccatctatggcaaagttgtggtgtgataatttaggagctaagtatctttctgctaatcctgtgtttcatgccagaactaaacacatagaggttgattatcattttgttcgagaaagagtttcaaggaaattgttagaaattgattttgtgcctacaggagatcaagttgcagatggttttacaaaggctttgtcagttcgacagttggagaattttaagtacaatcttaacttaggaaagttatgattgagggagggtgttaaacatgtgatatgtatttgtgtgatgcacacggcatggttagatggatagatatgattagataaggctagattgagtttgttgtaatagaataggagcatatctatccatccacctgcgccgatctctgtaacctacagcggtggttattatcgctaatataagattaacaaaggtacggcctgagagggttgaacgcttctgaacctctgatgtttgataaacaagacaagaccaagaccaggacggctgggggcggcaacatcagggcgtggattaaccgaggcggattggttccggccaaagttgaccccaagtctaccggcctaggctggctgagttggaaagaattcaatgaatcgattgcgacgagtttaaattctactatacagacacgtaaaacacaacgaaatttctctgtttttgtcatagcttacacgccgaaaacatacgctactactagtagtactagtttttttgaacgtgtagctggcccacgtaaaacactggatgcaggttgttaatactccgaggaggccgtataacaatcataaaaagcgtcatgtggcgcgaggtacaaagttcattgcgtttctgcatgaatcacacacatcgaacgctacgctggacaccacgtggccacgccaagcttagcaactcataccgacggccccacctgtcatgcgtacaggcttgttgtgggacccacgcccgcagccctgttccctgcaaagaatcattatatactccctccaatgcacgaccccaaccagagcacattggatcccccgttcccccgaacccaaggtccaaccaaccgcaaactgcaaacatatcacgctccctattttagtaccacctcgcgaaccggaacgcatcgcgtccgataaaaaactcgtcgccccacaccgcgcggcactcggagctcagctcgcacggcacggaacggaacacaaccctccctgtgtctctctccctgatgcgccgccccccatgcggcggccccgacccacttagcccgcggcggcggatgctgcggcggcggcggcggcgatgaagcggccgctgcggcgcccgttcgcggtgctcctcttcgtcgtgctgtgcgccgcggcctcgttcccctccgtgttgcgcaggtcggtgggcccggctcccgtgctcgcgccgctgccgccgcttgatcccgcgcgcttaaacgccacgctcctccgccttgccgcggccgatc

SEQ ID NO: 53588 - DNA, 1426 bp, Oryza sativa
  unsure (1)..(1426): unsure at all n locations
ggcgcggcctccacccggatcacgaccacgaccccctcctccacccgctcccgcgccaggagctccacctcgacccatccctccgccgcgcgctccgctcctggcaccgcctccgccggcacgaccccggcgtcctccgcaatctcccttccctcctctccctccccggccgcatcccctcctgcgccgtcgtgggcaacagcggcatcctcctcggcgccagccacggcgccctcatcgactcccacgccgccgtcttccgcctcaacaacgcccgcatctccggcttcgccgccaacgtcggcgccaagaccaacctctccttcatcaacagcaacgtcctccatctctgcgcccgccgtcccaactgcttctgccacccctacggcgacggcgtccccatcctgctctacatctgccaggccgcgcacttcctcgacgtcgcctcctgcaacgcctcctcccgctccctccacgccgcatccatctccgtcaccgatccacgcctcgacgtcctctgcgcgcgcatcgtcaagtactactcgctccgccgcttcgtcgccgagacggggcgcgcggccgaggagtggagcagcacgcgcgacgcggccatgttccactactcgtcggggatgcaggccatcatggtcgccgtgggagtgtgcgacagggtgagcgtgttcgggttcgggaaggcggccgacgcgaagcaccattaccacagcaaccagaaggcggagctggacctccacgactacaaggcggagtacgccttctaccgcgacctcgccgaccggccggaggtagtccccttcctcaacgacgccggtatcgccgtcccgcccgtcgtgttctaccattagagcgcgtgcgcgcaaggtgctcgacgttatgccacttttttccggtggaggattgtgttgtattagtggctcagtgtaaaatgttgcttcgtaaggtgggttattttttgtgattagattgatagacgaattgaaatagtagcgaaattttgatatgatggtgggattggaggtgtgtactaagcattaggatccctccattagcatacgaggacgatttcttccgcttttggcactgtaactgtaatttagactgatctttcttcgtaatttcatgaagaatcaattgtacatcttctatacagccttgctgcaactttgctctccatgtttcccaaatggcaaatacaactttagctttgcattgtgtcatctgtgtaccttccaaattccaatttgactgctcatttcacctcggaaaataacttgtgcaagtccttccctgccaatgcacttcttctacctctctaatccgattgctaaccgaaggctcgnnnnnnnnnnnnnnnnnnnnnnnnnnnnnnnnnnnnnnnnnnnnnnnnnnnnnnnnnnnnnnnnnnnnn

SEQ ID NO: 53589 - DNA, 715 bp, Oryza sativa
catgatcattatatactagtctattacaaactgataaagaaactagtgatgattttgctagctaagtgatagaactgtggacttaattttgatacaaggacaaatccaattgtaagccaaagaaggatcaatttgatacacctacatttcttctaaaatgaataacacaaagtagatggttataaataattgaaatcaagctacatgacagcatttatattatgctgtataacagcgcttaccatagaaataggcatcattagctgatttgatctaggtgaaaaaaaaaatcaagtccctaaaaatcaaagcaaagcagaaacgaagatcagcactcaccagcccattcaacctcttccctacttcagctccactcataccctcaggtataggggcaacatccttattgtttggtgcaaaattagtgtcctggaacaaaattagcagttggataaccatttagaaaataaacacacacaaaataacaacgattcaataatgttacctcacagactaagtagtcaccaacatcaggagcatatggaagatctagcaactcattttcatacattagttcaaacacttttctcaatagattttcatcgaactctctgcaatgcattgatgaacgcaaagaataacattacaacagtaagcatgatatcatcagaatgcacatacggtatcttatattttttaccaacctgaagaaacc

SEQ ID NO: 53590 - DNA, 8074 bp, Oryza sativa
aactaaacttaggaggagacgtgacatctttacaatgaatctggacaaccctttatccagattcgttctactagaaaacattacatacttgtatagtttaagtttttttttaaggatgggagggagtatggttgctttttctttttttttttaggggggcggggtttgatcgggctgtcaatctgtcaccacctactatggcgcaacagcagttgagaagttgagaattgttcagatgaagcgagtatcacgagtatcggggtttgtgatgcttactacttatataatataaaactgtatttttgggtagcagcagataataaactctttagaaaaacaacacctgaattaattattgcagctgaagatgacagcatatctgagccaactcgctgattaattagaactcaggatccaaccaagggaaaaggattattaatccagaatacatgaatgcaatcgcagaaactgccatgcagtcactcattggcaagtggcaactgggcatatcattgtatatttgaagtttcatatgataagtttttttttaaaaaaaggggaaaacagtaatagattgtgccttttcattaaatatagggagaatagctaatttagtccctaaagtttctctgtaggatcagtttagtccttaaccttttaaatggtccaaagaaatccttaaactttgtcataaggtctagaatagtccttgggtcccccaaaatcattatataaatatgccatgtcatcattgatgcaaaatctatgatgaattggcccatttacctttatgtatatcatagaaaaataaatataagggtgaattagacataaccatgggaaaaaatacttatcctttttttcacccttttgagggatatttttgctcttacaatttactttttggtttttatttttctatgatatatggaagggtaaattggacaaatcatatagattttgcatggaaatgtgacatggcatatctatgtggcgattttggtaagatcaaggactatgtcaacccacgtgacaaattaaaggatttgtttagacagtatgaaagattaaagactaaaatgtcccaggagcgaaattttaggaaccatattagctattctcccttaaatatagcagaagaaaaaacagcacaagtttctatgataagttgatagcgctgtagttgctgacttcgtaagcttgcatgctcctatggtttccacacttcagcaaactagatggctgctaaataaattagtaaactttttgatccgttccaggctccaggctagctagatccacgtactttgtggcagcaaagacttttttgcgtaggtcgatcgaacacttgtcgtgtatgcatgaacgccatcggttctaattctaaactaacaccaactaatcgatcacgggcttctagctatagataattaattagtactaatatggagtacatgagtaatgtaatcctaacaggaacacgcctctctggtgcctgaaacttcacgctgctcgccactaatcgagtactctatttggtcagaagagaaataaaatggtatagcaacaacacatattttgcagcatcgtctttctatgacgtctttcacagtaacttactctgaaatatgaatcaaacgacctcgagtccttgacaagtccaagagggagtaggcgaaagaatgtgacgccatttctgttcttccgcataaatgggcaaagctcgcgttatttttattgtaaaagaggaaagagatattgctgtttgtctaaagttggtgatccagagataagaaaagttctggaaggctttggatttgcagcagaaagtgcgtccaccaccattagtggggactggtaaaacactgcattgatccccttgactacttggctactgcatccagcagtgaacatttcaaaggataatcatgtggatagatgtgtcggagtacggaagcgagaaattaatctcagtttcggcgactctcttcattaaacttctgcgtgctggctgcaattttcttcacatggaatgcgaatttcttcatatagagtaggagtaggcatactgctactgtgctagcgaggaacggtctttttttcctagtccagtccatcaatgacatggggtgtgtccgtgtgtgtcggtatgccgtgaaatgcagtatgcaagcatgttcaggagacaagaggtacatgatctccatgttctcaatcaggtctgtccctgttcactatgagacattacggcgaaaccgcgaaagggcgaaagataaattaacccttgatggttcatattgtaatacacgagatctacctttcaattaccacgtgactttgtgtgtcctgaaatcgaccagacatagcttggcatagagattgcataggtcatccacatcttaaaagcttggattcaacattttcaactagaatagtagtgtggacaaatatatatgtgggcctttagttctgaaaaaaagggcctatccgggcctgccatttggcccatatcccttgttatcatctccaactgggcccatgacatagttgtgacaaggaaaaatgtgggcctttagttcagaaaaggcgggctttcgctttctgcaagaggcccgtttgaaatgttgaaatttcttactaagtcatttttttattcaatgaaattataaattccaatctttagtttgacagctctcagccgtatcttatttttacctaagttcagcattaagcaaaccttacagaagctgaaactggaaagtctaaacacattaaaagccaatattgttttgatgaaataattataataacaaactctaatgctaaatctctatctatgttcccgagaatttgcatagggtaagtccattcgaaacgttggtttttttttacatattttaatctattttatctgaaatggtttagggctggtttaaaatggaatattgaccaaaatactgtagtggattatctacgcggttatagatataaatctaatattttgataaataaacataaaaataacttaatataggcgtaacaggccctcacgaaaaagaaacctattctgatttcaccgcgtagccaagcaagcatcaggctctcttagccagtcttagggcaagtataatagtaggctataagctggctaaaagttaaggtggagaagagaagagagaagaagtgggctgtaaacttacagtcggcttggaaacaagatctaagaaactctgtgagagagacaagtggaccctatattaattgtaaagagctaactattatatgggtagactgagagaatgctacaaagaaccttatagccaacagatcggttgtattattagccttgctcttagaatagatacaatagcaggctataagctagctataaacatattttaaagagataaaagaatagagagaagagctagctgcaatacggactccaagacataatgtatgtatgatatgtagtatcaggtattactagtatatagtaaccaaatattgtataaattagctattatatgactatagataatttagagttagtaattggctatactgttaaacttctcttagcatacagcagtagcacccgagctaactgaaaaacatcagcccctcagccgtcatcctatctcaccaaaaatttcaaaacacacgccgcacaatcgtgacaacgccataacgtccactggcgccgcgggccccacactgcaaaatctccgcctccccttccccacgcatggattagtacgcgtccagctcactcactgcttgcttccgccaccccgcaccgcttccccctcccctcctaatcaccaccaccgctcaccggcggtgacctccccccctcctcccccgcctgcgccatgtcatcctcctccggcgcggctcgccgggcgcgccccgggccatggccccccgcaccgccgccacagccgcaggcgcagcccctctcctgggccaagcgcactggcttccagtcccgcgtctccggcgagtccgtcgccatcgtctccgcctccagctcggggcaggtatcgctgcctcgccccgccgaggcaccttccgatctggagtccggcccaccggccaggcccaaatccgccctcccgccccctcccgccggcgccgcgggcaatgcggaggcaaagccgcaaccgccgccgccgccgcctcctgggaggacgcggaggagggattcggatggcggaaagccgaatgggcaggcggccgcagcgccgcttcctcagctgctggaggaggaggacgacggtgcgccggagcggcccaagtacgagctccgtgacagccccggagtatgtaagtgctcaaaagaggaattaaatatcccacactgtcatgtgcgagcgcgctgatttacgaggttttacgatgtgttgcagttccaatagcggtatatggatttcagcattacattccatgctcggctcaatcatcctgatcccacttttgatggttcctgcaatgggcggttcacctgtgagtgtggcttcaatttagtagtagttctcacagcatgtttggttttgtaggtttagtacttaatatacgctgttggatgcttaggatgatatggcagcggtggtgtccacggtgttgcttgtctcagggatgaccacattgctgcacacattctgtgggacaaggctgcctcttgtgcagggaccatccttgtatatcttgcccctgcgcttgcaataatctactcccctgaattctttgggctcaatcacaatgtatgtttatatgtataaattttatttgtgttggcgtgatgcaatgccacatgttgtcatgtagggattgcctcatcattgctttagagcgtttgttgttgaacctaacacgttgtatttcattgcagaactttaagcacatcatgaagcacctgcagggagctatcataataggaggtgcattccaagtgctgttaggatatacaggcctaatgtcactatttctaaggtgtgcagctgttgctgtttattagatacaaatacattcatctttttctcctagttgtctgctatcatgtggcttgttgacatggcagtatatttctctatttaccatggccacatgattgggtttggtagtaagtcgatcagatttttatttggaatggtgcatactgagtcctaacacattcttaagaaaacaaatgatccaaaatttctactgtactacagagatacatctcgtgatgactgtgaacaactttctcttatctatgtggtgtttgttaacaatggtcacgatatgttaataaacaccgattatgatacaggtgttttactatggtctctattggtattttatagaatcaatccagtctgttcatactctctaatctaatggattgatctatttatactaccacctcaactacttgtagaatattttttttctactggtagtagatatcataaatcaatggttgatatcgcttctactggtgatgttagtagaagaccaccatagaggtattcaaataataaaggaaactttgttggatattactagttattatacatatttcctgcttctgagcatccctgttatgaattaatttctttgcataaaccgttgtttctcggacaataaacatacttttgcatgtcttataaactgatgaatccagatcaatgaaacattagtaagcctgcctctatttcttctgactgtaccatcaactgtatatttttgtgacaaatagtaatacatatgtatctccatcttcactgagcattttgtcattaactacctctgtttcaggttgataaatccagttgtcatctcaccaaccgtcgcagctgttggactttcgtttttcagttatgggttcactaaagtagggtcatgtatagagatgggcctattacaattattgattgttgttatgtttgcactagtgagtatgcagtaaaccaacttgttaaatgcattgtaatattttgtgcaaataatgtcttaagctgatgatctgtctatttctgtgacagtacctccgaaaagtaaagttatttggctaccgggtgtttttaatttatgcggtaagatttgggctaatagttatttgagctaatacctccatctatgctagtcattagtgtgattatgcaattctaattgctgaacttttggtgctgccttcttaggttcctcttgctctagggatcacatgggctatcgcttttgttctaacagcaactggagtttatagctacagaggttgtgatgcaaatattcctgcctcaaacaatgtatcagcctattgccggaagcatgtactgaggatgaaatcttgtcgcgtagacacttcacatgccttgcgatcttcaccttggttgagatttccatatccgttgcaatggggcactccaattttcagttggaaaatgggtcttgtgatgtgtgttgcatctgttattgcatcagtcgattcagtaagtttataattgctttgaacttagatgatgcttgtttttctttcttttggtttgtttacttttcataaatttggataaacaatctagtacttactgggaaatgatctacaaagcatattgttgctccccctgctaagcatcaacttaacataagctttcttctctgacaatattgttaaatgcctgaaattggatcactcagtaagtaggattctagaatcaaccattcattgctcttcactatccaatttatttttgtttcctgacaattcatttatgcattttggacttaaggttggttcctaccatgcatcttctttgtttgtggccacaagaccaccaacagctggggttgttagtaggggcattggtgttgaaggtgtctccacagtcttagctggcttgtggggtacaggagttggatctgcaacaataacagagaatgtacacacaattgcggttactaaaatgggcaatcgaagggcggttggatttggtgctattgtacttatactactctcttttgttggtaagcaactatttgcactttttcccctgtgttggaagagtagacatcatttaactgtgacagcattcaggttcttgctataacaattcttgtgtccccattgtaggaaaagttggtgccttcattgcttctattcctgaagttctagttgctgctcttctttgtttcatgtgggccatgctatgtgcccttggcttatccaatcttcggtatagcgccaagggaagctccaggaacagtattgtagttgggctagctttgtttttgtccctgtcagttccatcgtactttcaacagtacagattacagcctaattcaaactcatcagttccaacctacttccagccatacattgttgcatctcatggacctatacacactggatctagtggggtatgtattcatccgttcttttctaacactatgctgtttgcatactagagtttcaatggaaatacataaacaaaagactggtgatacacatgcagagtccatattataagggctccattatttattaaaaaaaaaaagttggccactggtacttttcattcccgttggcttggacaataacaaaaatttggtttctttcagtaacaatattgttgtggagtgttttatggaagtatcctgaacatttacataactatattgtacaactggagaaacagtagaaagaaacataaagaaaggaataaacaaattctgggaaaatagtcggaattagaaaattctcattaaatatagtcctttttactcctctgttttgatatgaaccctggaactttcatttttcatgtatatactatgcttcaactgaaattagtcaagctataaattcctagtggtaataaactttatcgagtagaagtgcttagggtgagttccataacttacatatggttccagcatagtttcctttttaacaaagaacacaattatttcactcttatataccgtgccatgatattttcaatcccattcacatgaatgatatattgctttctaatttactgcgtaggcacatttgcagtatataagaactggtctcattttatttgtgaag

SEQ ID NO: 53591 - DNA, 3050 bp, Oryza sativa
attgctctctaggttagttgtcttgtcctgatgcagatgctagatgcatcaagggcttcccacatttttttggactacctttgtcatcacttacagattttgctcttctcctggtactatttaattggtgttagggatatctatttgtacaggcggtaaatgatctgaaccaaacctgagctgtgcttaattgatctagttatcttactttcaacatttcctgtgtgtggatattttactttcaacttagctactagtgatagcgagtttcaccgtgccaggttttcctgctgaattatctcatcctcgcagtgctaaaggctggcatccatgtcaactgttaagcatgtaaagctgcctgtctgaagtacatgggcaaggaatcaaagagtctgtaatgttacggggctatttttccagttgccacctcccaactttggcataacccagcctgtacacattggatctttgctgacttgttggttatcatggctggctgacttgttggttatccccgtaaccacgtatatagcccagttctgagaccactcaggcactctagagggccttgtcgtggacactagaccctcttttctgaggggtcaaagccaatggacctcgccaccggcctgtaccgatgacgaggctgacaaggaccttcacatggaacggccgtgccgggcacggcggcacgggtggcttctcagcacgctccttccaaattccaatgctgttgcttgtctacggctagctgcgtgcacggctcgaatgtcgcgtgtacagcagttagcacgtactacatgaggtacggcaatgatgccggttgtcaccggatgcagcacaatatgcaaaacattatgatgaattcactgggataaaaatgtgtagcaagcttgattccgaagtcaagcaacactccgctatcatgactgctgggcatgccacataaacaaaggacaagaactggggcatgccagtataaattgctagccgcaggccatccagtggcgcaaggctattgcttctttgtgacctgcaaggctgcaagtttgcaaatgcacttcaacatactcccttcgtcccataatataagggatttgagtttttgtttatattgtttgactactcatcttatttaaaaaaaattatgcaaatataaaaaaacgaaaagttgtgcttaaaatactttggataataaagaagtaaaaaaaaataattccaattttttttaaaaagatgatggtcaaacagtgcaagcaaaaactcaaaatcccttatattatgggacggagggagtaccaattgtcaaaaagtggcgcacttcccatgtcttggtcaaattatctcccctagtaatcgaacgccttcttcacaaggatatgcagccatgagaaatactacttgtcaattatcagtgctgccttccgctagtaaaaaaagcaaagagaacaaattcatgcatgttacaagctacagcatccacttattagaaatagtgtaatcgcagccacgctgcatgaacaggtctgcatctgcaaggggccttcccttcctgaaatcttcagcaagtccgggaattccggagaggaaagaagctccccttattgtaaaatctgaacttggagtgctacacctaccagaagtaggcacagacagcagcccagaactgtgtggatcgtaacatggcctcgttgaaaagccatgatcatctcttatctctgacggagctaccgtgacacgatcagcagtgttgctcacgaaggcgttctgaggagcagctgcagttggtctcagattgagctctgaacctccatatttgttgcaagttgagaccatctcgtcctttggaaatgagtctgttggcaaccgaaacaagccggcaatgcagataggtatcttgatgtcatccactatctctctgtggtaatcatctaccggagccgggagagccaggatctcctgccggtgtgggcttgaactggtctgttcctctgtcagtgaaatggtagcgtcgtcattggcaggcaaattctccctgtcatggtaatcctctggtgcagggagagccagtatctcctgatcaggagattggcttgagctgcagagctcatctcttgcagaattgaactcgtcgtcgacgggggagtagccgtcgtcttctgaatgttcatggtcccctggtgcaggaagcgccagcgtcacctggctgggtggaactggcttgctcagcttctgactcagggaaatcctggcaagctgaagtgcctgaagaacacactctatgtccatgttgctcgttggctgttgatctggccctgcatcgacctggttgtcgccatggtcatggaagcgtgatgagctccaatcagagaccttgctgttcagggtggcatcactcattgacgggctcccatctgatggcgctttgatgtcacagtagcttgaacatccatccggattctcgtttccttgttcttgattcttccctgtcattgtgccggcgacattagagtttccttgagactgtgcatgacagtggccgtgaagctcctcgtgcgagtcacgttggtcggctgctgcttcttgtcctgatgtgtcttggggtgattcaggaagggaaccattcaacagaagtccagcagagcggttgttgctggcgctggggtgatttttaacgcctggttttgcctcttcgttgcaatgaaccgcttgatccgcgagcctagaatgctccttgctctgctcccaaccattttctatctggcacgccttattctctgcctcaacatgaacctggagctccaaagacaaaagtatgagtaaaatgtcaaattttgaaccaaaacaaccaggtttcactcatgatactaactaacctgtgggtagcactctgcagtgcattttgttattaaaaaaaagcattttgagagagcaaattatttatacttatcaagttggtggtacacatttttgtactgcatgtgcactaaatttggtagcatgtggaagtcaaggggaagttgactctctctgtggcgtagttcatggta

SEQ ID NO: 53592 - DNA, 2740 bp, Oryza sativa
  unsure (1)..(2740): unsure at all n locations
gggtgcttaccttggctgagctccgattctcgttgaactgattctcccactgcctctgagcttcttcctccgcctcatactggccgatcagctcggcctgcctctcgagcaccctttccatctcgccgtccttctcgtacctgatcacatactgaccaccagcaacctcgccgtccatgtccgcctggccgtgtcggtgcaatccgatccatcttgctgccccttctgactccaggcgatctcctcgacgtcgccgcgctgctcttccggcgccgtcgacttgccattgctgatgaccaaacccggggaatgtaaaaatccaacaaacaatggcgggggcggggtgccaccgttattggcggaacggactcaactggagcccttggcgcttgtcttgcgggaggactgccccatcccggacttgggcgacnggtcngaggagaagaggtaaangtagctcctccggtgcttctgcttgagctgcctcgccttgcgcgggctcacgctgcggcctttccacgacagcccgccgccgggctcggccgtcccggacagcgcgtcctccgccgcttcgcctgcgccggcggctgctcctccccgcgggagccggccgtgtcgccgtcgctcctcgcgtcgcgtgggtcgtcatcctcctcgccgtcgcggtcggagcccgagtcgagcacgtcggagaggttgccgccgaagccatgtgactccagaatacccagcacctccgtcgccgcccgctccgcctgccgcctctgcgccgtcaccgcctggacctgctcctccagctccgcaacctacaaccaagtgacccaacacacgtaatcaatggcgcgaacgacagcgagagtaggctgcccctgcgcgcggtggctggctgaccctcttggcgagctggtcggcgcgctccttggcggcgcgggagacggaccgctcggagagcagccgcgcgcggaggaagtcgacggtcatggccgtggagtccgccatgcatgccaccgcgcgcacgctcacgcgctccccgagccgagccgcgagtgacgttgctgcgtacgtatgccgctccgcgcactgtcacatgccggcggtgtggcttgaccggcgccgcgtattaaaaacggcttggtttcccgtgagccgcgcacggcgcacacgcagcgcgcgtcgtactcgcggccgcgggcgcacggcgcaccgacagcccaggacagggagtacgctacctacgcgcgacacaagcgccccgctgcagcacgagggccacgggctgacgagaccaccgcaacggtgtagttagctaggctgcgccgtccattttcaagggagaatggcgatgcctcacctacctgtatcgactgatctgcctcctgccctgtccggggtccagtggcatattgtcaatttggcatcttacaaaatcatgagagtttggatttatggtgtactgtgtacatgaactccagtagcacttgtttatgggggtaaattcgtcgaggacaagagtagtgaacgtggtacagctttgccatgttcgagcaacgcgacgaagccagcaaaactactcgtcttctcttgtgctactgcctactgctactggtgctgctccaaaaatggccgagatctcaggctgtccttgcttggaatctttctgcttggatcacgaacttctaccgcacggaaacatttgagtcttgcaacggtttcgataaggtcattcaaagcaaagtcagctcatcgtgcatagaacaatacgtcttcaaagaccatagcggcaattatagcatcgagtaacagatgtttccattaaaaaactttagaatacacatatgcagggtgttgaggccgatgatcaagcaatgaccatgcggcagattaatgcagaccgtaaccacaatctcaggtacttaaataacgtcatacccggtaggcgggtttacaaaacgttttcgtaaacgtttttagccgaaatttcgctcaagaaacattatgtctgcttagtttgacagattcaaacaagataatgacgatatctcaatcaccgctggcacagcctctgcatccacagtgaacacattctataaccttctcctctctgagatgcttggggacccggcagacgcatgtagttgcaaagttgtggtctcgtgtctgtatgcatcgaagacagcaaaggcgctcataacccggctgaaaacacacaaaaagaagcaatgatacatttgatataagaatgcctgacaaactcttgtgacaaaaaagcatcttctggatttgcatctaaaaagtgactgaaaactttgacagttgaattcgtcacgtacgtctcacaatattcttagggcaatttaggcccctcgttatcaatgttcagacaagtatataaagtagtaatatggaacacaagtattgcatccctcccaaatctgccaacttttatcagatgtccaggaaaaaaaatatcattgggtgttagaagtctatccatgatttgatttctggttacatcagctgctagtatgccaataaaaatacatagcggaaaatatataaacatcttttagtcaactgccttttctttttgctcccaaaatcttatttttcatggtgcacccatataagagaatatctagtccataaatccccacgtcactcatgctgcattatttcactatttcctacggttcattgcaagaaatccaataaggcactactcaactttgacatacagcta

SEQ ID NO: 53593 - DNA, 6246 bp, Oryza sativa
  unsure (1)..(6246): unsure at all n locations
aaacaggatttatgatgtgtcatgcaaactagatcagtatgtgatagcttaacccaatataattgatttactgaagaaatggtaggatgcggttagttaagtgttttatttttcatagtacaagtccaaaaagtatggttcaaggcttcaagcagttaagttacattctaagcatggggaaaaaatgtgagaaacttaacggtgtatccaggggtctatggcttcatctgaattatctttgtacacaagttaattaaagtcttaaagattatacaaggtggataaggcatcttactaaactagcacagagtataaggaatgatgggcatcttacagagcaaatcatgggtcgaatactaacctttttccactttgcaatcagattacggtctgcataaccctggtccaggcaaaactcatacaactcttttgatatctccttccttctgtaataaagatcatatatgtagcgacttctttgatgggaaatacggaaaattggccagagggcttcgcactttctcttcccatcatgtgtgtcattttcagctacatgagtagatgatattagtatccatataagagcagaagtatcaataaacatctgaaaggggagcatatgtcataccttccctcattttggcatccaactcacggatagttggttcaataagctcccatcctccaggatatttgacacggcttgtctttattttaggcatgttctgtcaatgaacgtcgagcggctaaagcttgcaaagaaaccctgaggacatagagtaggtgtaagattcacaatgcaatacatttgcacggtcaagctcttccatcgaactcaagagattataagaacataatacacactattacatagaatttagccccacattgaagccttacatcagatatgctatatattccttactataaaggaactgtgttgaacacaaatagcacaacttaaacaggtattttgcatcttcaggctaacagtcttgtcgaaccatgatttaaccctattttgcaagtacaaaatatgtgcacctcgaatcggtgaatggacggtctaatacctaaagaactaatcgacacgatgataaaaatcgtggaaaaggttccccaaaccctaggctactcggaagttttttttttgagggaatactcggaagaatttcgtcccaataaccacatacgcgagaatttcgtcccaaggaggagacgaattgaacggatccaataaacagcgaggtagaaactactaaagcatccagcgaatcatcttcagggaaaaaaaaagggaatcatggagcggaagacgaataataacctcttggcttgggcggccttgcagtcgccggatggaagctgtggcgcgcgggggaccggcgatccaaagggggcgcgcgtcgtccacgccgttggcctgcgctgcgctccgctccggtcgagcaaagacggccgaagaggagacgggcgggtttggagtttggaccggagctaccagctatatgtcgtgattctttttcccctccttttttttttttgagaggagctatgccggtttgacggttttctcctctggtagcagtagtatttgctacatcatgggcctcaagaatcaaaacgggacaccaactgtgctgaaatccaattcggcaaacaaggttggtttggtttgtagccagggtatacgattccgacatgctctttcgtttcggacaccggtggaattcgaaatttttgaaatccggtggaaaaccggtaaattccgaacaaatttcataaaccaaaatttgaatacaaatccttgagtttgccggcaagttctcgaaaaccggtcggttttggcgaaattccgatcgaaatcatcaaaatttcgatcagtaatttgttttcttttttaaattctttattcttttctttcttgatgtaagtttcagtaaatatacataatacatcatttttcgaacatttatatcccaataggttctatgaatatcatactccctccgtttcacaatgtaagtcatttagcatttcccacattcatattgatgttaatgaatctagatagatattgtcgaggagcgatcctctctagtaggtggtcgtgagacccccttttgtgagttcggctgggggaaatggcgcgatgacaggagtttacttccgctcgcagtctagctgcttgatcgttgtcgggactgtatgggagatcgaggattatacaggttcgggccgctaccgagcgtaataccctactcctgtgtgtgggattatggtgaggttttacaagggatttcaagctccgacggggacctagctgtcttccttcgagcttgagttctcctcgagtcctccctttttcccggtggtaatggtcctccttttatagttcaaggggataccacatgcaccgtttgcacctaccccccacgaaaaggggtacccacatggtcctaatcatatcgctatcctttgcttcaaccggaagcaacatggtcgcctggcttcaggggggcccaacgccgtnctccggctgacacgggggacatccctatcattctctaataaatggatgaaggcttcggcggcccatcacgcccgtggggcgcccctagcagcgtgccgacgggacagggcacacctgcccccattccgcctgacacagggtggaacgtgggggcactgccctccgtcccgtcgcctgttgaccggtcacaggccggtcatgctcgattgacatggtcaatcgagcggcgccgcacgtcccccaacgccgcattgaatacggcgtgggacggttggggtaccgcgcattaaaggcgcggagcatcgtcttttgccccgcctcctttccccgccacgtggtggccaggtgagggccccggggtagcacgccccgaaagcccgaggggtgcggcgtggcaccccgaggctccctggccacctctctacccgaggggcggggggaaacgaggccgtgtggccacgcgaccagatgggaaagatatttccctttactgtgcgtacccctgggcccatttcaccgacagatatatatgtctagattcattaacatcaatatgaatgtgggaaatactagagtggcttacatcgtgaaacggagaaaatagtatttataagattttttattttttatcaattcaaatttgaatttggatgaaactcctcaaaatatctcagacggtttctactttcgagtctcgtcgaaacatcgaaattccgacgaaatccgatcggatttcgtcggaatcgtaaaccctgtttgtagctcaactttgctaagtcaatatttatgcaatgttaaactatatagaatataaaacgattggcatggttgaaagccaaatgcaattttgataacaaaacaagcaaatgcctagtcagttttgttaaaaaagaaatcaccaccaccttattcttaaccatgataaagtttgataaagtttattttaacaataaagtaaataaaatttaactatattactccctctaggtcttttaatgacattggctagtttgaactagccagcgtcatatatacgaagattatggtggtataaatttagttagttttatttcaataataaaaggaactaagcgaacactctttgtttaacttatgatattctatcaagcccattcaaacaatgatattataacgaaacacttctctatctctgctattataaaaattaaagatgttttaaccggtattttggtatatcatccatgtttgagtcattttttaacttccttcgcttttagaaatacatatatgtgtttgagttagaatttaagctcatttgcttttgaaaatacaaaagaagtcgtacaagaaatctcttttagaaaatacccgcatactaacttaagataaaaatcggactcctaattgtagctcgtgattttctaaaagaaaaatccaagcaaattcctaccgtgaattttatcctttctaaaccgtataacaataataaggttaaaatagtattcacccgttgcaacgcatgtgtatttttttatactaaaaatgctcgtgcattgcaccgggtaaaagcaatttttaatctaattatggttatatggttaacctaggatgaaatccactatgggaattcacttggattttttttagaaaatcatgagctacagttaggagtctggctttcatctcaagttagcatgcaagttgttttaaagaaatttcttatacgacttcttttgtatttccaaaagcaaacgaacttaaaatccgactcaaacacagatctatatttccaaaagcgaatgaatttaaaaacctacttaaatacgggtgacgaccaaaataccgaccggtaaattttttttcaatttttataatagcagagattgtaaatcctatcttagtataaagttatcccccactaactccttaagcttaacatgcaaagatgccacatcatcatccactaattaacaaaatgctacatcatcatccactaacaatcatcacatttaaacatcatgcaaacatgctatatctttatagtttttataatttaagagcttttcaaatacaaatatgttaaattatcatccaatataattcacataatgtttcaatgtatatctttattatgttttatgatatcctatatacttatatagttcatccttaattagttagtgcttaaatgattaatctatggtccaaattatctttctccttttttcctctaattaagtcatatcacatcaattgtttttagcctttagatgattaatctacggtccaaactatctttctgcttttctttttccataaagtcatgccaccttactttttacgtttgaatcaacattctacatactatttaaatttaaattatcataaaccatattaatttacttaatttgatgttatctaactatcttgcacgttatttttttattgttatcatactaaatttccgcagcaatgcgcggggtttcacctagtatctcaatgttcacaccacaacacattcagagacaaacatccaccaggtgcccccatgagcggaaactttaatgggcgatcgatcgcccatcccatcgggtagcaattgccccgggccccctcccccctttctcccttcacctggtttccatttttttcaccgcattacttttctattttagtaaatttatgcatctaaagtttatacaccttaagtttacacatctaaagtttagagacccaaagtttataagtcaaaaatttatgtatccaattcaaatttgaatttgaattcaaatatttttttttatatatagtatttttatacatctaaagtttatagacctaagtttatagacctaaagtttataagtcaaaagtttatatacccgtttcaaatttgaatttgaattatatccaattcaaattttaatttgaattcaaatagtttctatatatagtatttctatacatctaaagtttatacacctaaagtttatagatccaaagtttataagtcaaaagtttacatacccgattcaaatttgaatttaaattcaatttaaatttgaattcaaattttatagacctaaagtttataaactttttttatatatatagtatttctatacatctaaagtttatacacctaaagtttatacacctaaagtttataagtcaaaagtttatatacccgtttcaaatttgaatttgaattatatctgattcaattttgaatttgaattcaaatattttctatatatagtatttctatacatctaaagtttatacacctacaatttatagatccaaagtttataagtcaaaagtttacatacccgattcaaattttttatatatagtatttctatacataaatttttctaacttttgtttttttaaaaaaaattagtggtgtactgtaataggaagagaagaagggaagaaggaaggggagaagtaggaggaggtacgtattgcctataggcggagggtggtggcggatgagtcgaacatggaaggatccgagccgtctgcccaatttaatggaagcttccaagcgcaaccgccgaatcctcctccatcttcggccagcatagctcctgcctggccacccccaggtttgctctcgcggctcttccctcaccggtgcgccgcaccgttcaccgcccgccggagtcgccgtcgtcgccgccgagaagagggacgcagctgccgtgcgcggccgagtggatgtg

SEQ ID NO: 53594 - DNA, 1384 bp, Oryza sativa
atacgaagccgggttcattgccaagcacaggagcattctgcttgtggacaagcagcatgaaaatggccacaagttcgtggtatcgatggccgtatggtatcctgtggacactgggctgttcgtgacagcttcttttgatcagtatgtcaaagtgtgggatactaattcgactcaagtatgcattcatctgctttgtggattgcttatttttcttttctcttgcctcctttggtggtggcaacggtgtgatcctgatgttctgatttttgccttggctttcttttcctaggtcgtaatggattttaagatgcctggaaaagtgtatagcgcagcaatgtccccaattgcaacaacacatatgctgatcgctactggaagtgcggatgttcaggtccatttatgtgacattgcttctggagcctttacccacacgttgtccggtcatcgtggttagtttcttacttctagtgcagtgatgaaaatatgcttgctttgtttgtatggttaccaccttatccttggtatctgacatgtcagatggtatcatgtctttggagtggtctacttcaagtgagtggattttgatgagcggtggttgtgatggagcaatacgatttgggacataagacgagctggatgctttcttgttcttgatcgtcacggtctcaactaggaaggcggcctccttttcttgagggcacctcagataagatatggtcaccattatccatcacttacatttgttttcagaatatttggtcccaatgctagagctggacttccactatcatcatctgcgaaagcttcaaaaatgttacagcttcaagtaaaatattatggctgtaatgctagatcaatacagtcagccttcaagtaaaagctgatttctgcggctattaatttataggtttgtctcacatattagtgtcagtatataggtgctatggtatgtttagtgctccaattcttacaatataaggtctgcatacattgtttcttgttgattgttgtgtcctagaaatgacgcgcaaactcagccttccactctagttgtgcaaatgatcaatgtattcatttttaattttgaccaggatcctttgaactctttacaaccttcatcttcttcaaagatttactctgcacagcagaggacaggcaagagtaagaaacagtcacacaaattgcacaaagtcaaatccctggacatggacatatccaacagagattgcaccctggttgtcttctagtcaaaattgtgcaacggcacattatggtgctgttacaggattaagaacaactacagatgggatgtaccttcttagctcaggttgattgaatttaattgctatttctatgagcattcgattgctattgcttgaaagga

SEQ ID NO: 53595 - DNA, 919 bp, Oryza sativa
aaatctgcatgtgtccatctacacaataaactgttgcatgctgtggtatgtttcatccgtttctttcctctactgttattctgatcaccgtgtccattttgggttgtatgtattgacttcttgcaatgtgcttgcaatataactgattatctttggaactcccgacagagctgtatagccttatggactgaagctttacctgagctgcgaggttctctgcgttttgggaccagcaattcattgcaggttggtttgaaaatagaaaatactgtcactccatgcgattcttcctcgacattagtctgaaataagtgcaataagtgcctttggcgatccagattcgctaaatctgttgtaattgtaattgtaattgtaattataattgatagctattcttattcatttccttaaacatattattgatgcagctgaaaaactgcacgatattaggtggaatttcatgcatcgctgtttaagttttggaagtcatacagccttgttgcttcatctctttttaaggattgttgagttgttaggctgtccaagcttttttaaacaaatcaacagcaacgtgttgaggcatttcttcgctgctgtgctcaagttctcgtagggagcacgaccctacgacataggagcatttctgtccttgctccttaccagataaagagatctgatgtatctttgttaacatgatatcataacagttgggtaaacacataggagcattttcattatcggagagagaatctggcatatttacatttcacttagctgtctttatcaaagtgatatttcgggtgaaactgcaggatgaagtactgtacagtagtaataaacgtggctccccttaaaaaaagaaaaaaagaaaaaaaaacgtggcctgttaacatccctaatgtcaatgttcagtgtataa

SEQ ID NO: 53596 - DNA, 1492 bp, Oryza sativa
aagtttgaagaaaattttagaactaaacacggccttaaaaggtgcccaaccgtttaggtattctataccacgtcaggcatgataatctgataaagaaatggcagcaagaactgagccatcttatgaaaagaagtcttgtactctcgcctagggggctattcctgcacatgaactcacacatggacgtctggggcctgcttagaagtcatttattaagtcctatcgcaaaaaaaaaatcatttattaagtattaggctacggcttataagccgaagatacatgaccaataaaaaaacaattgtataaaagcgtgtgatgaaaaaaagaaaaaaaacacgctgaattaattttaaattaagttctaaaaatcaaaatttaacatttaacgtggcttataggtcacatgtaaaaaataaacaagttataagttaggtgtggaaagaactgtccactgcatcattggacgtggttgaacagttccattgggtgggacgtgatgactgatgataccatgaaaccactgtgctcataaactagaggcaaaaaccagccataaactacactgtggaagattggttctagatccgtcataaactgttttaggacattttcttgacgtagatacctgcattttactatcttctaacatgtttaccgtcgaattccttcggtctttttcggtccgaatcggagtgctattccacacgtgaaatggcgcatcttggctttataagctaaatcatcctatctatacgcaaatcaaagaagggtgcctgtgattgttaattcctcgactaatgtttagctcgattaaaatcgatcttaccaaacagcatgacaataaaggccatattggacatggaacagggacattggggcctccccggcagggatttgtgctcccacaagatgattagtttcactcattggatggtctaattgtgttagttctgtctacataagtaccaacttatgtgcaatcaaggctgggtcacggaccatccgcattcaatcgatgtttacttctcttcgctctgaaatctgatgcaattatatgctttgcttcatcacgctgcaacagtcaggggcatttaggtagtcagactcggaacgtgtactaccagaatggtaatgactggttcagctaatggcataatcttataatacgaattccatgcaagaaatcgcaaggaaaattatgccacatggcaacacctatttcgtggaacaggctcgatcttgctagcgcgcgtgcagcaatccggaaatgctcgtgtgcgtgcgtgcaacgggcgtccaaaattttctggagtatcaatcaagcaattagtagatgatttaggcacataggtcatggctcagcgggctatgtgatggcacaagatgacaagaacacactaggtgaaacgagatattatgtatgcatgcaaatacccgatgcatgttgatcgatgcatgaactagaaaaaaaaaagaggcaatggcaaattat

SEQ ID NO: 53597 - DNA, 4373 bp, Oryza sativa
ggttttctttggatcacggcctcaccgcgcgcatcgccgtctcgtcgtggcgagcgcggggcgcgacggttggcgcgcgcgggctccgtcccgtcctttgtcaccgccgcgagaggcgcctcgcaccggaaccggccggccccgggcccgggctgcctgcctcgccctgtgcggatcgtacgcctgaatcagcgtggcggtctgtgtggccttcgtttggtgagagcctgagaggacagccgttcgctcgcaaatcgcaatgccgcccccggcacggccagcctccgaccgattcgtgagcgcgcgcgcgggggcgggcgcgacacgtgactgcacgagataatgtctcccactcttcagggaaaggtaaggacagggttgatcccgcggtcgatgtagccagccagggaagacgacgaggtctggtggtttccgcgcgcgccgaggcggcctcacacaagtcacaattggcggggaacgatgggtggtggttcgcgaggggccgcaccctcgtactgtctctttggaacaaagcgatcgccatcgtggccgaccggtcgagagcgaggcagcatcatcagtgaaaacgtcacggcctcgcgacgcggtaccgttgaggcggtgacgccgaagatgacttgactgcggcgagggtacagtcgtacagatggacacctgattaagcgacgttcgtggatggaatcaagggaggatgcgggtcaccttgcagcatttgtagagcaaaagcgacgtgcaggatgggtgttctgcagtgaggaggacggatcaaggaagatatttatttctgatgacgtgactcaaatggctagaatcctaatattggttatttgtagagaatcaaatttaggcaaaagtccaaacggcatttcttctctgggcttagacagacagagtacatattattggtttcacggcaatgagtagccaatgacagatcagttgacacaagatagggtcagacagaagtaacgctccactccaagggagtgactggtgagcagctgttggccgctgccccatagcaggcatcagctatagaatgactgttcgtctggggcccgatgtgattcccaatttctcaagcagaaatcctgaattggagcaccatgccattgcaagttttgagtattaccacggctgaacggttgcaacttgcagctgaacccaaaataactgaattagcatttcaatagatctactcttcagaaaaagcatttgtacatgtaatcttgcagtcctactaacggtcccaacagttgtacagtcctataatacaacaagccaatgccaattagttgaagatgtactacagcacatatcgtccaaacaccgaatatgatgacaatgcattgatggctcaggatttggagggtaatcctattgaatttctttcatggagagcctgtggcaggtggcttgggtgtctgatttttctggttagctgcagcttgcgcagcagagccctttgcgttactttcgctggccattgacttcttgatctggacaggttcagacaaaacaataacatatcacaccgcaagcaaagacaacaatcaaatggacgtatcggcagaacgctgtatttggtgatgagaaatgaccatcaataggttaattttgaaacagcattgagaatagattaggatatttgtcaattcacagtttgtactactttaatagagggaatcaaaacaatatgtttccaagatataagatgggaagaacagttaccagagtaagcctctccctgtgaatatcattgacatgctgcaaattgtaaaggaaaagattattacagttacaaacaattgtgagaattcatagcaagcaatcaaaagcgaagaaataagtatgcaaatgtatgaattaccggcttcttgtacagttttatttcatctccactgaagcctggcaaggtaatattccagcttctctctgcaatggatgacaattaaatcatatgaaaaatgcaattgaaaatttgaaatgctatgacttgatagcatcaccacaaagattctagaagaacaaaaatattcaagttacctgcatggaggagtacatcttttgcttctaaaatgcttgactttctatgttttgctaaagaacaagcaaatgttgcaacctgctcaaaacagctaattaaaaaaaaggtacagaagacatcctagatacaccaggatgacaaattcacatgttgctgatgattaaagggtgacaactttcttctatatctaaagacagcataacttcgacccagagcttctaggcctctagcaaccattaggcagtgtttactatttcctcacacaagaagaaccagagaacacatccccgtaataagcatacttgcaaaaagaaactattggagaacagcaatgatggtggagggaaggggcttacagattcaacaaaattttctgcaatgtccataagaacattttcaacttcaggatcaagcttttctgaaggatcaatctgttggaagatcacagcatgagaaagttatgatgacacttaacttttgcaaataataaaatgcctatttctacttaagtgatgatgatccataactgataaatattggtaaaagaaccaactaatccatcacaggcagtggggtttatgaacctacaatacccataacatccgtgaacccctatggttgcagcccctacactcaacaactttaaacaatcatgacccaaataaatttaatgacaaagtttaaccaccagtttttgctttcttatctaccttcctaataccaggtacaacctaccttcttttacttggtcaagacacttgaacatagatttcacacagatcattaattatcgtaagcacttctgaatcaacaacattattttgaaaagatttttacttggtccttaaccaatgtagattaaacaaaaaatctgttaagatagtgggccctttttttttttctgttttctattggcggggtttctttggatattagatatggtttaactgtgtttttttcattactaaagaagggtatactttcaggtttcagttcaggaagttgtgtacctgtgcaactaattcatgtatactcctcttggaaagcagtcgattaccagatcctccagcatccacatcgactgaagccatgtctccagattgcacattagtagcttttagtacagcaggagaatctagcttctgagccattagacaggggtacgagcagtttgctgctgagaaatttgttgctggtttctgagtgttgtagtctgttgactttgctgcgaggaatgttgtggctgattttgttgttgctgctgctgctgctgtagcttttgttgctgctgctgctgctgctgctgtagtttttgttgctgctgctgctgctgttgctgtagtttttgttgctgctgctgctgctgctgctgttgctgcaaatgttgatgttgtggtagtttttgctgctgctgtgttaaaagtgcattctgtgggtgcgaaattgcaggagcatggtatggtcttggatgtggcctatgttgaggggcctaagtggagcagatacatttggcggagtttgctgtaaaggcatcgagggggaagaagccatagatggtggtcttgccaaagcttggatgggggttttctgttggaatatagttaaatgaagttaggtttaataagaggagtgttcccttgtaactggattgaggaatgaaaaatacaaaaaataaacaatggtgcaagttccaattgatctcattattcacagaacaaggtaaactcataaatgagttacagttgccaaggaaaaatgacaaaatatgtacaaggaagcataagttatattgtaaataatcttattcacataattaggtacatcatataactgaaacagaaagcttatttgcctatagatagaccagtctttgctttttacaagtgaaagtttcttacttgtgaacttgcaatctggctatcagatggagatggtgctgttgaagatggaaaatttggccttgtctgctgtggcagactagagattgctcctggtctcacctgagatgtgttaatggaaccaactgtcccaatattttggatcccaggggaaggctgcctaggctgaagaccataatcattactaagaatcttcactgaattcaaaacaatagagaaaaggtgcaatatgtttcaactaacagcgtgcatgtactttgcaatggaaattggctctctttatactggattatattgaacaacttttcggactatatatgtttttttttgtatgtacatttgagttggctgcgtgggaactgggaattaatgatctctagagaggatgaatgtgttggtgtaaaaaa

SEQ ID NO: 53598 - DNA, 2723 bp, Oryza sativa
aaaaatgggttcacaaaactgcagataacaagcatgtgacatcaagcaagataatcctactaagtcatggtttcctcaagaaatttactaacatgggatcagatatcgtgtcattattatataaaagaatgtaattcttgctgtcatccagatcagttatttcctgaccaaatgaaaacctcatactaccgagagcttaatcacaccagaatataaaagtgcggagctaagcatcagatacagacctgtgtagaggatggtgggggctggtcaggaccccgatgcatcgagccgaactgcgcggcgagtgtcggcggcggcacgaacccggtgtagccgacgggcgtctgcggcgcacgcgggtgcgctggtagcccaagggctacacctccccgtggcatggcagatgaggacgcaaggtggcggccggagcggaagcagaggaggaagaggccgccccgtggccggagaggaggacatcgtgatgggcgaggccaggtgagtgtacggaggcctcatgcggggcaccggcggccgcgcactggcggggcttggagctggggtttctagggtttggacgggggctggggtgggattgggggccggggcaagggtggtgtcgggggtgggcggcgcggcggtggaggcggaaggggtgggattaggctgtggcgcggatgaaggggcagaagccgaggtcgaaatgggcggcgccggcggcgccgccgcggcggcgtccggttgcgcgggcggaggcgcgtccatggtgttcgacggctcagcgaggcgggggtgtctttgataagatggcagaaatacagatgaaggggaggacttgaatgcaaaatttctcttctgaaaaggtcttcctaaacccctcgccccccgctcgctaaacacactagacatttccgatgggcaagaacgggaagaagacggagtcgcaccggcaaggccgaggccgccgtgcctcacgcttccgcggcggcggcggcggcggcgacgaggatggtgacgagttgccttcatctgcctatgatgctccaccgccacaccacgaggactccgacggtgacgacaccgacgaagcagcagccgaggacgaacacgaagggggtgtggatggaggtgaccaggagcagcgggaagtaggttccatgccttccaagttccacctgtaccaactctccgtccaggtaatctcgctagcttcactagtgggatagatcggtgaaattaagtctccgtgcaccgaacctgttcgacgaaatgctaacagtatgcgtctgtgtttagtcgccaaaaggggacattagctacctgcagaagttcttccttatgtacgtcggcgggcgcgtccctctgcacttccaagaggatttctgtggcacggccctcctcaggtcaatgcactaaacttttcgatgaagtccatgtctgtcatttttcacacattgcatgtgtggttgaagacttcagcagttccattagcaagaaatgtgccaaatgcttgaatgttattctttggagaactttgatcaatgatgctcaacaatcaagagatcagttaactttagtgtgtgactgtgtgatgcatgtgtttttggcttcttggtcatgatatattgtttgatttcctgttggcagtgctgagtggcttcgtactgatgcaaggcgtacagcagttggcttagatttggaccttgagtcacttgagtggtgtcttgaaaacaacctgagcaagattggagctgatgggtattcaagaatgctacttttccatggaaatgttctacagccaaatgtagctcgcctagtcaagcaaaagatctgtgatgccatgcaaaatctgcacgtaaacaatgataatgactctttagcaagtaacatctgtgatcagttggatcctgctagcccaaaatgctcagccaattcaaccatgtcggatttggttttgccggcaagagacattatttgtgcattcaactacagttgctgttgtctccacaggagaaaggacttggttttgtattttaggcatgctttcaatgcactgtcaaaacgaggtggtatatttgtaatggatgtgtatggtggcacatcatctgaacgcaagctacgtctgcagaggaggttccccagcttcactgtgagtgatgttgtgttagttattagcccttatactagttacgaatccactaaatgctatcttcttgctcaccagatagaaatgtggtaggcatataatgccctgaaaaaactgcgttcttttttatgaaaattcacactatctgcttgtagaatctgcttattccaacataaagatgttgcagtagtagtagtatgcaacataaaagaatgttttagtccgaaatacaattttctattgaccatgcctcctttttatagattctaaagcggttagctatatttttatacaacttcaatctagctattctgaaataattgtaaagtatatatgctatgttgttaccctttatggtgagattttgtgcctcctttttatgactcgatgtccatttcacttatcagtcatataggtttttcccttgtgtagtttattctagttgaaataaacaacagatagagttgtccaattatcaatggcgtgcgatttggagaatgagaatgagattatatatagatttatattactgttcttacatacaagatacaactatgcattcagtatttctgggagc

SEQ ID NO: 53599 - DNA, 1224 bp, Oryza sativa
agattggtattaatatcatgtgcaaggtgtttagaatacatgtgtattagtcaagggtattgtagtcatttcccgtttctaggccaatcttgtaatctatattttccctttaggcctaactcaagataacagagagttcattacccatttacatcttcttcccaaattataacacagggaacaaccaaaggcaatgccactttattacctctgtgatatattgataccaaccacttctacatctactatatctctgaggagatttttcacgtgctatatctttgcactcttcataatgaagagtatgatgtacgggattgtttttcaagtgctgtgtgtaacacaccctacactacctgcatgacttcctcgcatgttaactttgttttagagttgcactggagtatcaggacatcttagtcctgtgcaaagaggaaggataccttcaaattcgaaattcatgttgctcctttgtaggtggtcgataccagaaatcaaagactgcttggaggaagctggatttaaatcaatccatgtctggatcagggagatgccaaatacccaatcaagtggaaatgctaaagaatataatgccaaccgtgatgtgaaatatgaagaattacagcatttcaatcaagcagatgcttggaatgcatatgttgttggagtagcaaatatctagatgattcatgctaccttctttttttagagagaagatgttggaaacctttgcagttttccgttctgatgctatccggtcagtttctctgatgctgcctgccggagtagtatctttttatctaatgcacaagtgcttaacatggattcccttctcgttgaaactagaatgtgtaattgctccactctatgccaggaaactaggaaagttgtatgtcttgggctatgatgtttgttctagatgagatgctagctaacatgtagtatcatcatatctgtaccgatcaaatagagagcagtcaaaccccaaagacaatctactgaagatggtgattcactatttcttgatgcagtcatacaggggttgtatgtccagtcagtttcatgcagcataaccttttcaggtttgcatgccaatggtgttctgtgctgattaacttcctgagccactgagtccctaagatatgctgtcaaatgtttgattaaactggccgagttacagatcatttcctctccgcaataatctctgcattgtgaacatctttt

SEQ ID NO: 53600 - DNA, 1897 bp, Oryza sativa
tcccttagcagtcaggtaacttctcaaatcctcccaagcaggccttagctttacaaaaacactagtatcgcgaacctgagcagagtattaaaatcagacaggggataaggtaatcacctcaaaaaagggaactaattacagaattctacaataattaaaaactctagttatctcaaaattttgaataactagacatatgagaattatactgagcccattttcagtccagaatgacttaatcagcttgattaatcgtctcagataagcattacaaaaataattactaaaatagaatctcttttttctaattggcagcaaacatatgagctgataataacacattgtgtgtaggttgtcaaactttgtgttaaatggtatttcatcatttcccaaaccatcaggctacaagttcatttctgcatctggtttattcataaacatcacatgtacaaagcaaattatgtaactatgcagatcatacagacctgtaggtagaaacaatgagcctgaacaaatatgtcttatccgaggatcaaaactgcagcaattacaagtcatttatagaacttatttttgtaccatcgttaataaccaaatagacatacagcatgccttttgtgggcagcaattggagcccagttctatttttccaacccaggaataggtccaactgatttcaaagtgtaattctagataaccccaggccaaaaacatgcacacaggcaaacgataacaacatttcatttaaatgaaatatatttatacatgatctatctgaattgtacctctggatttatgcgagttaaaatcgcattcctttctggcagcctgataacaggccggagaacacgctcctgcccaccagagataggcagaacttcctccttttgggtcccaacgattctgccattatctgtaactgtatctgtgtcaatgaactccttgagcagctccctgtcctcaatataccgcttgatttctgcagacatccctgctatcctgacggggtcgtcttcaatatccatcctacgggaaagcatctcgatccggtcctcaaaggacttcattgtgttagcgacaataagggtttcatcgagatcaaatactatagcaaggcaccgaaagttcagcatcccaacagatgctgcatagattccagagcgtactgaacagcaccaaaagcatggcaccttctccaccttgctcagcattgccactaggtgtagctcctcatctacaactactaccactgcgctctacacatacccagggagacaaaaaattttataaatcctattatttcgtgcccctgatggaaatatcatcaatgggaaacatcatccgaacgaatcaaaccacatcaaacacacaacccatcgaagatccataatagaatgtgtaaaacgctttgattactggtgattgccccaaaattagaagtggcgctaataccatttcccaagtagtcgctgtaaacaacttatttcgcttcgatttcgaatgggagtaccagctatactaatacaaagcgatggacatgagcgattgttgagaaattgcgtgggggcaaaccttgtactcgttgaagcaagtgaggtagaggcggtgtaggctcgggtggggaggcatcagcttggcctggagcttgcatcgcacggagaagggcgcgatggtctgcaggatggcgagcggcgggcaccgctcgctcgtcggcgagaggtggctgatgcggatctcgttgctcgggaacggcaggctcccctcggccccctgcttcatcgggaacacctccgcctcgccgaggaacacgtcgccgtggaacatccgcatggtgaccccccggcgggggcaccggcccctcctccggggaggccgcctggggcggggcgcggggcgt

SEQ ID NO: 53601 - DNA, 7098 bp, Oryza sativa
actgaatccacatgtcattaagataggtgtgacaaatagttaattgtcaaatctaaaagtgacaaatagttaattgtcaaatctaaaagtgacaatagttaattgtcaaatctaaaagtggcaaatagttaaatgccccaatatggggtacggagtacttgctactccctttcattttcatttaggcggctgtattgagttcctctgccaaaacttttttaagtatatggacaaacatttgaagtattaaatatagactaataacaaaacaaattatagattccacatgtaaactgcgagacgaatttattaagcctaagtaatccgttattagcaaatgtttactgtagcatcatattgtcaaatcatggcgtaattaggctcaaaagattcgtctcgcaatttacatacaaactgtgtaattggttttttttcccgtccacatttaatgctccatacatgtgtctaaacatttgatgtgttggaatttttgaaaatttaaaataaactaaacacggcctcactttgattgtcatatttcaaaaaatcagattttaaaatttgatcatcacattttaaagtgaatggagggagtaatacaaaatcaaaaaaagactaaaataccactatttttatcaaatctcaatttaattattcttccttttatttactcctagtgaatttatctcatactttcacaaactccgatttgagacaaaagagaagagcaaaaaataaataaatttactctaggacgaaagcagtacaatttattactacatccgtctaatatattagcaaaatcttttatattttaggatgggtatagtatcgtattgaagttgatcattgcaaaactgacatatggatctcactttttttagggtccatgcctgactcctacagtcctacgcaggagttgcatccggcgtggtttgcaccgggagactagtttttgttttctgcatattggggaatctccttttctgttgaattgtactactgcggaccagcttagaaccgtgtgggaaaataggaaatgcttgtggaacaatcaggttggattggatttatgggtggattgggatcaaggataaatactctgtgaataaattttggacaaaaaaattggtatcagcattagtaataaacaaccaagcatgtatgttaaacaactttccgttggctgcttcaactgatatgtacaaactactagtagcattcagtgggagtaagtatgtatgcatatatatatatatatagttcactcttatcatatttcataagatttctcatgagctgtaatcaggcatggggtactgatgattatatcttcgtaccccaacttctataaaaaaaaattacggttacatagacaactagacaagcacaacccgtgaacacattagtacttattcactcacctgaactggacaccctctacctcttttacatgatttatgtgctagtactacagagaccgcaacaatggtaccagcatttatcatgccatcgatcctgccattgatcataatggagcaatacaaggacatgatatgcttaaagtgtgaagaagatgcaaaggacaatgaataaacaagaattatagagttgtatgcactttagggttcaaaatctcggcgaaatttgagcatctagagccggctcaaaatgcgcatctcgaatggttttattcaaagtttattggagttcattgaaattttgctaaaattcgttcaaaattaacgaaaaatcacttgtagttggcattagattatttttatttttatagttggataaccggtgaataaatggtctccagtactaatcaaatattatgatcagaaagtgtagtgaaaaaagaagatgcaggaatatgtgagaaaaaggaactgaaaccaaataagttggccaatctcatgttacttggccgttaatactagtactactccgtcgagtacacaatgaatgattcactgctatctagtttgtggttctaataaatcgaatacattatactcttcatatgttccttgtataaacctgtttgtttgtggttctgtgaatcaaatgccatatacatgacattcgtgtttgtgctcctcatcttgcaatttcatagcaacatttttctactcagtatgcctagttgtcatggtgttttcacttgctgaattgcttttctacatatttttggctcttcttgtactgtatgttcagacttgcctttaacatggataattgaagtattgaactaacatgaaaaatgtgatgtcctatgcttcttgatcaacattcctgcagagaaccaagtcataagcattgactgatatttacctgccaactatcactgagcattttcagacacatacctttcatgcttcaacttttgtatgtttgtgctacaattttcttacaccaaatcgcctgtctctgctctggaaggagcaaagcgcttcgaggtaatcagcctccccgaaatcaggccacagcgtgttggtgaagaagagctccgagtacgctgactgccacagcaagaagttgctcagcctcagctcgccgctggtcctgatgagaaggtcggggtacgggaactcgtcggccgcgcagctcgtctcgagctcgtcggcgaacagcgcctcgtcgatgtcctccgccgcgagcgccttgctctgcaccttctgggcaagcttccggcacgcctgcacgatgtccctcctcccgctgtagctgattgccagtgtcagatcaagctgtgaattgttcctcgtggtctcctcggcttctctcgcaatcttctgtagagaaaccggtagccttgagctgtcaccgattacacgtagccgaattccttccctgtggaaaaaaaaaatcctcattttgttgtccacatcaccacatgacatgtacacattagactttggcaggaaattatactggctcctgtgaaaattgaatctttttcctatgaatcttgcaagaaattcctattacaagctggtaattgagttgctggtacgcccggagcactgtgggctttgagcatctattggcgaacttccagttccacaaagccaagtgttgtgaacgcgtgaggcattaactaattatttaatttgcaagtacggatgtttacctcagaaactcggcgacgctatcgtggatcacccgctcgaacagcctcatcaagaagtccacctccacctgcgaattccaacatggcgaggacgcgtcaagctcggcgaaggcagagatttcgaaggaatcggcgcgaggcgtgtgtaccttgggccggctccagttctcgttggagaaggcaaagccagtgagcgcgcggatgccccaggcgcgggagagacgcaccgttttctccagcgcgcgccggccggcctcgtggccggccgccgacgggagcccccgcgcccgcgcccaccgcgcgttcccgtccatcaccaccgccacgtgccggggcagcgactccgcccgaaggcatccagggaggagagactcggccgccgggctgcgccggcgcgcgggcatgggcatggtggtggcggcgcggggcgcgtgctgcggcgaggggaggtgggtagctgatgggtagcagctggagagtgggagggcagcatggtgttggcggcttggcgcattgcccccaaactccgacaaaaggatgaaaagctctgcatttattaaccttttagaattgtttttttcttttttttagatgttgtgatttcctggggaattctaaacaaattgcaagaaattgatttacaagaatactacgggacgatatctcgttcgaacggtatcgtgaccttagggtacggacaaatttggggatagacggggaagtatagtttcccgcctatcttgagagtgagctcaaaagcaaagtgagtgaaaagtatttttttctattgaacttgtccctgcttacaggatctagttcggcttaaatgactctcacccatacacttgagataccaagtttgccccgagggcctacatattattcatactacccttataaagtttccattcttaagagctttttattatatttaagtggtctccaagtaccttccagtaaaagaagtggaagtatccctgttaccttttttaaacatggtcttttgagttggagtgatccccagttaccttcttgagacatgttcttttgtagttggagtgatcccctgttaccttcttgagacatgttcttttgctcaatgatactttcccttgacttcaatcatccgggtagagtaatgtctctctcgtgagggcttgaatacatttttcccatcttctggcctctcacctgctaagtgaagagaattgtccaaacacgttgtgttgttagtaatataccccatcagtccaaaaatataacaccctttaacactcagtatttgttccaaaatataacattttttttcaccaacattctcttcccaacaattcacaaccctccatcgttcacttttcctaactacctccacttcttaaccaatcacaacctttccctatttaattctaaagaaaacccctgtgtacccctgaaagttcacctaatcccttctataccctgaattttgctcaatccttacatacccctaaattttagtatggatcccttccatgccctttccgctagttgccgttaaattcttatgaaaaagtccattttgccatttggtataaagaagtatataaattaatagagtatattgttggagcatagaaatttattatatgagactattatgtttatgagatagttatgcaccatattatttgcgataaatatacttttagatatgacataaaaaattaatacttatttatttttttagcatatgtgttctgatagtaataaacaaatctgttgtattactatgaaaacacatgctacataaaagaacttttaataactaataaataagtattaaatttttatatcatatgtaaaagtaaattgtcacaaataatatggtgcatcacagactcataaatataatagtctcatccaataaatttttacattccaacaactatacttcattaatttattatgttttttcgtagcaaagggcaaaaagggccttttttcaaaagaatttaacggttaactaacggtcaactaacggaaaaggcatggaagggatccaaactaaaattcagaggtatgtaagggattgagcaaattcagggatatagaatggattaggtaaactttcatagatacataagggattttctcttaattctatctactttcttaataactgtgtctaactctaaaacttcttatattctgagatggagggaatactgatttgagcaagtgaaactactcaaacgcactttccttggaataaacatttcttgggcaaatgcaaatgatcgatcaagggttgttacaggtcaaaacttcattcgagcagattgcatggctcaaatacgatttccttattgtgtgtgtttttgccgaacatagggatggcgttcaccccctactacaacaaatgggatgatactagttaggtataaggtcctgatatccctaaggtattagataatacttgagatctgataactataaggtattatacctgatacccaaccggtttcatcccgttcgaacgggatttcgtcgtacaacaacccctttatattcctttgtgaaggtgtcaataactgaaaccattgacacgtaggcctttttccttcttttcaagaaggaagctctgtagtttaataaaaattgaaaagagtaaattgtattggtggtacacaaacttattaggtgggtgcaatttagtacgtaaacttgtaaaatgcttatttcagtacacgaacttgtctagttcgtgcgaacgaagaccaaaataacttagccatgttaatttatgatgttcattaggatgtgacgtgcatacgtatagtgagtatgcataagacacgtaatatttataaatttcgtcttaactttatccttcagaatggaaataacgaatctcatatgtttctaacccttatattagtgctaagttttttaatctttctgatttttattgaatagatatgtctaatggcaaccttcttagatatatgtttacatagtatcctaatcaacccctaaattaataagattaaccatgtagtgtacttttcggttttctccgcacgcacctagacaaattcatgcaccaaaatgagcattttacaagttcgtgcactagattgcacccatctgacaagttcgtgtaccggcgatgcaatttactcaattgaaaaccattgacgtatataaaacgctgaatagtgtatatcctgcattcttgctctgaacgttgccttggctttttgctccatttctgagaatacggacggccagttaaaggggcgttcctagtatgtgcgtacgccgacgcggtagcctaactaactctgttagttaaggataatgatggtaattaacaatagattttttattttattaggagattctttttcctaatagattgaaaaattttaagttacatttgaaaacttttgacttaagatttaaactttaaactcaaattttgaaaactttcaactcgaactttgaaagttttcaatttgcaagaaaattttttaaaactttcaactcgagatttgaaaacttttaactcaaatttaaaaactttcaactcgagatttgaaaactttcagctcaaaatttgaaaactttcaactcgtatttgaaaactttcaactcgaatttgaaaactttcaactcgagatttgaaattttttaaattaagatttaaaaatttttaagtcaagatttaaaaactttttaaaaaataaaaacacttgctgctagaagattaaaaagtaatcaggaaaaaaagaaaaaaaaaggaaagcgaaaaaaatcagggaagaaaaaaaagtggaaaaaaaaaagagaaaacagcggtggttagatttcgcgggcgcacgccgagtgggccgtatggaaaaaaaaagagaaaacaaccgggagtgcgcgctgcggcgcgcgcgaattaggtttctcgcagttaaagcacggactgtgtg

SEQ ID NO: 53602 - DNA, 9392 bp, Oryza sativa
agttactagaagatgtcaatgttttaaatgtgactaccctgattttccatacttccatgtgcaagccttccatactaactactcgagaagctgtcgcatgtgtctggttgggaaccaatagtgaacgggtggactaaattccatacacgattgacaactccatctgacataaaggaaaacgcatcttttgcggctctttgacatgcttccagagctctagaatcaccaagcagttgttttagtgcttccaaaagttcatattctcctttgacctgaaaaacatttgcattaatcctcatagaatgaaaggggctgtagctccttgcgatgtttaggtgtaaaaaaaaaaagaatcacccatgcagtaaagcagcatacccacattgcaagcataatttattgaaagagcaagtagaaggcaattcatcctgttaccgtccaaactaatttccagaagtagggacaaggccaagtcaataattaacaaaatacctcccctaagaaggccacgaaatagtagtaatcccactcttaatcgaacatagtgcacaaatgatgcggcattttttgtgtcagttagataaataacaaagtacaagacagattatcacctgcttgacagctaaaggatttatttgccacatttcgaccagcatatgatagaagtgcccaacactaggacctgaaagacaattaatgaaactctagacattccgattttgtagaaaaagtcattcaaaatagtcagatgtgtcttgcactcttgcgtaccagtcataacagcgcaaccaactgcagcagcctcagaaatattatgtccagctaagccgggcaaaaaagaacccccaataacagctattggagtaaccctgtagagcattcttaattcacctattttccatggtatttcattcattaactaacattcaaaagaatatacacagtccatactccatactgaaaaaatgtgcaaacttaaggcataagagatagcacaaacctaacgtatcaaccacatatatactggtgtttgaagacaccacttctcttgttgacctcagcacaaaattcactttctgtttcttcagggtctaaaagaagatgagtaaagaactaaagatgtggcccatacatattatactatcagcattgaagtgagaatcatatgctacatgctctagaaccataagaaatttcaagtaatcgtatacaaacagttataagcaattaatttcaagcttcatacagtgaactaagttagttccctttttttcattacaacaatgctacacctatagattacccaatatgataatgtattaaaaaaaactaaaagataagcagtacaacccaccaactacttcatcaactaaacaggaccagatataaaagggtaaggaagacaattgacatacttgagaaacattcttgctgtcctcaggatgccttgggacgagaattaaaagtagagtaggatacgccctggttaactcatcatgaacacggagaatgactgaaaaagagaggaagcttgtcaacattgtttttatgttgagaacataagcatagtaaggcaaggattcaattattcaggaaagcataaagaagtcagcaatgactttagggatatcaatggtgatcatcaccataggcaaaacagctacatatatacagttttagtcctgcacacagttccttggaagagcagataatactgatccaataaaaagaaaaggtgggtgtctgaggtgcttactttcatcttccctttgtggatagaagctgccatccagatgggcctattgctgaactgctgctgaagatcttctattgcagctacctctttctccccagcagcaatgtcaccaacagctaggtaaatcacatgaatctctataaattattgagtttgtgaacctggttatctttcaagctcccaagataatccttgagaaatgcatcactcatatgtttatttcaaacatactctcatgaacataggaagccagagaaaaattggcatggcgcataccgtattttaaatcgccagcaaaatggatgatctgtggtggtgcatgaagtaattgaaaacgaacagcttgaatagtactctggaacagatagaaatgaatacaatggcaataattttacatcaaaataaggtttagaccccaccactccataccaatgggataacaagtgatagtttggagagcatcaaagagactaactgcaaccctagaggcaaggaccaacggttgaaagacttcaatgacatgcgcgcatttaaaagaaccactgcaatctgaaaaataggaaggtcattcacagcagataattaaatagtgaaagaatgtactatggaccgaaaatatagctaatctgccattgcacatggaaaaaacaagggtaacaaagggaagcctaaccacttagtagaaaatagtcattatgagaaaaaaaaaacttacccctttctctgctgcagacaaaatgaggtttggccagagttcactttccataagaagtatcaaatttggtttccagtatccaatgaaactttctattgcatcaggacagtcaaggggtgcaaactacacacatatgtatttcagttatgtaaaacaacaataagctaccgtagatgtatatagggcatatcaaacatttaaactatccttctgttagcctattcgtgattcccttcatctaaacaagttccatctgttcccaaaactttgcttgatctgtgtctgtactatcgaatattaccaccttaaaggtttaatattacgaaaccttactatcatagttcaacgagtataatatgaccttagtttaagggatacatataatgaacagacaatatctatctgccttgacacagttcgaacctaaaatgtccttttttttcaagaacagtccatcagtaaaaatttgttgtgcatacgccatttctcagaaaactaaaccggccgtcacgacagggatctgaaagtacaagagcaatttccgagctcacctgatatatgacaccatccgggagcaagtctttcatcacttcgctgcattgaaatcaaaacaaccgaaatagaatatggccacattacacggaaatgagagagccaggcaactcgtatttgcggtaatgggggaagcttacaaggatgagagggtagtagtggtgaggaggatggggagaccagggtggaggcgggcgcagtggcgtacgaccgggagcgcggccatcccctcgccgagggatacggcgtggaaccacacgagcggcgagcccggacgaggccgcgccaccgacggcctgcccagccgctcgggccaacgcgacgggtgctccagtcctcgtagccgccgccatagaagcgccgccggcgccgccgcgcggctcgccgccctgtacagctcgtacagcgcccggccgccgcgcgccgccgacgccggcgtgcgggccgtccgcatcgagcctggcccgtccaacgactcacggcctgggtcgctttgggcttttgttagcggcgcgtgaggtcgcgtgctttcagtaccgagcccaacttacctctcgtttatacgccttcgatataagaaagcgtctccggtgttgagtctctccgtattcatagacagaacacacatttctgagcgaaactcaggctatatttctgcctcgattgatttatgcttatgcatataagataaaaattaaagtttaaaactcaattttggcgttgattttgttattttctcgttgtagtttattttacagtatttttttttaaatcactaaagacatgctataaattatttttagttgctaataaatgattaataaatataatataaacataagtgggaagatgacttcttttaaaaaaaagaaaaataaaaggaaaaaaaatcttcttcctgcattgatgttcctttgtcaagagttaaagcataataacatcacacgttcgcgaacagtttatagctattggcgtccagaatgatctgccggaccgcggcgactgacgcgacgacagcgagcgcggagaacacgacggcgatggtggtgttgagccagaacacggcgcccttcttggacggcttgaacgtcacgttgtagaacaccgccggcacagcgaagtcgagcgggaggaagccgaatgcgccgatgagcgcgttcatgtcgccgaagaagggcaccatggccgcgatggtggtgcccagcgcgacggcggcggtgcgggagagcacccgcggcgcgacgttcctcgcggcgtactgcccggccttggggtcggacaggaggccctccaggacctcgttggtcggctgcaggtacaccacggccaccgccgacagctgcagcagcgtgaagagctcgatgatgagcagcagccactccgggatgacggccctgccgcccaccatgaagttgctcaggagcgtgccctgcgactggttgccgaacgcccagtaccccgagatggccacgctgaagaacgtcgtcaccaccacggcgtagcacaggcacagccccttgaacatcttccccgtcaccggcgccgccaccgtcgcctgtatctcggggatgattccattgccgtacgtcgtggcgatgacggcgatggcgttgaacacgccgaacacgcggtcacgggtgttggcgccggcgatcgagtagtccttctcgggcgctccctttgagcttcctgcacaaaattcgtcagtccaattttaatccgtcgcgtcgacaggccaaattaaagcccaatagctaatctaaataatgggccgggtcgccgggaaacctaccaaggtagatgcaggcggcgacggcgcagaagctgtaggcgaggcacagcacgagggagatgaggttaacgtggcggagagagtggaacgacggcatctgcgccaggatcatcatgaagacgccgaagattgccacgaacacgtacagcttgatcgtgccgcccgggttggcaatcaggtagatagcctgcaacgcgatcgagtaagaaatgtggattcataccatgtgcaattgatgaacgcgatccgatccgatccgacacgaaatcagttcgtggactaagttctgatgaagataccttcatgctctgaccggctaggagagtgcacgcgacgactgccccgaagcagaccaggaactggatcggcccgatgtagaagcgtccccatccaggccctgcatgcatcaccgtggaaaaattaaccatgaatctcatctcagtgacagtgattttgtcgcggtgatgaagatgaatatccctttcgaaacattttttgtcagatgcgtgtgtaattaaactgtatgaatctgctgccagatggcactaaggacgattcctttttcccaacacgtacgttaaacctgtgcttatctgtccaatgtcgtatcagctaggatgctagtatatgactgattctactacacctggtacagtgctactccctccgtcccaaatataagaatctagaaccgatgggacattttctactactgtcctgtccagattcgtagtactaggaaatgtccaatccagttctaggttgttacatattgggacggagggtccagttctaggttgttacatattgggacggagggagtatttaagattgacatattgacaagaaacggcgcgcggtgctggtttttttccttcgcaagcagtatcaatcgatttagacaggcaatcaagtggaaagctggaatattaaattccacagcaaatacttgccgacaaattcgtcaaactcgaccaattgcatgatctgtagtactaatgtgggaatactatccctttcgaccaatcaagtttttctctatatatccgccaagcgctaactggagttttaattagtattatctaaccagtggggattctttccctcgtcgactcttgacagtgacaaaatacgagccctagcagctggacttttctaacctgtactgtaccgtgttacgattttattgaatgctgcttagtcagttactgaaatcaagcaacatgtcggcttcagacgctgcactcactccggttgaagagtttaccggtccgatatagtatggccatacccattgctcatgaatgctgcagacacgtacatgtcgcaaactcgcaaatgcgaaatgggacttgatttggccaaataatacagctgacttgttccgcacaagaaaagggggcgggcagctgactttcttgtgaataaaacaggacatcaatgatcagtcgctaaacctgtcacgtctacaagttggtgttccttcctcccttcctttcttttctgaaagaacactgcacttggcgtttctgcccctatattcaaggtgacgacataggtgttgatgtattgactcatcctcatgtctcgtttgaacgcaagaatatcacaaactatgtaaatgcttcgaaagaaatggtccattacagaaaaataaatcccgtgttataatcagaggtggttttttccaaattctcaattcgggcctttaggagccagggctaagtgaagacatgggcgaaagaatcttacctgcctcgtgatggatactagtacccactactgacttgtacagttgtactgtattcgtttttttgggtgaaggctgaatgccacgtccgtccattgtgaacgcccttactattgtattgtaatgcttttggtattgcacgtagtatgagtttgcgagacagttgtcagccaatgcaattttatatgcagattctcctccatctaccaattagcttggagttgctacgtgccttccttttaatcacttatgtactcgagtttaatgagtatattagcatcaacctactacattatttccattttaatgggaacctaactagtaaatagtaatagggtgtggtcaggacctattcctgctatagcggttacggctgtagcagtactaaaaatggctgtagtttacagcagcgtttaggctgtgtttagttcagtgtaaagtttagattttggttgaattgaaaatgatgtggctgaaaagttgtgtgtgtatgacaggttatgtgatggagaaggactgaagtttggattcaaactttgaatttaaacacagttttaattgtggctgaagcaacaatccctgtcgatcaatctcattgtttaactgtaattacggatagataggtatacgagtgattactgacctaaaatatcggtggccatgtccctgaagcggagctggcggcgtccttgctgcgcgtggtgctcgaggacgagggagatgaggttgtacgagtagaaggtcacggcggcgccgatgacgaggcagatgagccccgccgcccaccccagcgacgcgaacgcgaacggcaggctcagcagcggtggcgccacgatggacgtcgtcaggtggtacccgcagtgcagccatgaccctgcgcatttatacagcagcagcatgatcagtttttttctgttaaactagctaaaggtactgtgcattgcggcgaatatcataagagataaatataaaaataaaaattacaaacctactaacgtagttagttaattaggcatattatgtcatatcaagtgcaaaaatactcacatttgaggatcttatggtctaatatgttaacttatggtgatggggaaaactcagacaccctcactaatatcattcaaagtagtatatcatagatatagaaaaagaataacattactcctgctagtagttagctaatctgttaatcctactggtattttttctgtttgtattagtcgctggatgatgataagctgattgggagaggcttccgcagctccactcggtcaaaagttgtaggagatgaaggattggcaaaagaaagttcacaggttagctaaacgcttggaagttggaatatggcgagtaaacacgtttctatcagtcgtttcaaaaaaaaaaaacacgttgccatcggaagaaaccccatccctccatcaaacattgatcaatcctgcacaatgcccatacctactttccaaagctgtatgtcttacacatgtagtactcctcagtcactaaacttgctttgacaatcgaaagataaaaataaaagaaattttgcagtcattaaaaaaaagtacatcgagatacctaaattttacattaaaatttttggtacttctagatacatttttaaggatggtaaaattatcctaaaataaagttgttgatactagtatgtttcaggggtcagcaaatcaacagggaactatgaggcattgggggcagtgagcaatttgattttgttaagcctgcagtctcacacctaattcgattttcctttttccaaaatagaccaaatatgatttgattagtacattactcctaccatattcctcactccattccaaaataatcactacgatgagtttccgtgtacaattttaattgtccgtcttatttatttttttaaaaaaaaataaaaaaaatattagtcacgcccaaagtactattcatattttataagctaatagcaataaaaatcctaattaattttttttaataagacagacgattaaaattaaaaaaaaacttataactgcgcttattttgaaacggagagagttctagctaaccaacctcccgatgccatttataatttcctcgagtcaagagtatctgcgctagtgcgcatgataatcaacgagatggtgacctgtaccagttctcctatacgatacagacatcacgctaaagactgaacgattcatgcctaatttatttttttggaataaaaataacaatacatcgttattatacttttatagttcacttaggtccatatattaatatattttctgtctgcttcaacaagaccaaatagacgtgtaaccatttcatggagcccgaaaggttgactaatacgagtactgtatcgtgatatgggggatcggctgagctagcagcctagcagaacaataatatgaattgcccatgtttacaactttacatgcattgctattgataataggcttgatagccagggagcccatcatccctgaagtacattttctcttgtctcttctctgaatgttgaaaaagaatacatgtaggcgtgcaggcaacggatgtaggggaacggaaaaaagcgagcaaagaaagaagagagtttttgttactacatccaatcttcatagggtaaaactgtgaaaaagtagtgcaaaaggatagatgggcagggaccattcaaacatctacatctgtccaagaacttttaatcagagttcaggagacgcacccagtcattcaagtagaacagtaacgcagtacccctcacaatggctgccgggtacatgcgctgaggaaaattaaccgaaacaatttgtaaccatcatttttt

SEQ ID NO: 53603 - DNA, 4618 bp, Oryza sativa
gttatcttggtagtttgtacagtttttgggtacgattattaacatgagccaaatcatttacatacggatcatatcaatcgggatggcatagccaaatcctgcacaacaacacttcatcaaaccatcttgatatagcagccagaacaatctattaactcgtacatgttagttggctagttgctactgattagttagccagctcttttgcttattaatagctggggacaatccatcaacagtctagaatatacggcctccgatgctcccagaacacaaacaggttacgcttatatgtgcagctagccaaacatgcttgctgcctgacatgcgccaaagaggaatcaagaaagaaataacgaaagaaagaaagaatagtgggtgatcagaagcgagtaagcgagaaacaagagagctcatgtcagacacgaacgcacctttggactgaaggacgaagagagccccggcgtcgagcttctggccgacggtgtcgccgccggcctccatcttcttcgcctcctcatcctccctgctcggcgcccccatgacgcctctgccgtcgaacgattcggtcgctagctcttttgtcttgcaggtaaaaccaagggagcgccaaactacgggttgatggcctgaaactcttgggggactcggacgatacgatctacagttctacacggccgtacgttgtttgtctctgcctctgcgcggtgtttctcagcaggtgagcgggctctggttttgccttttgcgcttctactgctgaagctgaactgcgtactccatatatatagaagaagaatcaagcgcgctcgcggaccgggtggacaccgtatgacgcgcgggcgaaagggacagtgcggcctgtgcgcacgcggcacgtcgcgcgtgccacggcgggagaatctcccgcgcgctcgctcccgcgaccaggccgggcagtcggcagagaatcgctaatacgttaagatcacgaaaaaagtcatactttggaaaccaaaaataaaaagaaaatccgtcgagaacccaaacgaggaaaatttttattgtacattgtaatgcaagtatgagaaagtccatctagtatactaggattttaagccaaaggccgtccagtatcgtaaacataaaaaattgtcaacggactcaaaacttcacaattttattcgtgtacaacctttttgacaggcatggatcctttgcattacggcaacaaagaaaagttagtgctacccacattaatttgtgcctgctacattctttggtagccttggcttcgcccattggccactaccctttccttgccaatgtcacgtggccaccgaaaaatagaaaacatgtcagggaggggataagtacatactccgtggctccgtcccacagtgtaggaacctctaagacctattctagaactacaaatatggacatgagttttatcataggttgctatattgtgggacagaggaagtactacatatttaggtatgcataatgcatgtactagtagatcctattgtgtatgtgtaagttgtagtgctaaaaaaccttggatttttttatggtataaacaaagccattgtaaatctcattttgcattagcataaatgctactccctccgtttcaggttataatatgttttgactttgatcaaaatcaaactacttcaaatttgactaaatttatagacaaatatagtaatatttataatactaaattagttttattaaattaataattaaatatatttttataataaatttattttgggtcgaaaatattactattttttctataaacttgtttaaatttgaagcagtttgactttgaccaaagtcaaaacatcttataacctgaaacggagggagtaatatttgtctttcctagccatgttgaagaccggcagtttaggccggttagctgtatatagcataggtgcagcagagctgcgagctataagaggctgttcaattggtggagcattgggtggtgacgataagtgcgaagagggtgttgtaggcgaaaacctagcctgaggtttctctgagccatcaacgccgatgcctacggacattattatcctctcttagagcattgttaagccatcatcgacacctttccactcattaacatcattcttcatgtcaaaacccagtccgaatggatgggcggtggtggcgtctaagatgtcatgatctctttggtggtgttgtttgggaagtttttttcctcgctttaccgtcttttcttagctttttcttggcaaatttttggttgacgtcatctggttaatgtgagggacgagcggatcttcttctctctcgccctcttcctcaaccactttacatgaggatgattaggaactcatcgatgatttgtctgagtaggatcttgcaggtctagcagcgatcggtcaaacttaacggcggtcggtttggtcctaatgtcttctccttagttgtgtagggagctgttaacacgtggtgggtgtggtttggttttttttcaatggtcacaattttttcgtcatgtaactttgaaattttcttatccatatcataagaaatttcacgttgtcttgtgcgggatcgttaaaaaaaaatcctcgtggctgttaggagtcacttattatcatcgaaaggcgggtatgtcaattatcgttttctaatcatgaaaaagacgttgtttccctatttaatgttacaaaatttaaaattaaataccaaaaattaattcagttaattaaacttttgattttgattacattattttttgtttacactgtgaacagtactttatatttcatattgctttcagtttataattttcaaaataatttcaacgttttgaattgcaacagattctcacagtaaaagatggcattaaaatatactccagttttctttgtttcgattacaaactccaaatatactttctacacgattatttactttgaactatcggttccatgtataacgatcatagtattttgattaatagtctgcatacatttagaagacaatatacataattaacttagaaaaagtaaatagatttatttataatacgacacaactatatccctttgcaaataaatcaacaaaaattagttgctgaatttgcaatatctctatctggcaaagatgctcatccaataagccagatcgaactgttcctagcctctcatctcatcgtctgtttggtggtttggttcaatcgcaacaaaatttgagttccgaagtttaattttaaagtgatcttttttctttcgtaagttatttaaactgttaaaaataccgttattttttttaaaaaaataacatttttagttcatttattcgtttacgacttaaccgaaactcaacttatcaaaggattacataccaaacggtttaaaaaattccttcggattatcgtgtggtttgcaaggtgtcgaagtcgacggatcgaacggcgagaccgcgagatggacacggattaaatggtgcgcgcatgtagcgcggccgagaggcttgcacgagtccgtggcccatgaggccttgacgtacgagtggcttatatgctcgccaacttggccaccatatatagcacagaagtgctcgtagagctcagagtactcgttttccttaccgactgatgcacctaactaatccgccgattggtgtctcgttctcatctctactagtgctgtgaccgtgcacgtcggtcgtcggagggcgggcgccttcatatcgatcgtgatcctgacgggacgtcattcccgggggtcagtactgttcgttttcagaggagcaacagagtacttcctccatcccataaaaaataatctaatagtatgaaatatgacacacagagcctgcttaggccttgtttagttcgcgaaaaaaaaaatttaggtatcacatcggacgttcgaccggatgtcggaaggggtttttgacacgaataaaaaaactaatttcataactcatctggaaaccgcgagacgaatttattaagcttaattaatctggcattagtatatatgggttactgtagcgcttatggctaatcatggactaattaggctcaaaagattcgtctcgcgattttcacgcaaattatgtaattagttttttattttatctatatttaatactacatgcatgttgtcagggttatggataccgcatacctaatagtagtcgactaaatctcggcaggccccacccaatatcatgtcttatacggaacaaccctccggatatagaaggagtttcgtataaggaaggatgaatagaattctacatgtaaacgacatgtactactcggattgtatccatattggttttcttagttctatttggacaaggggacacctatgggtataaatacaaggccccctagaaggacaggggacacgaaacaatagatcaagacacaagatcaacatacaagccaacacgcctccaaatatcaacatcaaaaattagcttagacaaaccctatctggtacctgcgggggccggcaagagggtcaagcactatctctgatctcgacgagttcgtgctcgaggaagaagactaccctgtcatcgactacgagttagttatctagccgtcaagtcgacgacagccagatat

SEQ ID NO: 53604 - DNA, 6482 bp, Oryza sativa
ccccccattcagagcagcggcccgcgcgcggtatccatccctgtcgccttgccgagccgcgccatctgggaggacggatcggttgccatgcggcgtacgtccctcgctgctcgcttcgatcgattaccggcgccgcggggcattgccttgccgccggtccgcgcgcgtctcgttgcgttgtgtgggcactgcacaggttgactccgagcggtcgcgaatggccgtaaacctcgcgcgcgaggcgatcaactcaaccggagcggagccccgcgcgcggcagggccatgcgtgcgcgcgtgcagcggttggcgcgtttgtccgtatcgtttaacggttggtggccggaggtggggggaccccgggcgcggtcgaaaggaagcggatggatgggcgggccacggggggaattggcagcgcaaccgcagcgtgccggaatcgtggcgatgtcagggtcaaggcgcccccggtgcccgaaacggggaaaagagacgagtcgtcgactgtcgtgtcggcaaacacctgcatgccgccggtctagggctaacagacaggtgatccggattcgtcctcggcttcatccttccaggttaggcatatcgatatagacggctttttagttctactaaaatttggtaacagcctaatggttacaagagtctcagtagcacatgtggtccttgattcgactccccacaaaagtggattttttagaatttaacggcgttgtgctttcagtggtaagcgacgtaaccgtcgacaacaaggcgcctgtggtgacttcgtcaatctctcaaggatttgccggcctagtcttcgaagatactcataggggtaagttttacgtgcgtgtgtttatagggggtgagtgcgcgtgcgttgtgagtgtctgcgttgtactgtgtaattcttgaaaatgctttagtctggccgaccaatgcgaaggggaaaatcagacggcttgctgaaaatatcaatatcagccaacccactaaatacccaatgctctatctatatggtttctttctcctctctgctgcatactcggtctgcacacagccaaccacttatgtgtagcaatttttttattttttttcttatgatccgattatacattatattacttacaattaaatctttttatcaagatctcacatgattatattctgataaatatatacatatgttgcataaaatatggtctttgtgttatggtcagtttttcaccagtgttacatttgatcgaaacatttttatcaagcagtgaaatattttttatcaagtgataaaacacccaaaacattttttttattgagcgatgaaacatctgattttttttatatgttttgaagcaccattcaatatttcgcaaatatgagatatctgggccgtagtatcctcaggtaattctaataaactaaacatagccattgccactgtactaaaatttgataattccaaaattccaaaccaagcacgtccatcggtaccaaaatttgataacaccaatatttattatatataaaattttgataaggatgattttaacaataaaaaagttaacaattccatagttgtaggtcccaagtctaaatagatgacgtttagcctcctgaaatcatgatattggattaaatattcaaatacgtacactgttcatacaaaatttcaagaatataacaaaattttaagaatatacctttaaagaaatagaaaatatacccatgtcatcactagctgcgatgacatttgcatgacaagctagttgggctttgtagggtcgttagacttatcgccatatggcggcaatgagggtatcaccacttgctgtgacgagacaggtatatttttagaattttctttaaaatatgtattcatgaagatttatgagagaaaaatattttgaaaaaaaaatatgacattgcgctagctacaatatccaacaagaatagacaatcggcgtgcttacaggagtactcagaaaactcaacctcgtactacagcatgacacatcctaatacaacgaatctagatatactttatgttcaaatttgttgtattaaaatgtgtatattctagtattaggttgtatttttttgggacgagggattattagcaaatgacatgagagtctgattggctacaaatcctttcagtcggatcatgtacggagtaacgccttccggtatgaatattcagagtttcagacaactttaacaccttttagtaaaagtgcaaccagttcagatagaaatacccttgggaaaagtgcgcccaaagcaccaaatttgcacaaaatcagtacagataatcgggacataaaacgacaaaatgaagggcctatcattgaacagcggtaagaaaaggatatcttccctccttttatctccagtgaccagtaggatagacatccggtccatccggacattggtcgagcacaccaggcctactgctgccaatgttattactatcaggtccctctgcgacaactatttcaaagatgacgggtataacaatctttgtcttaagcggttgacactgacagcgacgtaatatgtacatgtgatctatatagtacatcttcaaggcacagctagaaataatcattgaatggcaacaaggacaagaactatatagaatacaaacggtgggtcctttcgtaattcaatcagatacgtccacagaaggcagaaccacttttgcctgaagaaaacagacttaattaattaagattattagaacccactattattcaggaatctaataatacactcaccatgcattgcatgtagtacgcatctcgcaatatagtgtgggatatcggtgccagggcaacacgtgtctacattaactcatctctcttcgccgcaacatatattggcttggctctggtccagcatgatgacagaaatatataagcacagctcaccaaccctgagtagatatcttttagattgataaggtaaccagataaataagtagactaaaaatattcacgaacacgtatatcaccttgcatcattgcgctgtcatgacggcgtcttctagctatcttcggtcatcatgataaaaatttcacataactacgtatgttttttttatcaaactgacagcagactatatttaagcaattatattacaaaacaacagatttagagtttaaatcctactccctccggttttattttaattgatgttttggataatgacacggtctacaagatatatgtttgaccttatttttctattataatatgtataataaacaaatacatgtttacttttattatagtgctttaaaagataaatctatatatattgttctagttcctttaatctaaatatttttaaagttattgatggtcaaagttataaaagtttgaactcaaccttgtccaaaacgtcaattaatatagaaccggagggagtagtattattttgtgaaaattttgttagtaatccttacttttatgacatatcattttaaatctataatttcatgatgtagtttgtaatagtttggtcaaaatatatgtagttttgtgaaatttactttaatatttataaatgtagtgttagtaatcgattttcccaatcctttggtcttggttatgtttaactagactaaaaattataaaatcagatatgctacttcacattcgatacaaaacatgaggtaaaatcttacggactcgtcctgttcttttgtccaacaagagttggatgaatattaagatttttatggtatgctttttaaactgctaaacggtgtgtttcgtgcgaaaactttatatatgaaagttgctctaaaatatcatattaatctatttttcaagtttgtaataattcaaactcaatggagaaaagaacaccacctagtgcgccagtaccttagactacatctctaacgtgttctccatgatctccaacaagcctatatggttaggtttctgtgggttaggtcatggtttgagtggggtgggggagaggggagagggaatgaagaggggaatagttctctggtacttcctccgttcttaaatattttgacgccgttgatttttttaaacatgtttgaccatttgtcttattaaaaaattaagtaattattaattattttttatcatttgattcattattaaatatatatacatatagttttacatatttcataaatttttacatatttcataattttttttaaataagatgaatggtcaaacatgtttaaaaaagtaacagcgttaaatatttaaaaaccgagctagtaatttagagggaagcttagagtggcgaaggtctggcgatgggcaacggagtcggaacgtaatatagttaaattatccatagaagacatatattggacaatattttagtaccaactgaccaacacaagctcacatggcttgctccactgtacatacgtgtctacaccaccatgcacgtttgggaatcttgttgcgcaggataggataaaatactgaagtgatgaaactattaattagcatgcgacatacctgattagatttaagtatctgatcaagtcaggatatcatatttgtgcactaaattcggtgggtcgtcggttgatgacagtgatgttatatatatgaaacttcccatgcatatttagaacgatataactgtttaatttcactgcatctgtctcaaaatatagctaacttttttaatttcaattcaaaattacatctccaaaataatactataattaatgtccccaaattatactattatcgtggggtagctaaataatcgtccgctgcagacatatagcttatgaaattacatttccaactatattgctaacatcctcccgttgttaaatcgtggaccagctaaattcgggttgttttggtggctaaactttgttatacttttgacaaccaaatctgatcaagtgagataaatgtttagggtcttattgattgcccaaaagcttattaattataatcctaacggtttattagtgataaaaaatattttttctgtaaaacttttatatatgtgtttttaacaacttaaaagtcaatgataaaaaagaaactagattaaaaatatcttaaaataaacttcaaagctacttcatccatttcatattacaagccgttttgattttcttctagtcaaacttctttaagtttgatcaaatttgtagaaaaaattagcaacatctacaacatcatattatcactactaaaaaatcgatttttcatggtgtcaacctattttttttctctaacagccatacatgatcaccgtcaatgaaaatactccgagggatgaggggctatggaccgccagtgaaaatggatcttcgctggtagccgcagcgaatatgtacaacttttcgctggcaacccacttaaacagccgtcaacaaaaattcgattttcgttggtggccactagagagcattgctagtgaaaatatcgccacattaaaaaaaatccaccgccacccaacacctcctcctcagctccttttcccaactccccctcttcctctagacccacccagccctcctccctcaccggcgacagctccctctcctcctccctccccaccgtcggtagctcgcgcaagcggtggtggcgaagagaagcacggggggcggggatctggcgcaaggaggggtggcggcggcggaaataagtgcgggcggcgaagattcgacgccgggagggggcggcgactgaggagaaaagtgtgcatgcttattcctcctcctcaagggcgcgtacatgacgacgagcaaggcgtcatcgtcctcttcgcgctcctcgacaagaccggcatcctccctatcgaccatggcatcatctacgcgctgctgcttggcgggctggtgctcgatgtggatgccatcctcatgctcctctcctccaaccagatgatcttcttcttcgacagaaagccaaagctggcgtggcttgtagggtggccaagcccgtgctgctgcggccaaggcgatggttggagtggatggatttttttttcatatttttttgtgatctgtgaatggatatgtgtttaatttgtgatttgtgaatggactagggtgggagaggattttggatttggagtggggtattttggatttgtgtgggggatttttgctggcggttctctttacggacccaccagcaatattttcgtaagtggttaattccagcctatgaaaatactctattttcactaaccttttcttgccagcgattgggctggccgctacctaaaatataaattgtccgccaacaaaaaaagctttttttagtagtgttagttttattagatgcaacgttgaatatattttgatgttatgtttattttgtattgaaaatgttaccatttttatctaaacttgatcaaatataaaaatatctgactagaaaaaaaatcaaaatgacttataatatgaaacaagtgaagttttttaaattttaaattttgctttggcctattct

SEQ ID NO: 53605 - DNA, 10437 bp, Oryza sativa
gtccaagtttttaagaaggttctgtggcaaaatatgatgctgtccaaagagttcctaggagtcggagactacggttaaaatatactgatgtgcaaacaactgtacggtcaactctttagtcatgatatatatccgacgtggacacgagtaaattcctgcagtgcgccctgccgtcgataagctctctcgaccggccagtcggtagttagctcgtgtaggtgcactgtaccacacgtgctgatccgatccttttggttcatttgaactggtactacctcgaccagagagcgaggctatttatctcccctggaatcgtagatcgtcacatagggacgaggacactgaaggctacgtgcactggccactggccaaagcaggaaggtactccctccgtcccataagtgattttgataatttgcttccactgtttaaccacttatcttattaaaaaaattatataaatataaaaaccaagaagttattcttaaaatactttagataataaagtaagtcacaaataaaataaatatgagtaaatttcatcatgggctatattttttttaccagtgtttcatattgggctagggctaagtcaagattttcactttacaccatgtttctttgccaattgccaagagttgcactttggggtagggtatgtttacaacctgggcatgtgtgactgacctcgccgtagatattatgattggattgtgatggcactcaattcaaacaactttttgatgcgcggtgtggcacggtttaggtagagatggctaagcccactcatgacatgacgaaagaaggagatgtgtgctatcgtttcatgcgtgcagaacttccttcgcatatctaggtgttgccacattgcaataatctctattacaagcttgccgacgtccacaatccaatcatctccatcacaagcttgccggcgtcctcccttatctcctgatctactgacatgtgagagcatctagtccaaagtgaaagcttttggtaaaagaaactagcccaaagtgaaaactttgtctttaggatggtccatgttgaaacttaggtaaaaatacctagaccaatgtgcaatttactcaataaataataattctaattttttaataagacgagtggttaaacagtacaagtaaaatgtaaaaatcccttatattagaaaacggagggagtacgtggtttcaattctctctcttccgttcagttgtgttctctgccgagtgatgctttggagctctctactatcactaaaaataatataaatcgtttgctattaaaggtaaatcggtaatttactaatccatggattagggataactttgttatttataatttttttctagatcgatatatggccattcattctgttgtctctataaaaaaggcaaaaaggaataaaaatattgtcacaattaaataattattatatctatctagacctattttttacaataataccctctacgtttgtagtacggctaactagaataatagtataaatagatctatactcttcgatccaatgagattaatggtttatattgtcttatattgtcttttagagtaaatttcaaagtacatatactttgatcaaattatcacataactacagattaacttgatgtatcacaaaactacacatttaagatgaagtgtcacaaaactacttgtttagtaacacaactacaagtttaaaaccaatttagtcacacaacaataatgtttatagctccagcataattttgtgataacttcaatattaaatatatagttttgtgatatttaaccttaaatatgtaattttgtgataaatatggtgttaaatccgtacttttatgatacacattttaaatttggatttttgtgataatttaatcaaaataccaatagttttatgaaatttacttatttttttattaccaaaagagaacatcctaatggggcttgggggtaaaaacccaccggcgcaagggcgatgcatgtgtccactgcagcgacggaatcatgcagatgaaattatcaagcacatgctccgcctcgccaactgaaacacccccacacgggatggcgggaatcaaacatgggaggaggggaataacaacgtgctgaatgggggcctaccggaacaattgagcggtcaaaacgtccttgcgcgcgcacacggacgtgacacgcgacctctcaatctctcactcatatatacccaacccaccccttatcacgggcgacgagacgtcccgctggtataaaacggccccctcccgggacgccacgatcgtcacaagcaaacgcacgcgcccccgcctatgaaagcccgcgcgcaccacgcacacacgcacgcacgcagtcgcaggcgccgcagctcgtctccatgggtgtcgtcgaggcaaaggcgttgcatggggcggtggaggccctggctgggtcgctgcagccgcacgtggccaccgccttcttcgtgttctcggcgtgcacggtggccctcgccgcgctccttgccgtggtgcgcctgcgcccgccgtggtggtgcgactgcaccgtgtgcgaggccttcctgacggcgtcgtgggcgggagagttcgacaacctctgcgactggtacgcccacctgctgcgcacctcgccggcgcagaccgtgcacgtgcacgtcctccgcaacgtgctcaccgccaacccggtcaccgtcgaccacgtgctccgcgcccgcttcgacaactatcccaagggcgctcccttctccgccatcctcgccgacttcctcggccgcgggatatttaacgtcgacggtgacgcgtggctcttccagcgcaagctcgccgctgccgagctcgcctctccggcgctccgcgccttcgcggcgcgtgtcgtggcctccgagctgaggtgccgcctcatccctctgctccactctgcttcacgtgagggcaacggcaaggtgctcgacctgcaagacatgttccgccgcttcgccttcgacagcatatgcaagatctcgtttggcctcgaccctggctgcctcgagctgtcgatgcctgtatcgacgctcgtggaagcgttcgacacggcgtcgacactctccgcgcggcgggcgacggtgcccatgcagataatctggaggctgaagcggttcttgaacgtcggggacgaaaggaagctccgggacgcggtccgtttggtcgacgcgctcgcggcggaggtcatccgacaacggcgaaagcttggcggcgctgccaccggcagcgacctcctttcacgcttcatgggctccatcgacgacgacaagtacctccgcgacatcgtcgtcagcttcatgctcgccggccgcgacaccatcgctcggcgctcaccgccttctttctgctcctctccgatcacccagaggtcgccaccgccatccgagacgaggtcgcccgcgtcacgggcgacggcaaccgaaccatggccgccacattcgacaagctcaaggacatgcactatgtgcacgccgcgatgtacgagagcatgcgcctgttcccgccagtgcagttcgattccaagtttgccgccggcgacgatacgctgccggacggcacggtcgtcgcgaagggcacccgggtgacctaccacgcctacgccatgggccggatggagtccgtatggggccccgactgcgccgagttccggccggagcgatggctccgggacggccggttcgtcccggagagcccgtaccgttacccggtgttccaggcgggcgttcgcgtctgcatcggcaaggagctagccctcatggagatgaaagccgtcatcgtcgccgtcgtccggagcttcgacatcgaggcgatcgcgcggagctcgcggcggcccaagttcgcgccgggcctgaccgccacgttcgcaggcggcttgccggtgagagtgcgccggcggcgagcacgtgcgagcgggcacaacccgccaatttaataggtagagcaaacaaactggttcgtgtcatcacgatttgttcttctgtgcttcttttcgaactggaatattaattaggttacatgcatcatgtcgattatgatcgatgactccgtgaccactcgtgagtggctgagtgcgttggcacttggcagcaccaaacttgatgctggacgactagtcagttgcctccaccactcgagatggagcggtagattctgggaatcgatcgattgcgaacctatcagaccaaatcgcgcgtagcccgactcgtctgcgatcaaatcaatccccggcgccgttcgatcggttcattcaaagaagaacatatacgggacaaaaatggaactggagaagaggaatcagcgaacggcaacactgtcgtagacagtagagtagactcgaagtcgtttgctagctatagctaagcgcgcggcgcaaatctaatatgatttcctctgcgtggaaagagatcaatttagcgattattatagtggtaaattgaaatgcgaggcgtggccgtggcacagaatctaggcgtggtagctagtgagtatagtatgcgacgagcaggcttttggagcagaggcgcagagcgttgcacgcatatgttcgagtacggcgacataaacagatgctaattcttggtggtcggggtgggtctcggggggagaagaaccaacgcggcgcacatgtgctcgtggggcggccgctggctgctcgtgttagatcctcctcgtggtcctgccgtccgtcccaacttcgtctgggcctctcgccaaccaagtgccattaaactagtacgcagtaccagcagctgcaagaagcccgggtgcacgttttcttttgcatccagagcagccaaggacgcaatggcagtaaaagataggtaaggtggggactctctccctttacttattatccttcttgatctacaggaactaagctaggcaaattccatggcgcttccgaagaaggcagacctgagatttccacatgccaaaaggttaggatgccaagtgccaataagactccaactccacgcttgattccgttcatcggctgtatggtcagctcgactgtcgatcgatcccgtcaaaattgttacctccctctcaagttacatataagtaaaaagttgttatgttttaagacaaatgtgataagtaaaagtttgagaagagaatctcgaaggaaaaagtatgaattacccccctgaattattgtggttgaccgaattatcccctgaacccgaaaaccagacatttttcaccctgaactttcaataccggacgatttacccccttcgacccaaaccagagcggttttgtcctacgtggcgcatgcgtggcaatccagtcagtattttctctttttttttaaatggtggggcccacctgtcatatataccctctcatctccttctccacaacccctcttttactctctctctctctctgcaagcaggggcagctcgcgacggcgggtggtcagcgcgcgcggaggcgggcagtcggcggcgcgcggcagcggagcccgacctggatagctacagcccaccacctgggatgctgaggcgtcggcagcgtgggacagagccagcggcaaggtggcggagctagtgatctgccccatctacgccaacctccccgccgagctgcaggccaagatcttcgagccagcgccggcgggcgcgcgcaaggtggtgctcgccaccaacatcgccgacgccgagacgccgtacaacccgcgcacagcgatggagtcgtttctcgtcgcgccggtgtccagggcgtcggcggagcagcgcgcctgccggtcgggtatccaggtccgagtagcagctgccgtagctaggtggctgggagggtgaaccggtccacgccgccgccgccgcctccgcatccagtgccgccgccgccgcctccgcaactgctgtgattgacgaaacgttgggtgtgctttatcgatcaaatcgtgtgttaatccccatttgcttcggctggaattgcaacttgaccaccaaggaaaatgagcatgaacgtttacttgttctggtccatatgaacacattctccaagccatgcggtgttcgtctcgatctgtaacttcaaccagaattcccaatgccttccaaggacaagtgtgtgcgtgcgcgcatgttcaacaccatcatatcactatctaaaatgtgattcctccgcatcacatcgccgtcgccgatgcggacggcgcaggcggtgccggccttgaggcctcctgctctgcttccaggtcgaccgggacagcgacaccatcggggcgtacgtgtgcaacccaacgacaaggcggtgggcctccttgacgcagccggcgaccccgtggccccgcagacacgacggcgcgttcatcgccttcgacccggccgtctcgcagacacgacggctggcttgtggcgtggttggacgtacgccgacgctggatttgctcataccggagtcgtcgtccggagaagacgagctagcgccgtcgccggaggagaggacgttgcttctgcgcgtgttctctgtgtcccacgctgccgccgcctccgcatcccaggtcgtgggctgtagctgccaggtccggctccgccgccgcgcgctgaccacccgtcgccgtgagctgccctgctcgccgagagagggagagagagagagagtgaaagaggggaagaggagaaggagatgagagggtatatatatgataggtgggccccaccattaaaaaacgagaaaatactgactggattgtcacgcatgcatcgggtaattcgtactctttccaatctcgaaacccatgcaccacgaatctagagagatggagtgcgccatcacaccttgcattggttttacacgagtttgttggatggttgcgtttgaccctgtcctcccgcatcaaagctcataagatggaccaggtcaatcttcagtgtgtccagcagaaacaatttcttgtcagacatttccactgtaaactggtagcagtaaatggtttttgccggcatccatttcgtttggtcccgtctgtagatttttcatcggctgaaaatgacaatgcgtgtgccaggattcaggattcaggttaaagctgcagtttcctcataattaaaagttttttcaaacaatctagtttttcatccagattttagaaagatgtagtgatagaatttagaaaatgaactaaaagttttatcaccagctgaatttttacccactgctccttaaaatctatagcagtagttttcaggtgtgccgaggacagccaagagccaacaatctaggataagaatggttgaataatgctgctctgccgtatactgtttgaatattttgaccgtgtcgagtggcgatggcgacttgtgtgatgacgacgtcgttccattttcacctttgaggttttgatcgagcggcagtgagctgtgtaaaagaactgaattcatgacaaattggctcgttgctctcgtgtgtatgtgaactatgaagacccggaaatactgctcctgtgttgggtttcctgtccaagctctgcactgaaactccgacagactcacagacagtcacatcccgtgcgtgttgctcgttaacgatcggtgtcgcgtccgtactacactataccgtaccagtgtaccacacactagcgcgacaactcgtcgttgggtttcaccgttattgcttcgacaactcatgcttattatgcctctcctgccgtatcattcgcttcccgtgcaaaggcaatcatagagcccaaccatctccatctgaccgaagccggcagcttttctttttcctgcacgaggggctagtgcgtaccggagcatcggtcccgatcggatcaccgggcactaggcgcggcgtagattctggccgatctagtccagcagtccagcccaccggaacaaaggcttcaggtgtgtgcgtcaagcggaaagtgtattcaactaaacgttggaactcagctattgctctctctcgaagctccctctcctcaaggtggtcgctgtcgccgtcaccggcgctggctactctcgtcctgttgtcttggtccttgtcgtcggtgagctgaggcacctgggttcttcccctagccgtcgtgggtgtcatcggttttgcacaaaagaaggttacaccggcctacaatttcatctctgccaagcactatccaagccaagcagcctcttccccaaattccgacaagagttcataaagagatggttgatggaatccacaagtttgccgagaggccctcaacctcccattcaaggaggcccatttggatatgtatcttggctcccactgtgcttttattgttatctttgctggtgttttggatatagctgtttttcgttgtgcctattgttatgttgatttctttcaagaactcaagtggaaatcttctgtggagatgccaagtttttctcttttcggtccgacgcttcaaccttcatctttgggaggcccctccaaggtttgtgtgtgggatctacatcatgcagctcacctttctacaagcaccaccgaagctgagctccaagctaccgtcgttggcggttggcgtcgacagcagatcgacgagaaggacctgttgttttttctacttatgcgtaggtctttttctacaaaatgttgtacatatttgtaatttggtcattctagagggccctttctgcaaaactggttgtaccccagtaaaccgtgctatatccgccattccgccctgctactcgtgtaagtgtgtaacttgaccctagttctcttaaataaatactccctccgaagacgttaactttttaaacatgttttatcgttcatcttatttaaaattttttttaaaaaatatgtaaaattatatgtatatataaaattaaatttaacaatgaatcaaatgatatgaaaagaattaatagttaattatttttttaaaaaaaatgaatgatcaaatatattttaaaaagtcaacggtgtaagaatatttatgtatggagggagtacatgagtttaaaaaaagaaaaaactaatcgttggaacctaatttcgggaggaggagatttgaccaccccgctgtctcgcggaccacatcctccagcaaaccggcttcgctatttgccagaggaattctgcgtgcatgcagtgatgcagtgacggaaaagcgggagcacattggtactgcaatggtaaagtaagatgttatctataaaacatgtacatctcagcaatagactaaattaatagtaaaccacctcaatagtatgtctacatgggtatctataactctctaatccattgcctcgtttttctctatagactatctctaggttagtagataactttgctctctctctccatttaatctcttccaagtaggaaaatatgctgacatggatctcttgtagagagcatatagataaccattgtgggtgcccttagggtctgtctttttctttacactatcgctaatggcgactttggatgctgacgaaagggcacccggagtactatatggtggctaagattccgtcgaaatgatgatacagcgctgataataataaagaagataagagcaaatataatagagggctataagaaggctgaatgctgatgtggatgagagaggagaggagagagatgagaagcggactgtaagtttacagccggcttaggcacaagaaccaagaaaatctgtgagacagacaggtagaccatatatttatagtgaagagttaaccattatatgaatgagctgatagataggctacaagtaagcagctggctgtattattatccttgctctaaaggaagtttactagccgattgattgttcattgtcttgcagaaagtcagaagctatatgggcctaatgtattattacgctttcagcccataacttcaggcccgtatagatctcaataggaaaccgacagaatatccgaggatggcgggccaccgactcgattgaacaaccccatctgcgaggtccagggatacggatgccggttggctcctcttccgcgactccggcgacggaatccctcccccgaaggagccgttcggttaatcctgagacagagattaaaggaaatttattggaattattctctcttaatccccttcaatcatctttaatccacttcaaaccgaacaaagcctcagggaagaattgaaacggatttattccacatctattgtggtgtggaattattcccgctcaatccttctcaataccgaacaagaccgaagcgagctatttctccgtttctttcctaaactctagctacggtggtgtttgaatctcctgaagataaagatgaagattaagtattttacgcaaaatgaggtgataataacatgtgactaattgggttttagttattacaaacttgaaaaatggattaatctgatcttttcaaacaactttcatataaaagtttttgtacgaaacgcaccgtttagcagttgaaaagca

SEQ ID NO: 53606 - DNA, 1415 bp, Oryza sativa
ggtttttctgctccacagctccactccaccccaaaagacccactactatttaattttttagtgtactagaaaaaatacccgtgcgttgcaacgggtaaactaaaattataccaaatataaaatattatattattatgttgagttttacattatatgggcctttaagaaaatatatttctagagaaataatgaaggttaaaaaaaagaaagaaaaggcctctttagagtatagacccgccggtctgctagtgcattcgcgcgagtggcccaacagcccagcagtgttgcggcccgggaagagaggccggcccgacacgggatcaacctgagccgttcattttcatcgatggctcggatgattctgaatccatcaaaaccgctaaccctaaccctcattcgctgacccctttccttccccactgcgacccacctccctccctctctctcagcgcgccgcctctccccctccctagcggcgtcgctccccctccacccaccagcggcgccgctccccctctctcttcctctgaccgtccttcccctcatcctctctctcgcctctcgtgcgatgggtccggcgacggcgaccgcgggtggatccggccgcggtggtggcggccgaggacggatctggcggcggcggctccgtccgacccctctcgcctccctcccacggtggatctgacggcactgacggtgtcggccccatccccggtgtggcgacgcggctaggagcggcggtgggctcgggagccggtagcggccgaaagcagcgatgcggacaacggcaacgacggtggcggcgaatgacgacgaggagagcgggtgtgggaggcggctagttttttttttaatttgggatgttgattttgtggggattcttgattttgatttgggattgcaactgagtgattttgtggttttgggcaaaggggttgggagcaatcggttgatctactcgtggattttttttatggtgtatttgagttcttgtggatctctcttctgactttatttggttggattagagtccgattcttttatcttttttagaaaaatcgcaaaaaaccgcacggggagggaatcagactgcgcatcgcattatactcggacgacttacaaaaatccctggcaaaaacatcttaaacttatataatataggtaaaaataaagataaagatagagtttttataatataatagagaagagatatagattaaaaccaaaacataaaattaaaactgacttaaatacggatgataaaccgcgaaaacattttcaatttttataatcgaatcaaacacggatgacggaccctaaaaacatctttaatttttataatggtagagatagagatagagatagagattgagattttcaccacaatgccactgaactatcctttcataccacat

SEQ ID NO: 53607 - DNA, 1426 bp, Oryza sativa
atttggcgtgctttggttaattgggccgatctcaagcccttggcggaacttgcacttcttgaccccaaaaccccacaaggcataattgggccgattccctcctatattctcgtttcccgcggctcaaccgctcatcaagccctagatagggctctctctctctctctctttgctcgattcgcccgcgatggcggcgccgccggaaggcgacgggggcgccgccccagactgaaggagaggaggttaaggatggcgtcgaggtctgcgtatttgacgagtcaccggaggtcttctccagagcggtgcacgccatctcggagctcacaaccggggagcacgagccgaacttccctgacgccgaagtcgagcggctcgcctcctcaataactttcctcaggtgagaaactccctccttgctctgtctaatccggtacctaatcaccgcggcaaaattggtaactttctgttgttggcctatttagctgggtggagtggacgaatttgtgtttaatagtagcgtttatcagcaaagcattaatttgttagtcattgatgcaatttcacggagctttcaatgggaaaatttatgtggcatgtaagctctctgtagtttattcattgccttatgtgccacacacggtggcaaattttattggaatttgttaatttagatcctaagacatcgctgccacacaaacagaaaaaaagcagttgtcacaggaatgctttggtgccgtttcattattcctgttgtggctattagaattcatttggcttttgccactgcaattggccatattcttacttccagtgtccttaggtaacaatattagctcaatgcacaattctgtttttctattgattagaacgatacaaggattttttttttcatgtcatgaacaaaatgcagttgcactgttacttgttttattactaattcactaagtttaagtcacttttgttctggtagatatatttccttaatctgtactcatttgttgtttgatgactctgatcgatgatcatttatgcacattgtgactttctagctaaccatttgatgttatggtttaaggcacagaggagtagcgaaacttgatcccctttatctataagtcactaagtcagtgagccccacctttatttgtgcagactacttgttagctgttactttgtattcaggattggcagtttcagtaacagctttagttattagcaacctatagtagcatgctataactagttagtactctttgatttaatcaccaattaaagtagaagaaaatatttatgtgcccagtgttcaccagaaagatttttttttttaaaaagcaccactcactgtgttttagcacccaccaatataaggatgttaaactcaactgcagactgatcagctggtacagccatacaaaggctggtcagg

SEQ ID NO: 53608 - DNA, 1210 bp, Oryza sativa
tgatgaataagttttactttggaatgcttatatatttgtgaacgaactttagatacttcgaatacttatatctatgaatagagggagtagctttctcggtttggtttggtcctatttcttcctcacacacgtagccagattctactccttctctctatgccaaaaattattctgcttatgttggtatccgtgaaagggcatatagcctagtggttgcagtgagctgaataacactccaaggtcccgagttaaaatctccataggagcgaatttcagattgggttatttgagaactaagtttcttgttcaataggctaagttcctaatttaaaaaaagactgcatatatctggttgggcccaacccgtctctctgcatgctctacgcacagccaatttgaaactgcatgcatacatcattaacggggctaatctcgggagaaacagaacaaatttgaacatgcgccttctattgtgggacaccggtagaaatatttagcgccctctaaactgggacggagggagtatttattttccatggggacatctcactgttccatttcttctcatggtgatatctcacgcgatctgtttttgcttccttatccataaaaataatgtgagataacaacacgagggaacaatatttccatgcacctagtttcgctataagagggcgaatatggtgaggtaggccctagttagctgttcatgtgaggaatctttattgtattttatcctctataatttatattttctctgagacatttagaaataaacattgtaagtaaaggtaccatttcaatgttttttccctactaggttatgtgctctttagaccgttggatcacctattatatatgacaactctaatagtggaccattggatctcaagtacctacggcaaccctaatatataaagcactaccaagttgccttctctctattccctcgtcgctgttttgactattcatccacgtcatcgcaccatcaccaacctagcccacctatgagccttctccatggatcactcttagatctagctttttgcggtcttcgattatggatgaagaaaataggttgcaactaccagtgatttcatcactcaatgttttggtgaaaatcaggtactacctccgttatatgttataagactttctagcattgcccacattcatatagatgttaatgaatctagacggctgcaggaat

SEQ ID NO: 53609 - DNA, 1707 bp, Oryza sativa
ttttagtgtctacttattgaatgtgtgtcactaccttgttttgccagatgaactttgatatcagttttatgctctgggttgacgtttagtcaggaacctattggagtgtgttcttcatcagttgtacggtgtgcccactcagtcagtcagattagtttccattttgttattgcctagctgatatactgtaatgtaccactgttgatttttttcacgaatagccactgcatgttttatggtgtttgtagatttacttatatcctcttctacaagactggctcgcctactgcggagatttgttttggttacttgcaataggtctcaatattcggatcaatctatccttatttcttatgtgaaatagggaactcagggtagacttcattatacttgctggttacgtgaaacttataccggttgagctagttcaggaatatccaaaatccattttgaatattcacccttcactactcccagcatttggaggcaaaggttattatggtttgaaggtgcataaagcagccatctcatcaggggccaggtacttcgcaatttctctatcacccatcacaagcaactgctgtgcagtttgcgtatctactcaatgctatttccatggaaagcaatatcttggcagttaatttaagctgatatctcacattgtagaacaaaactaaagctcaactatacataggtactcgggtccaactgtgcactttgtggatgagcactatggcacaggaagtactctagcccaaagggttgtgcctgtgctagccaatgatactccagagcaattggctgcaagagtccttcatgaggcaacatatcttatgctcggctaatatttctttgatggaaatggctatgacaattcacttagctgcaaatgcaattgatgatatacgttcttttgctcatttattaaccttacttttcaggaacatcaggggccagaagctggcttttattaagtgcaaatgaatttggatcacaactcaacacatataagtagaaaacgacgacatataccacctaattggacaaaaggattgttggtaacggtgacgccaaaaacacaatatcaacgaggatacctttcagacaacaacatctcctcttccatgctgtattgtctgctcatttccttgcttccctggcctgtaactaacatgtaatgctttgtaatttcagatgcattacatctacttgattttacactatgtgaagcaagcttcttcttgactcgcaagttttcaagtgtcatttccacatctctcatagtaggccggtcttgtccattcaatttagtgcatgttgcagctagtgatgctacttcttggatttggtctccatctccctccgtcatgacttgtggatctattatttcaaccacctgaccttgtctatgaagcgaggcaaaatataacacaagactttcaccgtgatcagtcctatacatgggcctttttcgagtgagcaattctataagaagaacaccaaaactaaaaacatcacttttatctgttagatgacctgtatagtagtacatgggatctaaatggccaattgttccctgaactgctgtagtcacttcagtttgttcaatcggaatataccttgaagctccaaagtctgatacctttgatattaaattttcatcgagaagtatgttgcatgccttaatatccctatggaatattggta

SEQ ID NO: 53610 - DNA, 2859 bp, Oryza sativa
aggtttagaaattactacgctaatcatagaaaaggaagatcatacaccgttgattgtagtatgggtacagattataatagtctacactaaaccaacgaattcgcatagagatacactataaaaattctgaaatttggaatttataatatagaatatagaatattaaaataagaacgtatgtggaacacaataccacttttagagtaaaagaataaaataaaatcatcatttaattcaataagaatatctaagtgaaattaaaggacaggtaaaactcccaatgaaacaaaaatattaattaataaatatgtaaagaagtgtccttggcaaatacatattaagaagagaccattttaaaaaatacattttataaatactagtagaatttataggactaaaaatatttaaaatatcaatactgtaaaatgacatgaaaataatattattcgtaataaaaacaaataaaaaaatcaactatatttcatttcattacaaattatatagtaaaatccctatataactaaattttggaatagaaataaaagtaagaccaaacatattaacataagagtccatgccaaatacaatccatgagagtaaatgatatttttattaaaaatagtaattggattgcatgcaaatttcaaagtagaatctttaggtgttatgatttggaatataacaaaaagtaaaaaataaaaaaagtcaacatcaaacacaaacaattggactttgtaatagaaatataaatatttaatttagtttgatacaaattctaaattagaatcaatatattataatggaaatgattatgtggcggtcaaatggagaaaaaatgataacatatcatactatccaccaaagtaaatgactacaaagatgaaggcaattgtctatagtattgaaaagtgaaaactttaggtacaaaaagtttgtcagaaagaagcattgataaatagcggatagatttatttttttgattatttcaatatagagctagtgttacgaggagaggatggagaaatagaggtttacacaaccagagtaatgatttagcatctctagtgatattaatatagagaaattttatagttaatatatcttgaggtacctaaatttattaaaaaaatttggtactccatatgttgaagtaccaaattttatataaaaaatacgataccttttggtactttctcaaggattgtaaaattacccttaatattaatagcacttggttgtgtgtgtaatgtgatactggctattagatacttcttccgtacttgtaaaggaagtcgttttggacagcgacacggtctccaaaacacaactttgacttctattttctataaaaatatttattgaaaagtgatatatgtatacttttatgaaagtatttttcaaaacaaatctattcatataatttttatattttcaaactaaacaacttgagagttattcatgatttatattcccaagatttaacttaaacattgtcctaaacgacttcctttataagtatggagggagtatactccatttataaagatatagaaacaaatattcaatagattcgtgtcgcaatggacaagaattgagagaaactaaataaccaaatgtctcattgtaagtttgatcaaaaggaaagtagaggcaaaactttgaaataaatctatccttgtacagatttgtgggcaatccaactagctagctagttttagttcacctttgcatccatcttttggcgatggattgccctcgtagccacgagggcagttgcaaatgaacgatcctggtgtgttcctgcactcgccgtaactgcagtatccagaactgcattcatccgtatctagcaaacagcaagggcgtatatatcagttaggagttgtttttttttcttcattttgaacggatataggagtatcagttaattagaagttgattgttgaagaacatgaagaaattaaagcagcaagggcttatattaattaattaccatggcatccatcaggaacgtagggatttccttcgtaaccttcggagcagcggcagatgtacgccttgttgtcgtaagtactgtcgcaatagctgtgcgcgctgcgacattcgggggcggacgcgggcaacggacacgctgatgaactatttatgtaccagtctagccgtgctgggagctcttcaggactgctgtagccgaaagacatgtccaaggtatagttaaatctctcatctaccaagtacaccagatcatccgttcgatttagcacgacggcctgctcctgcaagttctggacctggatgctgtaggcagcagtcgagcttcctgctagtagcatgcttgtttcacagcagccaatccctgagcatggaccctctggaccaatatcgaggatagtggtagcaccacctccatcgtctgttgggcagatggcagtgcaggaactgagcaacttagtactagttttgttgttgtttctcccagccgcgcggacgtcaacccgggcgttgcagcttagcaaagctatcctgtttgaagctgccacgaagtacggccttcccacctgatccaataatgatctgttgacggcatgattgccagtagaattgaacaccatgcggccgctgttgatgcgcacggtggcttgggggatggcgatctcgagcacctgcaccgtgccgtcgccgaggaatagcctgggcgggctgtaggagtggttgcaggtgaggttgaagcctgggtggtagcagccaggctccacgcagaacgggtactcgatgctgatcccgcctgcagctgctgctgctgctgctcccgcctgcagctgctgctgccatggcaaagaacggtagcaacagcatcag

SEQ ID NO: 53611 - DNA, 2544 bp, Oryza sativa
acggtggcgttttttttttgttcgccgagaacattttcgcaggcaggtggctacaacgcttgtgaagatggagataccgcctatcaaaatcagccaatgtccgcttgcaaaaatcatgtattttcataggtcttgaagtgcaggcggggtggatggccatctggaaaaatcattttggcccgtttgtaaaaaaaaaatgttttctaatagtgtggtgaaaataactataacaacttgtaaatcatttgctggtccatacaatcaatttgaacaatttggttatttgaaatgaataatataagagagtgtaaggttttatattgatataaaaggaaaaaaaatcacaagacaaacattaattcattgaaggctatgatcatttattacaaatatgatggttaaagctttatgccatcagtacttgtaagtactaactaagtactacatatgtcccataacaattgtatttttaggatttaaatttgtctcaaaataattatcataatagagtactaacgatgtgttaacgaccaaatttaatatatcatagattggatttggagtcaaaaccgaagcggatttggaaggagttcgttattctcggaaacagagtacgcatcggatcgtttgcaccggctaataccgaatcggatagggagaagccgatgtagccaattttggcaaagtgatcttagaatcattgtcgggattgatttaaatgttccacaaatattgccaagcatggattgagtccgaagaaggcaattgtatctattaattaggatattctagtagtttcttcatagattttcggtaagagtctgcctaaagtacttgttcgtattttagagttgtaatagaagtggagtcgtgttcgatgtggacatattgtatattttgggtataaatatgtgcccgacaccttgtaaacgattaacaccagttcaacaacactttcggcgcatcgccacctttttctactttcattgtttcgacgagttcttgctttcgagttgggctgcatcggttacgatctctgacgagaggtaaagcttgttatggcgacttgcgttctcgggattagtgcttacatctttatgacactctaatcttgtttatgtaaatcgtcgagttatcatatatgctatataatctagattgacattactatctggtcttgtcgactagcctccatcatcgagatcagccgatagaattagataactctgtcgggttagattatatagtatatccaccatctcgaaaaggctttcattggtttgttgatcagatcttatgtttctctttatgcttaatgctgcatcagttaagtttgatctattaagtaatatctagaaccataatatctaacttgcttcatgattgctaacagagatagcatcggagtttcagcctatcttacccggtttagctatcttgttcttcacttatatttacttgatatgctaaatctaccctttatattaagatctcactaaggtgaaatatattacgcttgatattgatctacttaggttatcattcttgtttaatatatttaatctataataatatcttagtataaagaagtattggagcaatagccaacacacgctagatttacctattggctgacatgaacttatttaatctttaccttgaagtacttttaaacatatgttatttatactgtctcggcaacatccgatctaccctgatcacgtagtttaaacatattttgaagtatagattatacattgttaatatctgcagccgataaagtgaatttagttctttatctactatatactttattgccgatccaagttatattgcatcggcttgatatctgacgaaacgtcatcggcaatccagccgatcggctatcgtttatagatttaactttggtttctttttttcttgttggttgcaggatcaaaccaactggcacgctctaaacccgaaagcaaatttagaacctgcactagagtaaagcaaatctcttaggccagtgtgtgtttttttttgcatcaacacgatctcataaatcacttctcatctaaatttctttctattttaccctttcattcttacctacaaaccattcaataagggtttttcaaagcttaatatatgttaaataacttagaattacaattaatttgggatgaaggtagtactaaataatacacgtaaagcgtcttgcactacgccatatcctcaacctttgacgacatacctgtgatgggcataagtgttggtcagtgatgaggatcacctttgacaggttctacgggatgccgccatcggtaaggcatccggctacggcccgtcacaggtgactagatacctgtaacgggccatacagatccagcccgtcaaagatgttatgaaaccatttctaacgggtcctctttttttttccgtcacaggtggaaaccacccaacccaatccttatctatcacccaccgacagtccgagaccactcatctctcgtttcttagttcttccttatccatccccctctctctctctctctctct

SEQ ID NO: 53612 - DNA, 10652 bp, Oryza sativa
  unsure (1)..(10652): unsure at all n locations
ttgcccgatccagcggcagcctcctccaccgcaccgccaaccgttggatccggcggcctctacccctgaccgccggcgtcgtccaccgtctccttcacccactagctccgccgccatttccagctcttataggttgtgcaaattttcatttccaaatttcagattgggttatactcatggttgcttctgtggatttgtagtttattactcaaagttgtgtggatttgtgatgtatattacttgtgtggatgtgcttcatgtgtcaacatatctgtcaataaaatgcaaagttattgtgtcatgagatcttgagatgttcttcatgtcatgagatatggcctgagggctgagagctgagagctgagagctagaggctgagggctttaaatttttttttgttgattttccacacctgtgacgggtggtgagttgaacctgtcagaggtgtttattacctttgatgggctgaaaagattcactcatcatgtgtgagtttattttattcggtccgtcaaaggtgccaatcatcattgacgggctttcacccgtttgagatgagatgtagtcatcagtgaccactaatcagtgaccaagaccaaatccatcaaaggtgagggttagagcccgtcacagatgataggatctggcttagtgttggaaaattattttagtcatcggattgggagtccactcacttattctttttaaacggtcctcttgtctattatgtcaactaaatgacaacaaatctgaaaaaataactattagattatatgtaatatatatttccaccgtagtaagttggtgttcaagttggaggtcacgtgcatttgaagagatcaattaagcatccgtgtttgaattatactccatcgagcttgcatttaggggagatcgactgatcgagtcaacgtacatcagtgtcagccttacttatggtcggcatacttggcgcgtatttctaaggtacacatgtgtacgcacgcttatactcttttgaacatgaacaagctacatgtgcatcttcttcgtgcacttgttcactaaatagtcaggattcggctgtgttcgctagaagcggttcccatccggaacagtgatcacgaaaaacggagcggtccattagcgtgtgattaattaagtatttgctattttttaaaaaaatagattaatttgattttttaagcaactttcgtatagaaagttttttaaaaaatacaccgtttagcaatttgaaaaacgtacgcgcgaagagagagagagagaggggttgggaacataggattgcaaacacaaagataatcgggtaagccagatacttcgtgccttcatggcacggcagcacccgtactattgaaatggtttgtcagtagagatgttaccctttgaggtaaaccattctcctatattttccggttgacctcaacagcacaataattaaccactttcttcccatttcaaaaatcaatttactttaatattttaaaaaaaactttacaaaaacatgcagcgtgaggctatgggtaggctacgggtctgtttacattactgccaaaataaaattttcaaaatttggtaatgacaaaattttgataggttgacaacattatcttgttttgtatgataggttaaatgtgttattgcaaaaaaaaaaaatctctaggtattttgcaagtgagcggagctcaactagttaagttacttgtggtggaaccaacccacacaggatcaaattctaaatttgacacggatgctcgcattacggttaattattctttcggtgatagacgacgtattcatcgatagcgaggcgccagtggtgactccgtttatgctgtatttctaaaaaatatctctaggtattaccaatgtttggtaataaactaaatacatccacatttttatcaattttataaaaagaaaggtactgttcttctaaaacaaatctctagctattaccaatgtttgacaataaactaaatacatccacatatttatcaattttataaaaagaaagatatgatttaaaatggtcaatctgaagtgtcctatatatccttgcaaacacgttagatcaatgaccacggctctagcatggcatgcttgatgcttccatttttccccaaccttgcagcgtagcattatgaaaagggaaaattttctttcgtgtccttgagtttttctcaatttcttatataccactaaattttatcttattccttgcatccacttggttttcatttcgatctcatcttacccatttcataaattgaccgttagtttatttttcaaatgattttattgccctctctcacatttatgtgctgatatgctagcataccaagaagaacacaattctcgacatgaaaaaacattcagggctcaatccgaatgagccacttcagcatcgttcagattaaatgaagggaaaaaatgaaggatttcagttcctatggattgcgagagcactacggctcggacgtccaatatatcaccaaatatcgaacgcccagctcgattgtgtatgtgcatgttgttgcacttcattcttcactcctcaatcatgaggaatcttcctatccgacgtcccaagtcctaaagaaaattggtttgtcaaatgttctagttgaccaatgagtgaaacatcaaattatatatggtgaaacaaaaaatcagcaactgaaacatttaaaaattttatgaaatatgatgaagatacacgttgaaacatatcgctatcacatataaaacaactagtgttaacggattgaaacatatgtttttctttcatcaaaatataattatgtgatatcttgttgtaaatatttaattacaacaaatataacggtgtgatcggatcatatattggataattagtttatgagacaaattgttttgaagctcgttaaaatgcatacatgcgtgcatgtatgaggtggagagagaggagagagtagtgaaatgtagtttcacgaaatttgtgaaacatgctgaagagatatattaaaacatatcactatcgcgtatgaaacaaagagtgttaatggattgaaacatatgattaattttaatcagaatataatcatgcgatatcttattgtaaaacgaatacaatggtgtgatcggattgtagattggataagtaatttacgagaaaaattgttttaaatatcgttaaaggtatatgtgtgtaggcttaaaaggacgtgtgttagagtcagcccgcccgatttttcttgttcagtccgaacgttcgaggagaagcattttcgtatggatcgagattaagccactttagcatcgttcggattactggaatcggtcataggaaatacataggaaattttcctatattagcgatttcactagaagatcacaggaaaaagattgttcactagaagatcacaggaaaaagaacaatctgcgaccaacctcttttttctatcccttcgcgtgggaaaaaggaaaatcaagccaagcaaccaatcaaagcatgataaaagcaaagtgttcattgatattgcttacttcactgtttgtgacgctatgttacattgcactcgcttttattataagattcccatgtttttcccttgatccatccaaacaattatccatataaaattcctgtgttttttaatcatctattttacacttggattcctatcatattcctgtatcgtatcttactgtaaagttataaataactaattctaaaactcaacatgcaaacatgccacctcatcatccactagcaataattacatacaaaacttatgcaagcttgcaatatcatctataattcattgaattttacaaaatcaacatccaatcattttcattcacattatcacattatttttcattatatactccgtttttttatttgatgtttccgacacgattgaggaaattaaggaagctgcaaattgactcttttgcccttcgttcttatctcctttgcgctacggtgtttcctccacgcgcgccggcggcgagacgagcactgccggtggcacctcggatgagtccggcggcggactatcactccaccagcactctccaactgctacacagcaggctgacgacggcagcgacacagccatcaagcagggcaaggcagggtagggcaaggcggcaagcagacatagagcgaggcgggatggcagccaaggagcaaggcggagcaggcggccatggagcaaggcgacgccagttgcagattgtcgtcggtggccgcggcgccgtccccgcctcctcggatgagtccttcggtttcccgggcggccatgcttcagccttcaggtcaacgatgttggtactgttcctgaacctggtttgtgaatcttgagatgatattgttcctgagaacaatgtgtgcgcagtttctctctctctctctctctctctctctctctctctctctctctctcgtgtatgctgcagattagtgcacatttgacatggatgctaaacatatggtctagagaggagatcgagctgagactaaattcagaaagaacatttggtgaaattcagagataagttcagaccaaattcagcactctgttaccatgtggatgattacacatagcatttcttcaacaattggctgttgacttttcatgcaatatgacgacgtgattgatggcctctgcatcttcttgcttttattcgcctgctcatagttcaggtggtataaccaaattatggttgaacaatcttagtaaaattatgctttgtcatcatgatataactgtctaagaatgacagtgaattccttccaatgtggccagaagaagaagaattaaaaggccattcatgtttcagaactcaatttgggcaaactccactttaagaatgatttgagatatttttgctggagtaaaaactctatttttatgcatgagttgtaaagatgctggaatgatggaatgtgggatgtgtctgagaatgacatgtactcctttcttttctctatgatgatggaattgcaaaattccatttgttgcctttaaaggcgatactgttaaaatctctcatctcatcttaaatttcttccaagtcacaatatttcaatttactcaaattgccagtataatgtgatttactgataatctgatactccaatcatcagtaagaagcaactccaatcatctgtgggttggaagaaaatcttcttgtaagaatacaatgcttccattccgtctgaagaacactactgaacaccttgggtagctgctcttggactcatcgatgcattgatccaactcctcaaacttgtcaagagatacctccgcgtctctggcgaggccttctatgcaaaggccacaaatgctggcgtcttcttgcatgaggatgccatggccacaacatgaacatggttgtcatgaacacagcaatggatgccgcggcggccatctcgatttcctcggcgatggagccaaagctgaggcgcggcgacaagtgcttggtggcagccgcagtggcggaggcgaggcggcagagctccttcggcccagcattgggacctgacggcggccgcgagcctcgccttgcggcgttgcccctccgcagcaccgcctgcgcctcggtgacgtcatgcctgagctcgaggacggcctcctggaagcggtcccagtgcgcgtcgccgaggaggaggtcggcggtggcggtggagcgatggagtgagtccctagacgccatcgccacccgctgaagtcgaaaggagaatgaggcatctgtggggggcaagaatggaaattcgtgtgcagaagaggtgggactgaactgctggcgtcaaataaaaaaaacgctttgagattgaactggtgcgtcaaataaaaaaaacagagagagagagagagtatggccctctttgtttagacttataagccaacttataagtcgaaaagtctaagcaaaacaaacaagcagcttttttatttggcttttttgaagccantaagccactctaacactgttaagccaaaagctatattagagaagcttttttggcttatatgagatagatgtatgactccaccactaaatttaggacattaaatccattgacttataaatcatataagccaataaactgacttaaaagtttaggccaataagcctaagcctaaacaaagagggcctatatatacataccctacatagtacagctctattctacaccttatacataccctacatagtacagctctattctacacctccccctagaataactattctacatcccttcccacctcctaggtccagcccatccctccctccctcactcccggcgcaccctcctccccccctccccctctcgatctctcttccctccctccgatcccccctcccgtattccctccccctctcgatctctctctgccaaccattttctctccctcacatctcttatttttcctcctattcttttctttttttagaaaaaaataaattggtgaaactaagacttgaacccatgatctcatggttcatggcaagcttttctaagcaattcaccgtctaatgttatgtgaatagaaaatattgtttgcatgctttgtatgtctgtttaaattgtgtgataacaaatcagttatgttactgcaagaatcataccttattactgtgattcggcagtaatattatcacagaaaggtagtaacatgatacgttactgcaaaatttatagtttgttactacaaaatttataggttgttactataatgttggcagtaacaacatgacgaaatttacagtaacagagaacatgtagagtaacgggtggcactattgtagtaatttttttgtagagctaaaatattttaaatctcaatctttagatagcagtaacgtaaatgccatgccttatttttctaacccgtttgcatcatggcgttcgtaaaaaaaattcttaacaaaactagaaccatcgtaactactttttaatgtcggtactgcgaaaagcagtcgtgttactatacattggccatcgtgttactacgctgttccagtgagacaagaactaaaaagaggtaaatctcaatctttatagagcaatatctctcacatcatatcttgtttttctaatccgtttgcaccatgatgttcataaaaaaacgcttaacgaaactagatccatcatgactactttttaacgttgttactgtgagaaagttgtcttgttactgcacgatgaccgtcctgttactacacaattcctgcaagacgagaacagcaaagtgcgggatatcatatttcatctacaatttcatacagagtctactaaatttatttctctcttaacatagtttgacaaaccaattttatttgttgttaataactactccctccgttccaaaatataagcatttttagaatattgtcaaggcaaacatttctaattttgacaattaatgcaaaaaaaaagatcaatcatgtaaaattgttgttactagatttttatcattaaacaaactatcatagtatgcaactctttttatttaaaatgtctcactttatagatattactggtcaaaatagcatatcgaaggctatgtcgaagtccaaaaatacttatattttgggacggagggagtaatataatttttatttttagctcgattattaaaaaaaaataaaatttagttagtaatttctgcagcaaagtacggggaatcacctagtttttcttattctttttttcaatctttgtgttccgaatgagccctcatttgtaaaaaaaaaaacaaagggacagaactatttgaccataaaacataatttcaaatttataaatcaaatttacataaatttgatgaaatctgcacaacgttttcacaaaaatttaaactcaaacaaataatagttttaaatttatcggtgaactcttgtatattaagggtcgttgaaacatatgacctacattcgctggtgcttccactgtttcacaagggagaacataaggcgaaagggtgtgtgcgtggaccgatggcttggccgaaatgtggcaataggcgtgtgcggaaaaaataactaaaaatagaatctagaatataaaacctataaaacagatataaggcagtgtagaagagatactacattacaaattaaaaaaggctgaaaaattcgtaaaaaaaatcctacattcaaacaacttaaagtatttctaaggacataatcaaattatgatagtaatctatggatgattatggatggtttgatttttacaaattatacatgtttttaatttgaaccacttatttaaattaaatttttgttgctatgctttttttcattttcaagccgtataggacaaaaaagaaacacagttaattttttatgcaacctattacattttgcatttttttatgaagaaccatcctagcaaaaaaaatccattgtattttgataaggccaaaaatcataatattacctctcttttctctctattttttatttctctaaccttcctctcctcctattatcttttttattacacttttatcttaattttttcagccttctttcatctgtgatgtgctattttatcatatcatatgcatataagtttcatgtacgcaccaacaaataaatattaccgaaaaatatagtaaaaattgtgtatatacttttaatagtattattcctacatgtaaaatcttaaccttaaattccttatatcttagatgtaacaaaaaaaatagaatctaagtcttgaggctataaatccattagaattttatctttttgttagtctctatgtaggatgaatttgaagatgtgactttacacgtagatgtaatattattgaaagtacatgtacattttttctatatttttcggtaatatttataaattggtgtgcacagtgtatatacgtgaggacttgtgtgaatatgatatttctcggtaaggaataactctatacgtttcagtcagagcatagagaaaaatatataattgccttccattgttatgtttacatgcattgatttatctagaatgtatgaattcaactgagccagacattcgctgccaacgaaaagatttcgggaattgtttatgacgggatagaaacaattcttcatttccaaaacaataaagcaagatcacttcttgcactactgacatgctttacaaacgttgtacatataacaaacagcaattctagttcaggccaaagacaaacatcatcgaggataggtaccagacgacaatatttcctcttccatagtgtattgtcttgttgattcgtcagtgattcctctagtcgacaaataatcacatacaatttggtccccatcacatctatttgatgttgtaccaagtgtagcatgcttcttcttaactcgtatattttcaagtgccatctccacttctctcattgtaggccggtcatctcccttcaatttaatacacgttgctgctagtgcagctacttcttggacttctccatctccctcttccatgacttgaggatctaatatgtcgaccaagttgttttctgtatgtagtgaaacaaaatgtaaaacaagagcatcgccgttgctagaggtgtgtacaaacggcttctttctagtaagcaattccacgagaagaacaccaaaactaaaaacatcactcctgtcagttagccttccagtgtaatagtacattggatctaaatatccaaatgttccctgaacagctgttgtcactcctgtttgatcgattggaatgtaccttgaagctccaaagtctgacacctttgctgtcaagctatcatcaagaagtatattggaagatttaatatctctatggaatattggcatagaactagctgaatgcagatacgcaacagctctagcaacttcaagtgcaatccttagtcggtcatcccacggaactgacattggcccttcaacatgaagatgatcataaagtgttccatttgaaacaaactcataaaccaacaatggaacttctgtctcaaggcagcatcctaggagcttcactacatttctatggttgatttgggaaagaactgcaacctcatttatgaattggtcaatttctcgttgtactactatctttgatttcttgatggccacaacatgtaggtcaagtattcccttgtacacaatgccatgccctcccccaccaacctcacgacttttatcaaaattgtttgtggccttctctagatctgataaggtaatgatcattctttccccaatgtccaccttttgtgaaattaattgctgcaatagcaacccatgattttgcttgaaaaatctttcttttgttttcttcatcttccgtagcttaatcttacgtgttgcgaggggagcacaaagagccagaagcaaaagaactgtgccgccactgactacaagaccaatgcttaaacctgaaaaattacggagaaaaaatcagtatgagatatcatgcaatgatgcaagagagttatctagaggatagaccgtgcattgaagttgtcaatgttatagtctgtaccataggatcatacgagttatagaaacacgattctataagataattccagtaaagatcctatgcaggatagtaagaaagaacataataaatagtggtagaaaccttgtaaatattaatatcatgctttttcgggtacaaacctgaca

SEQ ID NO: 53613 - DNA, 5148 bp, Oryza sativa
ttcctgcagcccgttcaaagtgaacaactatgtttttcctttaaaagtaaccactcaagctcacataatcatgtagcttcccacattttagtggtgatcataaacaaatggttactgaaaaagtgcagaacaatctgcttctaaatacaaaggctattatttttatttaaaaaaatagtagtgtgtgctgcgacgtgtaagagcagaatgtgaaacaaataattgaagagctcatgtaaaatgaataaaacagttcttcagagaaacaaacgaaaaacaactggaatgcgcaattatttgcactcaggtaatgaagatagaacagagcaacagacatgtttaattggcagagaattaataaaaactactgaacattcctttcaaaaaaatatcaattactggataccaactgccagctatgtagatgccattaccaccagtctcattactaaaaaaaatctacatatagagttgatggcatgagtacaaggtaattagggagtgattgtcaccttgagaggaattctttatcttgatgcatcccccttccatcaagggattgccgtaagtcccatcaggacagcggcaatgaaatgttccgggcatatttacgcaggtaccatagcatgagtggagtttccagtgtgaacattcgtcaatgtctaaccaaataatgaagaagcatgtaattagactgggaaaatagccacatagatgtatacttatcgaagcaccgagctgttttcaactgatttccattttaactttgtatgacttaaagaaaataaaagcaggttgaattgacttgtttaccttggcatccgtttggaatgtaagggttgccttgataaccagcattgcagcgacactgatagccattgtagacatagcttgtatagttttgacaatagctgttactgctgcggcatgcaggtgcaggggctgcagatggcttcgtaccacatgtcgaattgctaatagcccagtccagcaaagctgggagtgcactgacagtttcaaagataaggcgtgtggcattataggacccctcctcagctatgtacacagaggactctgcatcaaactctgaaatttcattggcaggttggatctggatgctataggatgtgtagcctttggggatggccgcactgcagcagccaataccagaacactcgttgcgcattgggaactgaaaaggttggcctttcttgggggctggagggcagtaagtagcacaggcattgacagtggaattatcgcctccaagaagaagaacttgaacattgctgcatgatagaaccaggaacttgttcttgtacggcgagatgaagaacgggccgccctttctcagtccaccccatgtgtggtatttccctgtcttgttgacactgccagttccaacagcacttgatgttgatactggaacgatactgctgctgttgatgcgcaccgtgccactaggaatcgagatctcgagcacttcaacggagccatcaccaaggaacagcttgggcggcttgtgcgagcgatcgcaggtgaggttgaagccctcgtggtagcagccaggctctactccaaatggataggagattccgatgttgccacagtgggtgctgcaattagctgctgccgccgttgctacacccaacagcagctgtagcagcagaactgcaagtacagatagcgaaaacacaactctcatacttgcgaacctctccatatgttgaactgatgctctctcaatctccactgactaggcagatggcacttgagcttcttgtagtctccattccccaagctaattaaccactactctacccttatgcatccaacctaccaaatgaaactacgaggaattcgggcactatcaacacgatttgattaagttgaacaaccttcctttccctgcagctaacaacccaaataggacagcacagcactccccatttttcagagaaagcgacaggactccaattcaaaataagaattaacaacagctagtagcaagataaaaattaaggggcatttgcatcattcaaccacgtggtcgttacattataaataaataaaactataaaagtagatttaatcttttgcatgctttcgatgactatgagtaggaatcttgacttgtgtttcagttggaagagtaaataaatctagatgcaaaggtagttcacaaagtcgatggctgctcaaattgctcatgctatggtaaatacaaggggggatgattacgaaaccttggttaaaatcgatggagagcgcggagtcacaccgaagttggcggaggcgccgatccgatcgtgacgccgtcggcgcacaaccagccggcgctcggcatggcacctccgcccgattcgattcccccgccgacggaatctacgccgccgccgctcgcttcaacgtccgcaaccgcgacagcgcccctgtgagcgtcgttcccctcgatggctcatggctccccccgccgccgctgtttccgtttccgcgtagcaggtggggctgagccggagcccgcggccggagcggccaccggttccatcggagccgcccatgcacgccgccgcgccgcggttccgttcctggtcttcatttatctcctaaaaatatactccctccacgccgttgacttttttaaacatgtttgaccatttatcttattcaaaaacttttgtaaaatgtgtaaaactatatgtatacataaaagtatatttaacaataaatcaaatgataaaaaaagaattaataattacttaaattttttgaataagacgaacggtcaaatatttttaaaaaagtcaacggcgtcaaacattttaggatggaggaagtatatggttgcagctggtttatagtctgctattgtacatgctctaagtgattgttgcatttaggttaggttttagtagtaccactgtggcatagttgggtaaaatcttactaatgtaaaattcctaggtgattctgcattatacatacctacgaagtgcaatacctgttaaatttaaccgttcgatctgttcacgccatgacattttgacatcttcttctccctccttttttttttgttgcaaaatttgtctgtttgagaatcaaaccctataaatctagttcacaatggtgatgttgtggtaaacaaaagttcatcatggcgatgttgtgttcaaaaaatagttcataatggtgatgcgtatctgaagtttgaacgggtggaaattgttttcaagtttcctaatcatgtttggcctgccggccggaccgtccttgtcactgccgttcattttccattttaacgtatgttcaacacttcaatgtaattaatctaattttctgcaatctaatgaggtcagcagtttgactggacatagtcttgccttctgtggttggatacagaagtagataaatatgtctgagctttcttcaggtttgttttttggggagctccaaactgcaaaactcaaaagaaatgaaatttccaatgtattgtggttcctttcatgtcctagattgactctttttaaacctgccgtcctgtcctttaaggttgataaagtgacatataaccaccctgatttgatacgcaacaattatcggtgcaatctgataacatctttatagtgtaatatataaccggtgaagaaattttccaaggtagcaaaagaccagttcctgcaaatgctttgtcaaggcctatatatgtgacatgaactgtgtcctaagtccaaaccaccaagccacactgatcagggcacctattcatgtcagtaaaatgcatgtttttgccatagccacactgcacttgctgcagtttctagcagcaatacccctgatactttcatataacatagcattgcctggttgcactgacacatgcggaaacacaaccataccttacccattcggtattggcgacgaacggtgcttccgcgagggcttcaaactagtgtgcgacccagcttatgatccccccaagctcttcatgaacggccctggatatgaagttcacaagataaagctggcacgtagagttctgcaccttgataccggcatcacccaaatgttggggggagacagctacaaccagaaatggatcctcgacttggatgacaaactcttccgggtatcggcagacatgaatgttttcatcaccctgggttgtggtttccacttcttcataggtagttctcctgcagcagcaggagacaatgctactagcagcagcaactgcgtttcgaattgccgcccaggttaccccatactggcaacggatggcacatgctatggcattggctgctgcaacgcatcggtggttgaagaccacaactcctacacgatcaagcttctctccctgcagtctagtccaagggcggtgccgttcaacgcgagcatggtggtggtgaagggggagtggtggaggagggcagacaatgccatgctgctgcagcaagaggtcctgtcaaggctgggtgccatcgctggggcgccggatgctgcaaggaatgtgggtgtccggactgtggttaactggatgctgggtaactcatcgtgcgtggaagctaagaagttgagtgattttgggtgtctcagtgacaacagtgagtgttttgatggccctgcagggagaggctatgcgtgcaagtgccgctcaggatatgatggtaacccttacatgccaaatggatgccaaggtatgatactctctgcagatatgtcagtatgtgcactcatggttttgatgtcacttaaagagttataaaaaaatttgagagcgtagattattgtctcatatcactccacaagcgtgcaagactacaagttttctacaagttgtaacaacagaactggctataaatagtgcctctacttttcataggtttaatttgttccttttgtttctctatacgtgtatcagttttggagttaagaaattttcagaactattcgatcgacacttgagaggttataacttagaagcatgcaagggcacatacccagattaaacagtaaaatgcagctcagatacatttaaccttattgcgtgatcactttgcacaatttaatttttatttcctttttcacagatattaatgaatgcatgctgccaaatccacccctatgctttgggaaatgcataaatacagt

SEQ ID NO: 53614 - DNA, 2506 bp, Oryza sativa
ctcgaaagcttggtggtggtggccatggaaccgtctataaagggattttgtctgaccaacgtgttgttgctatcaagaagtcaagatatgctattaagagagaaattgatggatttattaacgaggttgccatactttcccaagtaaatcacaggaatgtagtgaagctttttggatgttgtcttgagacagaagttccattgttagtctatgagttcattccaaatggaacacttcatgaatatcttcatgtcaactctgcacaatcagtcccatggaaggaacggctgaggatagcacttgaaatagctaggtctcttgcttatctacattcagctgcttcggtatcaatcatccacagagatatcaagaccaccaacattctacttgatgataggttcatagcaaaagtatccgacttcggagcttctcgaggtatcccaattgatcaaaatattgtaactactactatccagggaacttttggatacttagatccagagtactaccgtaaaagccgacttacggagaaaagtgatgtatacagctttggtgtcatacttgcggagctaataacacgaagaaggccaacttcctacatatcaccagaaggcttcaatctaaccgaacaatttatcttgctagttagtgaggacaggctcttggaaatagtagacagtcaaatcactaaggagcagggagaagaagaagccagagaagtggcagaaattgctgttatgtgcttaaacttaaagggtgaagacaggccgacaatgcggcaggttgaggtgaaacttgaagggttgcagggtgctgtaaacactatcagaggtcgacgtgcagttcagttgaattctccattgactgaagagagcgattccaacatcgttgctgttggtgacgctggttatcacaactcaagcaggcggctcagtatggaggaggaattctggtcatctatgagctttcctcgttgaccatcttgtttctcatccagctcataagattttttgttttgttggtctttttttaagtttctcttggaacatctgcaattgcaaggaacttccaagctgtatcagtaggatcctccacaactcgtgcgatttcaacaaaacttgagaacttggcacttccctgcagtcctgtactgtccgtgtaataacttatactccctccgtcccaaaaataataataaacatagtacgggatgcgacacatcctagcactacgaatagaaatattactagctttgttaggagtagtcctagttccaagtgatcctttcagttatcactatggatctgccaaactgatatgtaatatgcagaacagttaactaaacttatagtggatattcagttatacattgtcagtgcaccaatacaaggtgactgagtagtaataattcattaataactcagttcagatcgcctgatgagtccgatgtgttatcattcctgcaaggacagattgagatgatgattctattggcactgaaacatgcaagatctgaagagtggaactggtgcagcttgtagagagaactgatcaaaataggtacactcctgttaatcatgatatattacgaaaagaaacagaagagatcataagggaatttttcttgtagagtatgcaatcttgctgtatcaaatttacagggatcactgatgtatggatgtatgctttatccttgagattgacagaagtaaagtgaagttaaagattagggtttctttcctagtcccaagttgttttgcttgtggattgggtcatagctttgctgagtttcgttgctgcttctctgtttgctggttgcttcaaaggtgtgatctcctataaggtataattaatctaagttatatttagttacaattatgcatcttcgttgattgcggattttttttagataatggaatgaaacatcccggcctttgctcatgagagctacaaccaattattataagaagtagcacactaaaaaggcgtagtccaaaattaaacaagcacaccaaccaaaaataaaagaagtcctaacatgacaagaaaaacattattccagtctattggtgaatctccatccatggttggtaaaaagttgcataaccgttgactcaaggttacgacatgcaacagacatgaattctccatcttcctcacacttttgtagttgagcccacagtctaagccaatatgttgccttgaaaatcacctgcatataggaaacagatggtgatttgttaaaaaccctatcatttccacacaaccacagagcccaacataaagccgaggcaccaacaagtatcagtttactcttttccttgtccacaccctgaagccaaccatcaaacatatgagatatacttctagggaggtataaaccaaaagagaactgaaccattctccaaataaactttgcataatgacaatctataaacaaatgttgaatagactcattttttatgcaatcgttgattgcggataccaacaagttttccttgtacta

SEQ ID NO: 53615 - DNA, 20877 bp, Oryza sativa
ttcctgcagcccccctaagtaccatatattggaatacaaaattaagctatgtgtaaaaatatctattatcttttctcatactgggtttcaaaaagacatttccctactgtctctttattcaaaacttatatacaactagccctttcgtccaatggacatggtcacctccatgattgtcccttttggctatgccattcctccatgacaaccttgatcataagctctacttgtgtaaagctcaacttttctcccacctttgcataggtgcaaaggttaatgatggcttattactttttttgcggggtatcgcgcgatgtggctgccaaaccagcattggtaggacaagtgcctttgagatgccctggccctagacacttgaatcaatggccaatgagccagagggggatgaggtgagccagggtaaaggcatatggtaggacagtggagtatcataagggcccggtagctttctgtttcatctacaccaacacccaaccatccgtaacttcctacttggagggccctaccgatgagcgagcgatgatagcccatgagggagtggtgaaggagaggatgggtgctctgtgctttgtctgggtggagacaagttggtccaagagggaccgttggtcgcgcgtaggtaggagtgtgggaggcactcatgactacttaaactaagttttttgaaatgaatcgcacaagactgtgaggtttcaccttgataaaagatcatagctctgacagactataatcaggaaaacaaaagaaaaggacaagccacaccacatgcctacaacacaagcacctattgtagatgaacaaacaggagcataaccttccaacacactaattccatccacgcctttgcatttagggcagagaaggcaagagagaaggatggatccgctctcccttacaagaccctccaaagtgaccaacttgaggtagctagggcgctgccacaagataacaatttgtctggacgaggcattgttaggaaatagattttcaaatgattcctctagggaggatgtgacaccgaaagcgttgccgtcgaccgccctagagaaccaaggcatggttttcacctgaagcattccaaacatggagaaggaaagagattccatgacaatgccctttggagggttgcgcttcccaccctctcttgtcattttgtccaagtcattaccaacggcctccaccatccaagccccttcaatgcacaaccatcaccccagggcccactgctggccagcctcctcgccacttccttgtgcgagccccactatcaccgcctcaaggcaatgccaccactcgtcgttggtgaccagacatgaaaaggagaacaaactccgccgccgccacacctagcctcatcaagatgcttcctcctatctgcgcagaagttggcaacaccatgccctttccgtcaccaatggccaagctcaagtggatggtgagcagccacgaacaccacctcaccaagggtcaccacagtcgctccctctcctcccatcaccgcaaaagcctccaacattgccatgtctcatcatcggtgatcaagcatcacaggaggggtgcagtggccaacgttgccacacctagtcatcgcataaacgctctgatcccacccattcctgcacctccatgtgggcgggcttgcctcgccggtccgtcactctgtacccacaccgtcgcagcccaaccgagttgcctctcatgtgccaggatgccactggccgccaccacctcaggtcacctcaccgtcgttgccgtagtccctgttaaatatgtgatccgaattttaggcctacaatatattcggattagtttcctagtaggactccatgtcttttcctattaggtgtctttcttttctctcctatatatactcttgtaagccgtacagaaaggggtgacgttcctattgttatttccatacgtttgtaatcaactattcaatagtgatcattgcttgtcagcatttccacataaaattcgtgtctccattgtgcatatattttcgtaccagtcccaatgagccatcgcggcagcccatcaactagatcaagtcaggggaggggtcatttggacttggtctctccaaactccaattagctaatgtcctctctctctctctctctctctctctctctctctctctcccacacacacacatacaatcaactcgattgtcatcgatgctacctcttgcctttgcttggactagggtttgcaagcttgacccaccaacacatactgcagaaagacaatgaagtttgacgacttccttttgtgtaaggaaagggcaaatggcaaacgacatatttacaaacgaaaaataatttataataaaacatttatatacatgttcttaacaatctaaaaacaaaaggctgaaaaataaacttcaataagaaaacctcaaaataaacttcaaatttaagaatgaaaattcaaattttggctgataagtataagcataagtaaaaaataagactgcaagctccaccaatcagttatgggggataaagagggtacgatgaatttaaatccagctgacccctcaggtacaagcaagtagtagatgagcacacattttcctttcgttaatttaatgttttatagtacgctagcattgacttgacctctcctagtgcaacttgatcttcaaattgaacactgatcgacgtcgacgccttaactaagctaacagtgaacaaactcaatgcacactttagtggttacgatggaccggacgtcgacgaatgaacatccggtgtgcacattgccagctggtacgtactggctcaatcatctcaatcgcatataaaaggtagttataagtagcactttgtaagcaggtttgaggcacactgcgaagaatcaaagatggagaaacatgcagtagcattagcagcattcacttttctagccgcccccctgctgcagctgctgttgtttgtcgcggggaacggcagcagctgcaccaccagctgcggcaacgtgagcttcgagtacccgttcggcgtggaggccgggtgctaccacccggggttcgatctcacctgcaaccactcgtacagccgcccaggctgttcctgggccaagaaagcagcaccatgcatcaggtgctcgagatctccatccccaacggcaccgtgcgcatcaacagcagccgcatggtgtttgcgtctgccgttttagagaacagcaccaccatgcggtgggaggtgggtaaatcctacttcctgtcggatttaaacattatagcgttggtaggatgcaacgcccaggtctccctccgcgattggggcgatacactcgtcaactcctgcatcacgtcgtgccctctatcactcgactccggtaatggctcctgctcaggaattggctgctgtgaggcaagcattgctatgcacataccggtctacagcattagcgccaaccaagtggtggacccgggtgcaggacctgaccctaatgaaccaaattttttcgtgtacatagtagatcaggcgtcgttttatttcgacaccaacatggttactaagggcatcagcaatactcctgaagcgctcccagccatgttaaactggcttatactcagcaattcatcagcgtgctcggcatcgaccaatgcttctgcaccttcgtctgcccccgaatgttgcagcgccaacagcttctgcaaaggttacaacggtactactgctgactacgatgggtatcggtgctactgctccgatggctatgaaggaaatccttatgttgatggtggatgccgcggtaagtatgtagtactacctccgtttcagattataagactttttagcattgtctatattcaatagatgttaataaatctagacacacatatatgtctacattcattaacatatatatgaatgtgggtaatgttagaaagtcttataatatgaaacgaaggaagtacataatatgctctagactcttctttcaatattttttttatttgtaattgtatttcaatattaactctaaactcatcatttaatatttcttattttataattttgaattttatttattctaaattgtatttctatatcaactttatactatttttccaatatttcttattttacttatatctagattgtatttatatatcgactccatactatttttccaatatttcttattttacttatatctaaattgtatttctatatgcactttaaagtctaaaatacaattttaattttattatattttattctgaatttcagttagttctaaatttctatatggactttatactattcttcaatattccttttttaaaaattttgattttttttttgttatttctaaattgtatttctatatggactctacccctttgcctttaattttcttttttttaattccaaattttagttggttcaaaattgtatacaatatggactctagacacctctttcaatatactccctctattttaatatatgacgtagttgacttttttttatgatacgttaacaattctttttttagaaaaagttgtgtaattatcatttattttattgtgacttaatttttcatcaaatattctttaagcatgacttgaatatatatttttatatttacacaaaattttgaataagacaaatggtcaaatatttgttaaaatatcaacagtgtaatatattaaaaaaggaggtagtaccttatttcttaattccaaatttcagctatttttaaattgtattttctacatggactctattttttttccgattaatatgagaaattctaaaccatgagaacgaacgtggaggtttttttccctgttactttaataagttaatagattgaccggggatttattccacacctcagcaagtgtggaattaatcatttccaacaagtctccttctattttcgtgagatgagattaactgaacaaactaggctttaactatttataagtgaaaaccgactaacctttgctatcggttttgtccttgattggtggatgctatcaacttacattaagttttatatttattactttcttacagagttattacagtagaaagacttagtcatatttttactgtaaaaagtctaataacgtataccctctgtcttaccggccgacatagtggtaataagtgcgttcttattttagtctacccttctcttatttaatctaacttaatttgttctgttcgtctagatatcgatgaatgcaaatctccacacatctacccctgttacggcgactgcaaaaatacacgaggagggtatgattgccagtgccatcatggatacaagggaaacgcttcgatactgaatggatgtcaaggtacgcatatatactcccatcgtatcaaactacaattactttatgcctctccctattgacagagaagtacgtaatagacaggcagagtagcttcatagagaaatttaataattagattttttttgttaatttgttttaattgacacttgtttggcgaagtccatatatatcccggcccatcgttggggatagcctgccagacaaggccttgtagagttgcataataattttccaacatggcaacccataattttgatactaagctatttagtttcaattccgttgtattatgtaatgtaaataaaataaaatgaagttttactttcattttttttaatagattgtcccataattttccagcattgctacccgtccttccattatatatgcttactaatttatacttcttctgggcaaatttatttgacgttgatataacttagtttagttcattagacatcaaatatttcttaatagagagagtaattgataattttatttttcccgtggtatttgtctagatattaacgagtgtgcggaaccagaaaaatactcatgctatggtggactctgcataaatacgccaggagcttttgtttgccgctgccacgacggaagctacggtgatcccttcacaaaaggagggtgccgttcatctaaaggtgacattattgcacaactatactacgtaccggctatatattaatctatctatgtatgcctatgttaattagaaacttcgaagatgtttcacgttaaccgaagaaacagtgcacaactctaatcatccgccgaattaatgggtgaattaaaaagaaggaacccctacgagttacaagttgattatcagtaattttaaaattcaaaattatactaaaaatatactgacttgagagttcaaacgcaggtaaaacattatatttattaattatgtgttctaaaattattgaacattgagaaaaacataaatcgagacattcacttcttcatttttattttataaataattgtattaataaaatataatgttaatgtagaatcgtaaagggtatttctttaccccaaaagctagccactaagaatgggttgaattagttagtaccacaaattttgacaatttaaccctttgcaaaaactatttttacaaatgaaccaccatcaaaacttatttcaaaaatgacccttttgttcagcggcaaatcgtgtggcgctgaacttagatacctcagtgccaaatagcacggcgctgaatgtatgttggcacgctgacttagcctcccatccgcggtggcacggcattcagcgacagttgacgtgacgctgaggtgtctaaattcaacgccacacgatttggcgctgaaaaaaatgatcatttttgaaataagttttggcggcggtttatttataaaattagtttttgcaaaaagttaaattgtcaaaatttgtgtagttagtacagtcttcagctgcgactgtgccactctagccatggctacagtgatgggcacgaaagaaaggggtcgatcgaggaagaactaagggatatggtgacaaaatatgtcaacaaaaccattgccaagtttactttcaaaaaagaacaaaatcattgccaagtaagatgtttaactagacgaaattcttttgtgtgcgtacgtgcgcttttagccttcttttcataatgtagtatagatttttcaaaggaggtgtaccgaggcgcaccacaatgccccaattatttatttttatcattgtgctaatgtaactctcgttccgcaattaaaagttcatccctgcataatcatgaaattagtttcttaatgtatcctttcttcaggtttgaccattggtctaatagtcagcggtggttcagtccttctacttctagggcttgctgctcccttcatagttcgcaaggtcaagctacaaagggtaaagaaaatgagggataaattctttatgcaaaaccatgggttattattacaacagttaatatcacgaaacacagacttcgccgaaagaatgatcattaccttacaagagcttgagattgctacaaacaattttgacaaatctcgtgaggttggtactggaggacatggggtcgtgtataaagggattatagatctacatgttgtggccatcaagaaatcaaagattgttgtgcaaagagaaatagatgaattcataaatgaagtcgcaattctttcccaagtgaaccatagaaatgtggtaaagctcctcggatgttgccttgagacagaagttccattattagtttatgagttcatttcaaatggaaccctttaccatcatcttcatgttgaaggatctatatcattaccttgggatgatagattaaggatagctcttgaagttgctagagctctttcatatctgcattcatcggcatcaatgccaatattttatagagatattaaatcttccaatatacttcttgatgacaacctaacagcaaaggtatccgactttagagcttcaagatatatctcaatcaatgaaacaggaataactactgcagttcaaggaacgattggctacttggatcctatgtactattatacgggacgacttacgagcaagagtgatgtttttagttttggtgttcttcttatggagctacttactcgaaagaaacccatcggtggtacatttgataatggcgatggtcttgtttcacatgttatctcacttctctcaaaaggtaatctttataatataatagattctcaagttaaagaagaggaagatggagaagtcctagaagtggcaacactagccacaacatgtactaagtttaaaggagaagagcggcctacgatgagagaagtagagatggcactggaaagcatagtttcaaagaaaagctccttctgtaacaagaacagtcaatcaagtagtagatccgatgaaaatcgaattttagctctttacatgtcgatcgaaggagttaccaaggacaaaacaattacaattacagaaagcagcacggaaggggaaataccattgtcgtcaaggttttctcgataatcattctctgtcctgaacgagaacgccttgcaagaaagccggaaacttagttacatcgatcctgttctgttctaaatgattgctaaagtaattttgctgtaaaacaataataatgcaacagaaaaattgtgtcgtatcagaactttgaagtacttgtggtttagttcatgttgattaagcatctgattcgatcagtttgctctaatggactgaaattgcagagtgccgtttgtgttttcattattcattgaattattctgctagcggctgcagagcccatcggctctgtaggcgttcatttttacagtttatctatcgcacccgcgaagaaagataatttcgttctttcttatagaataaaaagggaaaaaactcacttctacttattttttttaacatggatggaatgaaaactatgtcctatcaccctcgaagcggtgaaaataatgcttcggcccgagtgtccgaggctccggacgcctctccgctcggcccatttctctctagaaagtcgagtcctccatcttccctttaccattttttctccgctccatctccggagaattttcagaatttgccatccaatacgcactatctttaggatatgccatccaattcgtactacttttaaaatatgtcactgggacgtgaattttcttcactctatgccactccgtccgatgtcagtcctcgtcgtcgttcgtccgtctgctgccgctcgcatccccttctatccgtcggtgccccctcccctcccctcgggtccattcgccggcgctggccccgtctcgccgtccatcctccggcaccgcccgcgtccccgtccaccggtgccaccaacggcgacagttggactcggcagcagctcctcttcacagcatgtccactcgggggcgagggcgggtggagagttcgggggttggggcggggctggggtcgttccagcccaaccgctcccgatccaccccgttgccatccctattgacaagcttgtttctcatccagctcataaggttttttgttttgttggtcttttttataagtttctaatggaacatctgcaattgcaaggaacttccaagctgtattagtaggatcctccacaactcagcgcgatttcaacaaaacttgagaacttggcacttccctgcagtcctgtactgttcgtgtaataacttatacttcctccgtcccaaaaaaataaatctaatacggaatgtggcacattctagcactacgaagaaaaagattactagctttttaggagtagttcaaacgaaacaacatgtttgcctccctttgatccttgcagttatcaccatagatctgccaaactgatatgttctatgccgaacagttaactgaacttacaatggatattcagttatacattgtcagtgcaccaacacaaggtgactgaatagtaattcattagtaactaagttcagatcgccttatgagtccgatgtgtttatcattcctacaaggacagattcagacgatgattctagtggcagtgaaacatgcaggatatgaagagtggaactggtgcagattgtagagagaactgatcaagctaggtacgctcctgttaatcatgatatattatgaaaagaaacagaagagatcagaagggaactttttcttgtagagtatgcaatcttgctgatcaatttacagggatcactgatgtatctactgttgtaaagaacatgtgcaacaatggaaattcagaactattgctttcttagcgaaaaaagataagaaagatatgtctgacatgcaagaattctgatttctggaggtgttgcactgctctgaaaagtgcagaataccagtatatgactataagaattttgtagctgtctttgcctcaacaatatcaagtgctttgttgaggtaaacagtttcagaatagctttgttccttctagaaaaaaaaaatcccatgaaatgtttttcatgtctgctcaaggaaatgacagggaaaggtggaaaagaaaatgaatcactcctgcattttctaaacctgaatctcagccagataatttccatccaacggatgagacgagcaaaccaggggttcggagaacaattcaccgaccccaaccaaagataccccctacccatcagcacagccgccggtgaagttgccggcacttgtgtccatcttgaaatccaaaattttccctggaaaattttcggatggatccaagacacctgcagcagtttctctttgaaacacaagattttaaaaaatagaaatatataatgttactcctgacggctcattgaatcctacagaaaatgaatccacaagtttgttttctaaaataaatgtttcgtactatatagataaaattttaacaaacatgcacttagaatatgccaatttcattgaatagagagagaaacaatgtacaaaaatatgaaaactgtacaaaacagaaaaagaaaaaagaaagccggtaaatcatttatattttggaatgtggtcaatagcactatcggagaacatgggaattttgagaaaggagaagagaaacaataagatctacgtatcttcctgataaattttctttaaaatttctataaaataagctattcgataggaattttaaacaatttcgagagggacatttcttttctcgaaaaggaccctataggaattaatgtgttccaaagaattttaatcccctaaattttctttatttttttctttgttacaaaagagccctaagttccgaacacggtgaaatgaaactgaaacgaaggcaccactagccgacaccaccggcaggcagctcgcagccatctggcccatctccatctcaacctctcacggacacacggacgatcggtcgacggatggacaaaggaacagccacaaaaacaaccagttaatttccatctcaatccacgcaacattggtcactgatatatataccctctaaacggtttacatatcagccatacttaaagttagacaaaaaaaagtactacagtacagaggatatgtgttccatactcgaccatgcaatagtcacgagctgcctcttcgtcgtctagagacagacaaacagcttatcctacccgacactactagaaaaaaaaattcgtagacgatgtgcttttaacttttcaggcggtctttttttttttggcaccatatgtccgcctgcaatataggggcgaggggcaagatgactgtccgtctgggaagatatccattttaagagctccgcttatatctttgtaggcagcgtgttatctcgtccgcatgagaagattgacctatatagtattcttcctccccgagttgagctttgtagagtttacaggaagtttctctattcaaaaacaagcaaaatatagaaaggagattttgaacttgaaattttcgatgaaattttctacaataattagatcatacatttgcgcgacagcctcaagcacgcggatatggatcctctgcagtactacacatacagtagctgccactgacaggtggaccggtcccacatgtcagtggtagtagcgtcccacatgtcagtggcagctactacatatacagtactgcagacaatccccactgcaagcacgcacatacgcaagcatgcaaaatcgatcgatcgatcgatattaggtcgtcgccgacgatgacaggacactcccggtcgattggccgcgaccgtttgtcaatggaatatctctctttctttctttctttctcgacgagtccaatcacatcatgattcatgcatggccatcaacggcgtgcgtgcgatcgagccgatgcatgcgggcgcttgccggccgcggcggcgacggcgatgcgacaggccggatcgatcgctggtgttgctcgctttttcttccctttccggcgaggtcgatcgacaacgacgacatgaatgaatgattcgtgagtcaaatgtacggtggacgaccatgcaccaatcagcccggctagtgctagtgctagtgctatccccacacgaccactctctcgagttcccctagatagatcctgtttcttttttcttttcctgattcatggacgttttccatcctctttggttatgaaaatgcgccgttttagatattggcacggtctcaacatatatttaattttaacatgtcatttttaattttttatgtatctgtacagctcggaaatacaattttaactcctatcgtaaatatttgcacatataactggaagagcttacgatattaaaagaatgcgtgtttttttttcattttaaaagtttgactttagagatagtatgttttcatggtcataaccagactagcatagtacttcctccttccaaaaatctgagacctattttattctttggtttctctaaaaatctgagtcatatttggagtcactatgtgctaaattaaattgttgaccagaaaccaagaagccattttagtacttattggttgcatgttcattatttttgccacatggtgagtgagttaattgcttcttggttttgatgaaaaagaaataggtatcagatttttggaaggaatgagtagcatataatattatggtgatgtttaaaaaaccaccattatatctctattaatttaaagcccattcgctgctccccatatatatattagcacccaaccattgtcttcaccaaaaaaaaccaagcaattgattaataaaaaaaactggctgtattagttgctttcctcactcccagcccatttctaattatacaggcccgttgtaacatatcagtaagttactcgtattaattagtattaaaggcataaattaattttcctgttatgagtgcgtcttgttaaattaacatgtggtataattggaagaggttgtactgtacatggtgtttcatcataggtttgtagaatctcttgttaaataatacagcaatcatgtggagaaaatgtgtacttttgggtgcatatagtacaattagtactaagcaagatttgtccatcgcatactagctgtcggctgcgcatctctgccttcatttctcagtcaaatagctaatcatttggggaaagtagatttgttggaagcaaagaagccttttcttttatttcttctccttttatgcctgcctaatttcactggcctgaaagtgaagtcagttgtcatacggagtgacatgacaatagatagatttatttgaaggacttgaggtaggtagatgaaagaaagcctttgtttccatcctcccctattcagcatgaccgaggttccatcgcgatttttgacattatggtcctcatataaaacttattttataaaatatgctctaaaaactaatttagaaatgagtaaattgcgtattagatccccttatgagaccattgtggtagcctgaaccagggtaaagcaacattttcatattggactggttatatttaccaaatgattcactttggtcctggttcttctatacctagctagcgtcagcaccgtgctcgtgccaagctctcctagggtcagctacttagcattgaaggcgcatacttatgatggaggtcaatctccctatctgggttcgtacttaagcttaggaacgaacaagagaaaagagagaaaaacttcccccattgctgtggagagggtgtttagtggtcaggtgggggtgtgagaagagcaagtttccgtgtacatccttggccaaggacatgagcgacctgcttctcgggctggcttggctttggcttggtgaaggtgtactgatcgatgtcggcagtgaggaggattttgtggagatcgtagtgggggacatagtagtattccccccaagggcattagctgtgtacttgggatgtcaccaagcccatggacaagctctaacttgaggtcatgcaaggcgacgggtggtttgcaggctgaaggttgagcacagtggtgtcaccgactagactcaagatcgagcatcggaatggtgccaaccggaactgacgacctcatcgacagtgcttggctttggccatatggagagaagagagccattagagggagagaagagagagatggagctggactgctggaggaagaacgggtccgagttgaaataattggcaaagacagatggtccaaagtgataatgtgtgtttaccccagtccaacttgcaaccatggtaaaaatatgtggcccaacatgcaatttactctttaaaaatagacccatagcttgccgccaaagacattggtatcgatgttatatgtatatacatgatagacgttggcaccaacatgtggttgccaagagtcacactggtgttgacatggctagaggttgcttcaagaagcctagcacagatggtcaaaggtgaaggccatctcatgagatgtagcgcaaaattacagacccaccatctctaggtaactagctcgaccttgccctccatcgacatcgtccatgggcacctggctcgaccttgccctccacagacaccacatctggaatcgaccaagcctctagcctccagacaggttgtccctaggcttgacgccagcctccatctaagacatctctaagctcaatctctgcccaagttgtctcaggctcaatatgtaatcctatgcccgtaccatctcgggcttggccattcttgagcttgacatccatttctgccagcgtagctagccagcttgacatcgggatctgcccatgccctctcgggcttgagctccccccccccttctatcataggctcgagctcagtttccacccttgtcgtccccaagctaggtctccgcatgtgttgtcccttactaggttggacctcacctctgcttgcgacatccatggcagctggtaacgcagcatgggggacgagggtcggtaccagagccattagtaccaatctctaggcacgctaggttggcttggtccaccacatgtgttggggctcggtgacagggactccagctccatggcttcaggacccgaataagtttttcagaggtttgtttctaaaatggctaaagtattaaaagtgcaaaatgtactaatatataaaactttttgagtatgagtaaaacttaataaaagaatatggctaatttatcagtaaacaaatcaaccacaagtgcatttaggtaaaagaatagaacataggactctttggggggcatagctaaaacaaactcaaatgcacctccaagctaacatatattaggttcggatttcatattcctattttcagtaattacacagtaaatttctttgataataaaggtaccttctattctttacatcagctatagatccacgtatctactccctccatcccataatataaggcacaaccactttccttaaatgttccataatataagtcatgcatgcaagcatgcaattaactataacatcttctctattaaattataacttttttaaatcctccactctcatgttatctaatcctattggatgcatgcattttatttattaggatgatccaaactacaagatgataataattatttcttggtctttgggttaaggatggctgtgccttatattttggaatggagagagtatatcacacaaatatttatcaggtgattagatactctatgtatggatagacacatgagcctttttggagagcttctgggagttgcaaatttttctcaaatcaaaagttttcctcaacagttagcttttcgtccaaattatgatgatatagttgcataatctgataatgaattagaaaccagaaaacattttttcagcttatccagatcttactctataaattctcactaataatctaaagctccttaaaacatccccatgaagtcctagctatcgatatgatccaccgctatctccgactttaactatgacaaaatgcagatcaatggaacatatttggctaaaaaaaactcttaaaaagtgcaagtgtaaacactagtagatgctaccagcagctataggtcttaaaaattttcaaccccctaggtcgccaatttctcacattggcaggtaaacttttgcagtaagtaggtagccagcatcagatccaaaagtcaaaaccagcagctcaagaacacaggcagtatctcgtatatatggactaaacaaaggtgatgaagatagcgacgctaatgccgcgccttaattagtaattaatagtgatccacgtttcgtgctgcatattgctctaccctttgtatatttctcgtcatacgcttggtcggggagagtgtgaatcccgaggacggtaaattcttggattcgtgtccatttcttaaaatggattaattcctcgagcgatgttgccgtggcgctgtgaacggagcacacagcgctgtagccataggaattttacagaatttctacagtaactttgtaagagattgctggttaattttttccattataaaaattatccaatgtttctttttttttaacgactcgcacaagacggtgcgaagttcataaggagttaagggaagacgtttttttccatgcaagttagttgagtttccaaataattgattcatttacaatgaaaaacagacacatttaatgttatttgggaattcaaattagcaattcagttatttacatatgagtgcttaagtttttttcgtgggttcaaaggaagcatagataatatgatgatgtgttaggggtacatgacttcagtcatcagggttaacaactctactaatcaacgtataaagtttggtgtccacatatattacgcatatggtgagtaggctttcgataagaatttagtaaagctacagatacagtaggcgtgtgtttgaaggcgcacttataggtgtgtgtgtgtgtttgtgcatgagtatatatagtgtgcgtgtgcagccaagaaaaaataattcgaactaagatattattatctttatcccctaaaatggggagtactttgaaaacacatatgtagtggctgcaattgtctgtactactgcaaatttactatgcatagagaaaggtttgatacatgagggggaccataaaaagttaaggatattgaccttgtttatcctctaaagtcgaaaacactagcaaaacaaactctaaattgtaagtctggtaagctaattaagtggcttgaccagtcaaaaagagcttacaggggagtaacaggaaaagggaagctttgaacagttgtggtgtcaacaggttatggacaaggatgtgatgcaacataagagagaaaacaaatatttatgagaagtgtccttggtggtggttgttagggcacaaacaagtagatgtgtagaaggaggctagctgtacatcaccagcatattaaaccaaactacaagaaaaaaatgacaaaatgcaagtgtgtataaaaaccagtagaaataaatgacaaaacaatcaaatgtatataagctagctaaaaaaaactattagtagttctcaacaaccacttctcaatcatagaagctatgtcacaacagaacacaaagtgcatgactggtccattagtcaagagtgatcaagagtctcaaaaccacacgctaaaggcacctaaaagacaaaaaggctatgagcataacgtttgctcaatgattctttgcaatgacaggagatatcaattttgcattgcaaaattatatgcaggactaagtttcttgaagattttactctagactgacataatatggttactggaaactactgcatagagactagagagagaaaattcataatatatttcagtacttatgttagtaaacagtaactgcattgcactccagaaccagggaataatctagattctagagtagatagagacgtgtatgattcacatgtatgctcatggtctcatggatgattcttccttgaagaacattacaataacatctcaaatgcagaagcaaatgattaaattataaagctgtaatattgcacttgagctccataccaattaaaaggtgactttatacatatatatagtcatatatatgaaatcttcaggaccatctcaatttctggtgataagaccaatggccttacatcataatcaaacgagctaaaagacagtctcagcaagctaattaaagcagcaagaacggcaacaggtgccaaggagaggaaagcagaaaagaaaaagaaagaaaaaagagaggatttgaattaattcagagagagaaaaaatgcctggccttcctgcataccatcatatgatcagtaccatggaacggtttcttcttcaccaaaactcgatctcctccattttgttgagctaagctcgcatggcggcctccatgccttggctctgcagaagaactactgagagaagacgacggcggcggcggcggcggcggcgacgacgaggtcaccggaatggcctcccggagacgaggaggagcagggaagcatggtgaggaagggaaggcaggttgaaggagatggtggcattggcatcctcctcttccttcttcatatgtcccaatgaactggtgctacttgcacaaagcacaagcgtgtgggttagagagagagagagagagagtggagggagggaggtttctctctgcacctagatgtaaatgtatttttggttagaatactagaggtttttaagcacacacaactagcttaggctgtgttcgcatgcaccttttcccatcccctcttcttcgttttccgcgcgcacgcttttcaaactattaaacggtgtattttttgtaaaaagtttctatacgaaagttgcttaaaaaatcaaattaatcaattttttaaaaaaaattagctaatacttaattaattacgtgttaatggaccgctccgttttccgtgcacaggagttaggttcccatctcccccatccgaactcagccttagcagtagcatgagtttacacatcaggatcatctgtggccgcagtccatgtggacagctatcagctcatgttcactaaccataccataaaaaaaataaggttttatggagccctctactgtatctttttctaaaagggtgtaaaaactattggatgtttacctctgttacactttaccactatcaacaattcaagaagaaaaatgaaatctagatgaacaatactgcaatgttgttttttctaggtacaagagaaaaccccgctctatattattgttgtacaaacccagatactgtaatgttgtcatataaagtaaatgtgaatggatatataaaacatctaatgcgtcatatttccaaaatacaaagcagtggaagtataatttagcagattgctagagatatggaggttaatttgattggaggggacaaatataaaatgcataaaaattgtacataaggaacttttttatattatttagtaacgaacaagtgacaacttgcatgtgtatgtttgtctttcacataatacgaaaattataactactcgcaaaatggtttaaatctattgttatttgtcaaataaccaaagaagaaaacattgctacaactataagaaaagaaatcagttgcctttagactttagtaatttgtcagataaccagaccatacacaaatgcaatgactaccaatgagctcgctctaaccagaccatacacaaatgcaatgactaccaatgatgcagaaaatcaaagccttttaggagagataagggagaagattgttcccataaggagctgaccaagagaacgagttataaggctttggcttgctgatcaaagcagaagtgtaggggtccaaaagtgaaagaacaccgtcttttttctccaatctcacgtgggatcaattccatctttcacacagtgaaagtttctaagagaagggtttttttaggcttgccagttagcaggggtgacttctgttttgccattcaaatctctgtttgagaagagggttgaacaatatgtgtatgcatgtgctgttgaccagcaccttttcatgtggaacacaagcaatagcaaatccctatttttgtaagatatatgagtgtgtttaaaagtaaatctaatcatttggttttccattaaaaaaaatcaaacctttcctctagattgcaagcctgcagttctaatcatgttggaagcctagaactgtaagaaataatagttggccatgcttgtcttgggtttgagtcgattttgaattttaggtttgatttcttaaaagaataattttaattagctagcttttgtacttgttttctagcgatcatgatagccagacaacaaaaataacaatattcaaaatcacctctagatttttatcctagctccaataagcagtagtagggtacgattcatatgttgatatgtggtaacacgttgcgattccacatgtacatgtggtgatgtttgtgcatgtgcactttccttgtaattgtaaaatataaacttgcaaagaagggataacctagtaaaaaaaatgcacttcctccgtttcatattataagactttctagcatcatccacattcatatatatattaatgaatctagggctgcaggaat

SEQ ID NO: 53616 - DNA, 6511 bp, Oryza sativa
gagaaagctactccctctattcatagatataagtattcgaagtatctaaagttcgttcacaaatatataagcattccaaagtaaaacttattcatcaatcacctcttatttgaatttcgtcttaccttaccattaaccacccaccccatttatcctttgttttaaaaaagcaaacatctctactaaacaacttacaaatgtctatatttattgataggagtataatagtccaaataagatgaggactgaggcaggggcggatttacaacgggggcggaggggtcttgagactccactaccgctcccgggacagtggagacccccctaagcccccactaaatttttttcccatagatccataggatgtggggactggaggttcgacttatgctgatgtagtttattcagctcccactactatttttttctagatccgcccctggactgaggagatgagaaaggtagggaaagggcaaggccatgggccaccatgcaccgcggcacaaagcggtgtacagagcaacaacgggggcaccactttgaccaccaccgccgccggggccgccacttcacggcttcactcccctcccggccctgccgcatcacgtgcaccccgggcccaccaccggtggtaggcccaccgtcgcaggcccccctcactctctcagactctcagtcggttggttcaatcgcgacgcgaattcgctcgcaggcgttgaggtcagtaaggaggaggggcaggaaggtcatttcgcgcgccatgaattgcaattgcccatacggaggtcgcacgtgcgggggatcgggcccaccggtcggacgttggcgggaccgaatcccgcgacatcggcccggctcttccaccgataatgcccccgcggctacacaaacatgatggtccatgactcgatggacacacagcttccattccgattcctcccaatcccgacgccaacctccgtctccctcccgtccatgccatactacagcaagtatagcagtagcagcgttgcgttgtcgccgtcccaactcccaaaccggccagcagcatcaccttaggcttagagacaaaacggcaactgtggagaaatacaaggggcgcagcgcaccaatccaccaccatgacccaaaaaaaaacacacacacatcatcagagtgcaaccaaccaaccaaccaacaaggaaagaggcaaaatacgtcctagtacatcaacaggcgtggattggcaaggagagttttggaagtttcctgtccagaaaattggtagtagcatgtagcctcagcgtattctaaaagcaggccgtaggacaaaacaagctcgcaccttgaaaagataggccgaggcacagcacaagtagctgtactctacagactctacacggtggctcgtgacaagagaagaaccaagtctggtgttttcaccttttcaccttcctcgccaggttgaagcacaactgcacaagtggtctttgctaacagcggctgtcagtaatctttactagggcttgggttaatgtctcactcctctagtcgtcgagccaaccagaggagccgtgcatgaaaggcggatggtccatgcctctggacagaaattctggaggtgggtaccatccttgccacaagtcatttcttggggcgaactggagtccagggaagggaattcttggagcaggaacgaacggtaatgcagggagatcactcgttgtctgtggcagatattttgcaaccactgcatcgacctcagaagcagcagggggtgcaggtagtgaatcttccagctgtctgcaaccagcaccagcttcaggtgtccctctggacagtgtgtcttccagcctttgatattgcaacccagctgaaagcctgcctcctccaggaagtgaaacgatcggctgcccagaaaagccaggtacgagttcatccagaggaggtggtgtgtcttccagcatcttgtattgaactccagctgcatctgcaggtctctctgtgagtggtgaattttccaggctatggtactcaatgccagctgatgtcacctcatcacaatccgcaaaaccagttggttgttccacaggtgcacttccaacatgatcgtgggcttctgaaccagtatgcccatgctctgagtttgacatagtttcggtttgtttttcacaatcgctcttgtcagatgatgaaatgctcatgtcagatccacaacccatgcctgcatgatattcatgggttggatcatttcttccctcgtagttgcaaggctgccgtgatcttccattggtatctgtccagtagtcccctggcgagctagtaggatcatggtatgtgtcagacaacaactgatctataacagaggcatttagtggtgcctcttcttgtctttctttgttgtcaaggtcatcatccccctcattagccatttgtgcatgccctgtgtttacaacagacctttgagtatcatctaagcaccacacatttttactgatgtgccccattgttttagctatttccttgtgtttccgagcccaatcactacggctccatagagaaagaggaggtggtgacatattccattgttccataatcttgttatcagcatcaagcgacccaggcaaatagaacgactacagttttccaaagaaacagtcagaacggaattttgcaacaccatgtcaaggataacatgcaactgtaccaaggagagtactatcgtacctttcctgcaagctgatgagaatcctcccatattagctcatatggtgggtatttcctgtccagcctaccagacattaaaaaatggagctgtgttaacaatcaatgacagccacaagtatatatggagagtgggacagtacctttcagtttccttaggaacaatgagtatgatcagcttgggcttgaaagtgagggctttattaatgaattgattagcaagagaagctttaaacccaaacggaggattcaatcccatgatctgagggaaatagcaaatatcaagtagagaaaactgagactttctgtgagaacaaataaaatgaatggctgggttgtgagtataccaatcgacatcctgtgggcaattcatctggttgaacggtcatccagtctcgtctctcaaaattgaagtcattctagggaaagaggtatgttgtgtcagcttcaacacaggatagggtgtgacaaaaatatttatcaggtgcatgactaggccctcatatatgtagcttttacccttttaatctccccggtatttccatcttactgaacgtatctatttcatgcatggtaacttgttcaatattaaaaaaaacatcatatattacccccacctttggttgaataagatcaaaatttttatagaagcaacttttttcagaagcttcaagcttttccttcaataataagctaaaatcatttgagccacagcaaaagtcaacaacctaaaacagacaggaaaaggaatgtgtagtgaattgttagaagtggcacatctggatcatgtgtaaaggtcttctatttttattatgaacccaaaaaaattggtacaatcaatatcagatggaaaactaaacatagcattaagttggtagatcaacagcattgcaagcacgattacaaagagtcaaatcaagacatcaataaaatagaaaatctgccatcatctacttctcttgaaacacagtatgaagatttgagaggttaatccaagggtataaagcaagtggcattaaacacttgacagatcgagcagacggtgacacataaatcctactattacattattgcaatcatttagtatctatgctaagcagctagggtaattgtttgcatagtatcgaaattaggacattgaggttatccattgtcatgactcggcataatatcaaaatccatagagcaagattagcacgaataaatgaaaatatatctccgtgttagtttttgagagccagcaggctcttcccagactcccagtacaaataaacaactgcccgagctaatttacttcatttgaacctggatatctaagcttggcaaggataaagcatcgatacaatatcgctacaatcgaacaccagaatttatgcagatgtatgacacaaaaagcaagcacattgaaacctgtatgttgcatcacttatgcacattcatgatgaccaaatttacataacaaagcagaacaaacatgtaccgtatcaccactttcaatataccattgtagcctatctacaatctgcataatttaaacattgttatgtcagtactaaaaacagcatcagaagaaggtagaaactagagtatataatagttaagcataacaataaccccgaggtaagaataaccactatttttcagtgctaataaaaacagggcatgaaatcaaacaacagtggttatgaaaattgaaatatgaagtttggttttcattcatcacaattgaattcacaagtggtaaaaagtagcaaaaggatatagatctctagaaatttccattggtaataccaaatgaaacaaattcctacttttgtttattggtgcagtggacatatttatgcaagcaaatcacaagacaagattgacacttgaataagattttaaaaaaaatgtgtttgattcctttgtccacgtttaactctcagcacataaaaatacagcaaaatggtacatgccaaggaatggtagaggggtagcataatttgttcttgcttaattttaatcatggcaacttcttctctaaacagagggaggccaaacagttccttctatgaaatgatgatcatctctccatcttgagacaaagggagtggtaattaaaatatttgacaagtgatgtgtaccactgcatatgaatgtgcagaggtccaaacataaacctcattgacacagtaattgtctggaactttggattcacaagtaatatttgcagggctatttgataattggaacattgtttttccaagtattcatcacgaaacaatttaattcatgcagaaccaaacaatttatagttgagtaatgaagagtaaactgaacaagagttgaaggacgagatatagatttctttttccaattacaaaatcaagtacaactttgttaaaactgacgataatgagcaaagaattggcaagaatatccatttaaaagaaacttgatcggtgggggaaagaccacccccacggctttttcacgaagaagcctcagcagccaaagccagccaagaaagtccatgaaccctggtcccttgacacgaggacctgccccccatggttcgggccttaatctgtgctttgaggcccctgtcccgtacacgagggcttgcccacaggttgttttctaacacgtgttttaaccgaggggccagcgagtgtcctttttaaaaccaaccctgaaaacttgctcccaaggggagttgaactagacgctggtaggtgctactagagtgttgtggccactggctacagacccgttcgcaagaatatttatttcatgacaagactgttttgggttaacatttaaaaataatatttataacttccgaaatcaaaatgttatcttccaaaggaaaattaaaaggatgatagatcagtacagcaaaataaccaacccacagtattactgatctgcataccaacctgctcgagtttgtccagtttggtgaagtggcgcccataagatgtgtagcgcatgccatgaagaaatggtgcaagatatatattcagtttattctgcagacaatagttcatgatatcatggatagaagaggttttgttatttctatacagactacaaacttgcttttagcatatatcactccacacaatcataagcaattacaagcatgttagaatcataggaatttttctattatctggtgtgatgttgaccattctcattgtgcataaagagaaacaaactataaggcctattacatataagaatgagacacaggagttcataatattcagcagtaaaccattgttacagcaaggaagtgtgttttcaatatattcatgtaccttccaccttgcaagttggaaaagatcactaggtgcacatacagatttgacatcttctatggatgcaccattttctaacatatgcagagcagcatttatagcctgcaaggacaatatgtaagaatcgaccaaattcatggcatttcttttaaggaagcgcagaagagtacctcaacagatctttgcaccattcccaatgtaatcttatcagtattcttcgaaaccggtgtgtgtgtagatggaaccactagctttttttgtatatcctcaatggttatatcagatgacactttctgtgcgaactcatgaatcctgaattaaaggataatctcagctcttgcggattgcagtaaataaaaacacaacatcacctaagttcagcttcaacagacattttaaagggtatcatgcaaactgcatgtacaatgaaattttgtctgttgaataaaccatggaacaaatcatttctgaattctttgttagcagccagaaatccaacaaat

SEQ ID NO: 53617 - DNA, 2412 bp, Oryza sativa
agttttccctccttaaatattgcttgtgcttcctaccattcccactcgtaggatgatcagtggattatgtgataagtttacaagattgcataaaactaactacacatgtaccatagccactcccaaattataactgtataatttttagtttcaacagctttactagagttgtttttatgcggaacaaacatttggttttcacttttgcagtcaaagttgattgcataacaaaaggaaacaatgagaactgaatgaaagaggaaaacaattaacagtagaagtgcgcaagatttacctcctctcagtgcttttatcaataacagggaatgagctcaaggggataaatgacggaactgatgttttttccctagccacagcactaagagcacaatgttttgtacctccagacacaagcactttcctctttttggttatcacatcacttgaggaaaaacggttcactgtaccaaatgattttttgtcactggacaatggggcaggtggacaatcctcaagaagccgtatcttaaccaccttcttgttcattccatttacatcgaagggctttctcgtgacagcaggattatcaggaaatttaatatgatctcttgtcggggttctaagtttaggatcaatatcatgtttcctatgcaaaaattacaagatttagtcagaaatttgtgtacttgaataacaaacgcaacaattttataaaaaaaaactgagaaatcatacaggcaaaatattaatattcggttattgggaagaaggccctcccacgccctttggaaatgaaatacaccattgtcaacgaagtcatcaaaggcgattttcctatgtatagatttgcatgtattagtttaagaataaagttaaataaatatcaactcacaaagaatgcattcatgatcaactcataaagaatatgcattagtaacccacttcctgcaaaatatgaaaaagagagaaatccttgccttggcaagcatcttctatgatatgccttgggacaccgtcggcacacagcaaactgtagctccttttcatccttgttttcaccatacttgcaaacatcacatttgtgcagtgggcatgcaaattttaccccactggctatctttgttgtatattccaatgctttggcttcattttcagtaaagagtaactgtgcaacgcatttagcatggtagaaataaccacaattcgcagatgcacagggaaatacctaaaaaataaaagcaatttatcaggtcagaagatcaaaagaaattcagacagttttaaaaggaaggaataaatcacatcttagacttatagaataattttgaaggagtgcaatcaattactaatcttggaattccataacaaaagggctaaaagagattaacctcaggagtatctgttttagctgaacccaacctcatgcatgcaaaacattgatatttttcaagctcacaattcttgcacaaaaaaggattcaatgcctgtaaatatgggaaagctaagtgaatgttaccatctaatatgtgtaaaacatgtgaagtaaaaacggtatcattcatgagtggaagattcagaacagatacatcaaattgacgcctagtgtagcctagtgtttgacaatcttcaccagcatccctgacggcatgaaaagatctgaggcacttgccttcgcagctgcaagagtgtcgcagaaatgcacatcacgattggtaagttatgaatgaatacatcacagagcatttttcacagcaaacaagtgacaatagttgaggttcaagcctctaatatacaatcaataaagaacacataaattttacgagaagtacaaagaaatgtgtaattttctattaattctggccactgcatctaatgctgcacaaagtcaatgtaaatcactacaaaccgtccacaccaaatgggattcacaaatttaagacaagaagctataccaatatatgatatacaaaatttcaactcgcacataaccatactagatctccattcatgcatcttgaagagctccataacagccctctccaaaagtgctgcttggcacaatagtgtttttttttacgcaattaaaaaaaattgacacaatggcacaatagttttagccactaagaatgtgtaatgtttgctcccatccaaaacatcctgctgtaaaattgagcaaaaaaaaacttcctctacacccagaagttttgctacacagcacataagatcttctcaaagtaaagtccatcaccggtccctaaacttataccgctgtgtcatcccggtccctaaactcgcaaatcgaccattcaggtcctcaaacttgttcgactgtgtcatcccggtccctaaacttgcaaatcactcatttaggtcctccaacttattcagttatatcacccctctccctaaact

SEQ ID NO: 53618 - DNA, 1619 bp, Oryza sativa
ggggcccgggtggtcatgggctaagcgtagcctccatcgacgtggggaggagtcgcgggatcctccggtggggccgacctgtcagtgagggtggaacggctccggatgcatgggggtagggccgggcgacgtaggccgtaggataggccagccttccgggggcgtagagctcgcgtgggccgtcggatcgggatgggctctgacacgtgaggcggggaggctgcgttgcgggcaggtggccgtgccggtgaaaggaacggacggtggggattgggttggacgtgtttcgtggacggcgcggatggagccgtggaggaaggtgcagcgtcgggattctttttactgtgtgacccccttttttgtcccgtggaaacgaggccgagctgaagcttttttttttttactgctcccttttgcccctttctctctcgcagtaaggggctgtttggcaggactcctctccaagaaaatagctccatctccaagtttttttttgccaaacacgagtagtggagtagctccggctcttgaatcgcagctccatctccaggaatattctggagctcctcaaggggtactccaccaaaacctggagtcatatgtcctcatggagatggtaaaaaattacccaccattgccattggttacaaaaaaaacgattcgcttctattccacagtaccgtcccgttcccgttcctcattcgtgaaaaaatgtttccaccagagcgccgcccgagtctgcaggcaaatcgccaccgccgccaaccctagagccgccgccaccaagatggccggatccgcctctgtccaagatggatccggcctagaggaggaagtcccggccgccgagatgaccatgggcgccggactggagcatggctatgggcgcggcttccctcctcccgcaaccggccaggggcgcggctgcccgcctcctgctgccggccagtggcgcggccaggggcgcggctgcccgcctcccgctgccggagccgccctgcacccgcctcccgctgccggagcagccatggggcacggctgcccgcctcccgctgttggagccgtcctggggcacggcagccctgccgccggagccgccgtggggcgcggctgctcacccgccggcgccgcactggggcgcgggtcccagccgaccggcgctgcccagtagcaagctcgtcccccgcgtactggatgatagaagagcttttccccatttcaaaggttgtattggtgctcttgatgaaactcatatccgtgtgtcattgtcacctgatgagcaaattagatatattggaaaaactggaattcccactcaaaatgtgcttgccgtttgtgactttgacatgcgttttacttatgttgcaacgggtcaaccgggagctatgcatgacacaagtgttttatacaatgcattaagagtggatgaaaaattcttccctcatcctccacaaggtaccacacttgtattatgctctctatttgtgctaactgtgcatgtgttactaaaatgtatcaataatcatactatgctatcttttgtaggcaaatactatgttgttgacgcagatatcctaatcgtcctggttatcttgctccatacaaggggctgcaggaat

SEQ ID NO: 53619 - DNA, 771 bp, Oryza sativa
attcctgcagcccaccaaatttccaacaatccaaaaacctgataggtcatttcagtagttggctttgctgcaacactgaaaccacatgcttttgatggttctaattataagagatggaaagcacgtgcactactatggttgacagcgatgcaatgcttctatgtttcacggggcaaacgaagtgaaccgcctctctctcctgaggaggaggctaagttcgaggcttcggattgcctgttccgtggagcattgatcagtgtactcgctgacaatatagtggacgtgtacattcacatgcctttagggaaggacatgtgggatgcacttgaggccaagttcagagtttccgacgccggcagcgagctgtatgtcatggagcagttctatgactacaagatggtcgatgaccgttctgtagtggaacaggctcatgagattcagatgctggcaaaggaacttgagaacaacaactgtgagttgccggacaagtttgtggcgggtggcattattgccaaattgccaccttcttggtcggactttactatttctctaaaacacaagaggcaagagtttaatgttactgatctcattggctctttgggtgttgaggagaaggcgagagcaaaggacaactggggcaaaaatatcgagggaaattctagcgccaatttggtgcaaaagaagaaccctcacgcatcccacaacaacaacaacaagaaagtctagcctgatgtcaaacccaaggctacacccaattttaagaagaaagac

SEQ ID NO: 53620 - DNA, 1407 bp, Oryza sativa
aattcctgcagccccattgatgtgttaatatcaaagataatgccgtttagcattaattccttgaagcagctaaattcatcacaatagcatgttaccttacctagcgtagaaagtggatactcgttgatacggtggtcttgttaattaaatttctcactttggcaaaaaaaaatccatacaaaaatgaatatgaacaccaataatttgaggacctggcttttttgaagcctaattagtcctgctaacagaaaaaccacctttgattccctatttgctagaaatttaaccaccgagaaagattttgtacataactaatcgagctaaccgatatttcataatatttttatcgacccatacataaaaaccgatatacatctgacaatcaaaacttacatgtacacatcgccaaccatctcaaggagatatcacttcctccctccatttcaaatatatatatatatatatatatatacctgcgtgtttttaatacgaatttgggccaaattaattttgaaaaacacgtgaaaaacgctggcatgttccaaactttcacaaagccttagaaaatgagccgaaaaacccaggtcagagttctcaaaaaaaagaagaaaaggtcagctatcacaccttgctactcacacaggtcaacctaccaaacatacacaacacagaagagaaacttttagaaagaggagaaaaagaaaatgggtaaaaccccatcagaagccacagtgccggagagggtccaaaccgcaaaaggcgcaagggcgttggcaccgcaagacgcaaacgcaaccaccccggccccgagttggcagaagcgcaccaccaccccagtctcctagagtcccagacctcctcgccgtacacaaccccccctgcacccagtccaccgtgcaccacccccggccctatggaaaaccattccctccgcacgaaaaatggagcgatctattagcgcataattaattaagtattaattattcttttcaaaaatagatcaatatgatttttttaaataactttcgtatagcaatctttttacgaaaacacacagttgagtagttaaaaaaacgtgcgtgcggaaaacgaaagagaggagttggacgaacgcagaattttacatcatcgatcatatgtacgaaataaactccctttaattatttccactttctttaaggttaaccgaacagtgcctcacgctgctcgcaggcagctgcagtgtttaccgtttctggtttctactgctacgaaaatatgtagtccagaccacgtatgtagtgcaaacttggaaactatcattggatcgagaaatggacgtccgagattcgtccacgtcaccatgagttaaaatttaactcgtggattcactcatgagttaaaattttattgggagttaaattttaa

SEQ ID NO: 53621 - DNA, 2941 bp, Oryza sativa
  unsure (1)..(2941): unsure at all n locations
tggcaagtactctgttgtatcaattgttctgtgagcaatcgtgttgttggagctgaaaacattcatgttgtagtttgagttagaatgctggtgattttagtttaaattgggttaacgtttatttaaaatttgccttgtctatcattttcaaaaaagaaacaggaaatagaaaacaaaataaacaaatcctcaagggcttaaatttattatacaagtagcaatggatgaggttcagggccggccctgaggcagtgcggacggtgcgaccacactgggccttcaaaaattagagacctccaaaatatgtatattacgatatcaggtctgatagacttagaggaaagacaagactaatcggtgatcgagcatatcgtgactgcttgattgtactttaaacttgttagtgtgaaattcgttaatgacaaattagattttaaatattatcttgtatttttatggtgaatgggggccttctttttttttgcaccgggccacaaaagtcaaggccggccctgatgaggttggctatgatgtttcagcctaccagttacgcgatcaaccaattgtagcagctacatgtttaatgcgtcagctatatttgcctagtgataactagttcatccatgcatgaatatctctattattttaaaagcatagtcattctccctccatcccctcccccaccatgcgcagcgagcttgcacgcgtgaagtaacatatgtacgtaaccaccggatccactgttttattttacaatcacacttacagtctatttttatttatggttctatcctattataacgtaagagcatgtagtgtttaagaaagggtgaagctattttttctaactccacaactccagcttcatatcagattggaagccttcggccttagctagatattatgctacaaataattgaatttttcatcttcaaaacagcacaaaacaagcattttttaaaatcattttgaagcatcgttttattttggtagggcaacacatgtggccatggaatggcaggccacagagatcaaaggaggcagattattggagccaaacggcaacccaactctgacgtggcaacagagctagggcggtggaagggccccacatgcgtcctcacaatgaacagtcctttgcacgnngagtacttatngnggngtntttgggggnnncccccccccccaaaaaaaaaaaccccccattttggggggggggggcccccccnnnnnnggtcgcagtaggcgtgtatccagctcattttgtatgctagataaaccataaaccactttagtatcggtagtcaagtcacnttccttcttnnnnntctactttcgagcaatctatctgtcaagctancttgagttgtattctatccgtcccataatataagaaattttaagtttccgtcccataatataagaaattttaagtttttatttatactgtttaaccactcgtcttatttaaaaaatctgtgcaaatataaaaaaaataaaagttgtgcttaaaatacttgggataataaagtaaatcaaaaaaattctaaaattttttaaataaaacgagtggtcaaacaatacaagtaaaaactcaaaatcccttatattatgagacggagggagtaagttgtaacataatccaactgggcgttcgtttgagcgtaaaggttttgatttttttgctagtaatacgagatgaatcattaactcataactaattaacaattaattattaaatattttgaaaagtgatttaatttaaataaaatcactttgaaaaacttctatatagaaagattttgaagtagcttggcgtgaactaaacttcataatatataatttgcatgttattaaactctataaatttctataaatgatatcaaagatagaaatatttaacttaaaaggaaactggagtaacaaataacttaaaacaagagagtatgatagtatttttaagacaaatctcccccgtgtcatttctttctttttaagcctagctagcatttgatagaatatcgacgaataaagcttcaaaagtttgaatcaaatatttctcaatagaggtgtgtaattgttccaggcttcgggacagtctggacgagacttcaatttcctaccggataagtctattttacctccctctatcttgatcctgattaagtcgcatccctcaaaaacaaattgtataacacatatcccatctttaaaaaccagtgcaaatagactccttcgacgatttggaaagcagtttctcctgacgtggtaggttacccatggttaactcgctgaatcagcaagtgggtcccacatgtcagtgacttccaccttatcccatcttcttcctcacctctccatctctctttctttcctttcttactcctctcccaccttccattagtaacaaaggctgggcggcagcgacggtaccaatctttgtagctcgtaggggagtagcttgccagtcggctgcgcgcggaaggaggagctcatcgaccaagtacacaagcggggaggacctggcctgtcgggcacgcacaggggaggtttcactagccgcaacttgcgcagggaggagcttgttggccggtcgcgctaggagggaggacttgctggctggcagcatgtgaggggaggagacgtcggccggccgtgcgcggatggggggaagctcgttgtgtcctccaccaccttaacgggggcggtcaaaaaaccaatccgcggcaccaccactgtgtccgctaactcccttcagtgtcgaggcctcgttgccaccgagcgtcgcctcctcgtgcgagtcaactcgccaagacgaccatcgtcgcttctgcatgagtaaactcagccagtgtgtggtggttgtggatgtgtttggcggcggcttcctctctctccctcaaaggcctctcaacgacgacgatatttaccaattggggca

SEQ ID NO: 53622 - DNA, 1786 bp, Oryza sativa
tgacatgtgagccccacctgcaaaaactacttccaaaccaccagagtctatttgcactggtttttaaagatgggggatacattatacccggttttgtggcaagtgacacaactcaatctagagtaaaagatgagaagcaaaataggcatattcctttgctatcctgtccaagcaccaatagtgcggtactgggctgcaacttacggtactgggtgttggttcgaatcaggggttgagaccagctttttagtggctattcaataaacatagtttatttgatttttcaagaaactattcaataaaaaaatacatatacagcttaatatagtttaatagtttaggaagtgtgctcatgaaaaaacgaggcaatagtcatcccgagaagctgaagagcacatcaaattccaataaacttctacagaagtttcaggcatttcgaaatttttagactggcaataataatgtacgaggcggcgccgagtttgaattgcacccgctacttgtgcatgtcgacaccgttcttgttgtacagtgctaaatcttcattgtttttaaactcgaaacatttttttcccttttctttttctctattttctgagacctatttcagtattttggaaaatttttggcaagttcagtagtgggctattggccagcagtgcaagtgtgtagtccctccatctcatagaaaatcaatttattactggatatgacacatcctaatactataaatttagataatatttattcagattcattgtactaaaatatatcgtattcagttgtaggtttgtttttcggggagggagtacaacgctaaagctactgcactcacacctagaaaataagaaaaaaaaagatgcgcccttttgtccctacagcttcactcaccaataatttacagcatcttgattcttgcagtgtgacccagccaccgccaaaaaaagaaaacagaagaaggacgaccttctcatggaagatttacccaggctattaatctgaagaggattgtttcaaattagaacgatatatattactttcataaaattctataagctcttggagtcgcttaaagcgattgatggctcagataatttccattatcgtttgtacactgtcaatcaaaggaattcggtggcctggggatcaaaaatcttcagatgcaaaatgatgcattactactcaagcgccttttcagcctctaccgggtaaactcctggtccaattggctctggtcagaagcaaattcgaattcaaaatctctcgtcgaactcggcaagcttggacctcactggcattctatatctaggctgtgtttagatccaaagtttggatccaaatttcagtccttttccatcacatcaacctgtcatacacacataacttttcagtcacatcatctctaatttcaactaaaatttaaactttgcgctgaactaaacacagccagatatctaagctcattccccagctggaaatcctaacgagggcgcaggacaacaatggacttcgcacatccttttggaatgactgctggctcccagacaaatgcttccgtctacagtaccctgctctcttctcgcactatctgttccaagcggcgtcggtttcctgaagatccatctgttctactctggcgccaagactttccacagccgcttcacaggagctatcccagcttacaatgacattgcaaggtactccctccgtttcgaaatgtttgacacccttgactttttatcacatgtttgaccattcatcttattcaaaaacttttgtgaaatat

SEQ ID NO: 53623 - DNA, 5218 bp, Oryza sativa
  unsure (1)..(5218): unsure at all n locations
attcctgcagcccaaaaacctttttacaaaaacaatcctgcagtcaccttacttcctccgtcccaaaaaaaaaagacaaaccctggtttccgtgctcaacgtttgaccgttcgtcttatttgaaaattatgaaaaatattaaaaagacaagtcacgcataaaatattaatcatgttttatcatctaacaacaatgaaaatacgaattataaaaaaatttcatataagacggacagtcaaagttggacacgaaaacatagggtttgactttttttttttggacggagggagtatgtgccatctactagacaggggacgaaacgtcgaatcatctcttcttcatgtgccccttcgcatcagctttttggacgacaatcggagttatacccaatgtggccgaagtgagtaacattcatcttttagcccggccaccaaacataccttcaaaacactacaagaccttctatctactctgcttatggttatggcgtctctggaatcaccgacacgatgtcgtcttccgcgaccttcagccgtcagtccaacggctgatcctgcgctgcaaagaagaattatcactctgggcagagcatcttaaagttaacgacagattagaggctgatgcttggtgtagtatttttttcaaatagtctgtcttctctacatccataatagctagccctagggctaatgcatgtaccccccatgtaatctaaacaatgctttttcaatggaagattcaggtgggaacctctcccctccagtgacaattaaaaaaaaatactatttcactctatatgttgtgttgaggtattgtaaaaaaaaaaaaactaaactatttcactctatatgttgtgttgaggcattgtaaagtactacttcctccattccacaatgtaagtttttctagcattacccaaattcataaaaatgttaatgaatctagacacatatacattaatcaatggatgaatctaagtaagacaaaaaaaaatcttataatataaaacggatggagtataaagaaggaaaagtatatttaggtcatcggggaataactatatctcatcagtgccttttagtgatataaaaaagataaatggtaagaacaattcaggctccataatagggtaaaataattcacattaaggttgtgtacctcatcgtaccgaaaatggaacagttcattagtccgtgattaattcagtattagctaatatttttgaaaagtggataaatataattttctaaaagcaaatttcgtatagaaaaaaattttggcaaaaaaacacattgtttagcagtttgaaaagcgtacacacggaaaacgaggtgagcgagttgggaatcaaagaaaagaacgaagccatctgaatagcactatgcactaaccagtgatgacaataaacattgtcatgtgccatgttaaacctggagatgaagctttctgaagcatattttcagctatagccatgaaatggcatgtagcatttgtagggcaatggacctcaagccaagtttggaagagcatccctgccttgccaacctcgcaacctcttctactgcgggcatctccttcaatcgcattccattccattccattccatccgatcctttgctttcttcgccggaatagtccacggatcgaattccaaacccgcgaggaattcgatcatatatctagctagctacccctcgaaccgatcaacctcgcgatccccaagaaaatccaaacatccgagacgccatggatgcagctcttctctcggcttcgacgacagcgccatgtcgtcatcttcgtcttcttcttctcccatcggcggcgccgccgcgtgccgggacacggagcagcaagagcgcggcggcggcgggggtgagggggcgagtgcgcgtgaattccctgttcggcgacggcggcggcggagatgacgggttccgggcggtgaggaggctggtgaagctcaactccgccgtgcagaacaggagcgtcagggagttgctcgagctcgccggcgacgagtgcctctacttcttcggtagaatctcctccattgacgtttcacaagtgagcaaggtacaaattaactactccctccgtcccgtaaaaaccgaatcagaactggacgtgacacatcctaggacagagatatgtccatattcgttgtattaaaatatgtcacatctagtactaaattggtttttatacatatatatggaaccaatgctatatttttttttcttcaaaacaaaaggaatcaatattcaactctagaaaaaaaaatggggttctttttaggtgagtgattgctctgtttcgaaattagaaaaataaatgtggttcttaagaggtagtataccaattattttagaatgaactttagtacttttttatatctaagaagtactccctccgtttcacaatgtaagtcattttagcattttccacattcatattgatgttaatgataacatcaatatgaatgtggaaaatgctaaaataaattacattgtgaaacggagggagtaccaaatttaacagtttaaaactatgatatctccctctatctcctttaggaccgtaaaatcacactgtcaagaaattgatttagctgtctctattgttcaaattttaaccaaaattttcaaaagttctcaattaatcagtttaataaagaacaatatggttagatttatagaagatatgaggtagcatccaacgagtttggagcaagtaaagggcagcatttttttacacatttcctgcttttaacagaacatgtttctgctcctccacgcaatgatgcttaggcaccacgtatcgttcgtgctcaagccgactgaaaacgaaggcttcgacctaggcgtcaaatggtctctaggtgtggtcagaaataacctcacctgaattggcttttgttactgcattacaaattagtttcagaaagaaaaaattactgcatttaactgcgttttgccttgcagaatggaagggcaagaagctgccttgggacctagactgcaacatcaccaccaatcacgtctacaggggcatgctgctcattaagtaaactaatttcagattattatttttcagtctgattaaattgaaccttgggtcaacttgttactatttggcttacccagtagtataaaccatgattagcaatttagcaatatacatgtgaacatttttacattagttaacaatgttggatttacggcagaaaaaaaaaagaggtgaagaaactgataggattgtattcttgttttgttgttgcagtgaagtgaacaaggtttatgtgccactacttcagaggattcttgagataattcaccaggcaagcatttacagtgcagaaacatgctagcattcaataaaactttcttgaaccaaaaaaaaatttgccccccccaaanaaaagaaaaaccccaaaaccccccccccttttttttgaagnnnaatttaacctttttttaaccgctgcagaatttggatgcggtaattttgacattggcgaataagcttctgccagaaggtactcttgatgagagtaacaggaggacaatagtcgcatgtgccatcattggtctggtggtcatggtagttttctacaatatgttcaagaacttgtaggtctattgggacagcaataacacttcataaatcataagcatggtctactgtgtagagctacaagaacatgttgtaaataatcagcagcagatgtagaactggtggcaggtgaagcgacaacagattctgaaacaccacagcactatgcaagaacacttcaactgatgcgtataagcaaaggctgaaagagtgcctgtctgatgatggttaggagcaacaaccattcattaatacgatgaacaggagcaaatgattaatgtgttgatgacaatctaaaactgtaaatttaaattaagcatcaccgacaacataatacagggagagcacaggtgtccttttaacaagagcactaacaatgtaagaggctttcaagcaacaaaggtgaaagcaactacttaccatagaacgcacctatgcttgctgatttttacatcaagcaaagttcatcagctttaactttgcttcggtgctgctttctactcagtatttaacaagctagaaattcaagatagcctaccacatgtgactcttccaagaagactcaagactacataatatgcaacaactatcattctttttccttgctactgtgaagagattagcctacagcctttttctcataagtaaatcagtttgatggatacaaagcatagaataaacactttcagcattttctgttgtttcatcagcgcctactaccagggtgttagaccaactagagtccagtaagacgattcatctgcaaaacaaaacaaaacaccatcaacttctgccttaacatataagatatgcaagataacaccttgctatagatgaaatagattgagtagtttccagcacctaagagccattataataaaattaaggtgcgaactcggtgcaaggaacaaacagggaaggagcagatccagttactttaaaaaattctgatattgttcaacatcttcctatactaactaggagttgcaagcagggatggatgtcatctagcaaacactaaccagtgcaagtctcaatacatgatgttgttctgaaaggaaataactaaccagttagagcttgttaggttgcttgaaaaggtgttgtgacagcaactccgaaacactcacggcagttagactttcacatccaaagagttgtttaagttttgagtcgcacaatatcatggtgggatttgctggatcctgcaacaaaatcaagcaagatagatataagactgaatccgcagtagtttaattgaactagaacagcaagatacaaggatctcttgtgtgctttacagagaacattgaaaatggcttcagtgaggaagagaagtcacaaatataagcaaaagcaatttatacattatagtttatgttaatgaaatcctggatggataatataaaatctcttgctaaccagatgactgaaaaatccaacctataaatgcctagcagcaacctcttgtcttcatctagctatgccaacaggcagattttcaataactaccatactgggccatctccatgaacagcaaaacaaactaatatggagaaactagaagtggcgaattcttttgcatgatggataaaatagaccacaa

SEQ ID NO: 53624 - DNA, 4246 bp, Oryza sativa
atcttagcacttacatttgttccctagtaagtagttcttagttctaactacctcacatcaacttgatatgctttgatcctaaaacacaatttaggtactcgtttataactgaaatatgcattgcctgttgtagttctccatgcttggacatttgaaatgaccacaagtttattatagcacaacaaattcaaatgagatgatgagaactatgtaatacacaaaagtttggtaataatcactaacctctaaattattgcttttgatgtggtcccaaacacgcttaacagcctcagacgagggcatctctttctctccagtcccaaaaaagctcgcaagagcatcagacaagataattggaagctggttaacatcagtttcagcaggagaaatgggttcgctgtcgacaggcttcaacttctttgaatctcgatttgaatcttctgcaagaattttgagcacttattccacaaacaaaagcttgattattttgcagaacatagctggagagtgaagaagacctactttttgcctcaagtggtctaatatgcttagctaaaagcttgttcatcttgaacatatcagtgctatctgtctcaaagactagacgcagctcatcattgcagataatctttctcttattgtttgggtcctgcaagttgttcctgcgaatgtatgcccaaagctgcttaacgatctgcagttgagtcacaacgtcagggtttcatacatgatgtaatagttaatacaagataattcactagagaggtgagccagcagaacaaacctcagttctagccatggttggttcaccaacaatagcttgcagctcaggagaaacaccacagactttgtttagcccacctggaccacctcttctctttactccagtacttgcactggttcgtaaacacgaccaaggaaaaaaaaaaggttcaatgaatagaccgagcagtaaaatatgctagcatttagcaagataagggcacatttatctctctcatagtctgtacaccggatttcatatcaggaacattcttccataaagacacactgatgcttcttggacattatgtctgaacaagcacatgccaaatagcaaatctaagagaagttccttttttgaaagtcaatctaaatgaagtaaacacaaataatatgatttggaagttaatcaagtggagtaaacaaacatgataaatatgatctggaggttaaattccagtttccagatgaaataatatggaaaatccatttgtttagcacaatgaactttatcgttacgattcttagtttctaggccaaaggaggttgcttgcatggcaatcattttgaggagaatgacgggatccattattgccccccaacaagttcagaggcattaattatgctggtatggttgacatccctacggcagtattcaaagattttctcaagtacactagaagtgattccacaagcgtccgtggacattaaagatgtagtacaagcaggcaaaccaattgaatcgctcggaaaccagttccttccagattaccccacccccactaaatcatcgtgataaatatctcgatccacagtagtaataaagattaaactcatcaagaactttgtgagcgttaaagagaaaaaaaaaactagtagtagcgtttttagtcttgacctaacctcaatgcgccaaccaaatctgaaaaatcggagcgagaacctaaaagaacatctaatccaagccctaactcgaagcgaaggtatgggaaatcgaagaggaaaaacaaagcgtgggaggcaccacctctctttcttcgatgccgccgcggggcgcgggctctccacagccgtgggcggcgcagcggccacccccgccgccgccgccgccatctgctgctgctgctgctgctgctgctgctgctggtgatgatgcatctggacgagcctctgcagatgcgccccttcgtcctgcgggaacggctgcccgtacctgtaccccgccgccgccgccgcgacgccgtacgccgacggtggcgccgccgcggcccccgcgccgccgcggtgctggtactgctgcgacgccgtcaggaacgtctgcagctgctgctgctgctgctgctgggagaagaagtggccagcagcggcggcggaggcggaggcggaggcggaggcggagggggagggagcggaggaggtgaagggggccccctgcggcgggggggagaagagggcgaggaggatgtcgcggatgaggggggccttgggggtgaggtcgaggccgagctgggggccgagctggcgcgccacggactccgccgatatgccccccgccgccgccacggcgcccgggacggccgccgcctggcgcacgaacgactccacgtaccgggccagctcctggtcggacaacatcggtgacccctcctcgtcggcggcggcggcggaggcggcggggttattttgaaatggggatcgcggagggggttggtttttttgggtgggtggttttgtggttttctccggtgggagctcaggtggggatggatggatgaggccgtgtgagagagagagaggggggaagggttgttttgatggttagcccctcgttttattgtggtcttacgtctgtacccctgactttccaagtactccctgcttaccggtttatgcgggcttatattttcgcttatacttatacttatcaggtaaaatttaaatttttaaccttaaatttgaagctgattttaaggtttttcatcgaagtttattttttagccttttagatcgctaagaacacgtatataaaagttttatttacaaattagtttttatttgcatatataccgtttcgcttatacttaaaatcagccaaacaatggctctgatggagtaggggggaaaagttatggactcatcaattacccaaaagtatttataagtcgtaacggtttagtaatgaataaaaaaaattatatgtaaaaaatttatatattttttatcataaaagctaatataaaaaaaataagttgaaagtatttactttcaacttaaagttttaaaactattttaatgttctaaaattcaaattttgattttggcttattcttttcgggtaacctatgggatggttagacaaacaatagttttgaccttcagtgttggtggtttcaaagtgttggattttgtaggttattctctgcccacctagctattgttacaagggggttagttacagttgtttattaaattgaactaaggtaaaatgagaactacacaattagttggttgctagttatgaggttatgttttacgcatgataaagaagccatgtaaagtggtgaagcatacaataaatagtgtgagggaatatagaaataatgaggaatgagtcgtttatattggtagtatctcctgctttaacagcctattcattggatcttgatccatggttttactggaaatgatcgaaaattatcatgtcctatatttggagatagtagttgtgctcagtggcgaatctaccatggggcggcagggtctcgagcctccgacccctcactaccaacgttttaaccatggaagtctctatttaagtcccgctaaaattttctgtcatacatctattaaaaaggttatataattttgtatagtttattcaacctttcctttctggatcttcacctggttgttctatatacaatgtgctgcttcgtactatagttaataacttcaattgaagactcaacatctcaaattgattcactaaacaaatcctaggatatcctctcttccagtaccgattgcattgataagttaatatcaaagataatgccgtttagcattaattccttgaagcagctaaattcatcacaatagcatgttaccttacctagcgtagaaagtggatactcgttgatacggtggtcttgttaattaaatttctcactttggcaaaaaaaaatccatacaaaaatgaatatgaacaccaataatttgaggacctggcttttttgaagcctaattagtcctgctaacagaaaaaccacctttgattccctatttgctagaaatttaaccaccgagaaagattttgtacataactaatcgagctaaccgatatttcataatatttttatcgacccatacataaaaaccgatatacatctgacaatcaaaacttacatgtacacatcgccaaccatctcaaggagatatcacttcctccctccatttcaaatatatatatatatatatatatata

SEQ ID NO: 53625 - DNA, 12505 bp, Oryza sativa
tttctcgatccaacggtagtttctaagttttcactatatacgtggtttgcattacatattttccctgcctacattgcatggccatgctgttggattttttttacctttttaattttaaattttaagaataaactcttttaaaacttattttcaagacatgaatctttaggccacgtcagctgaattgtgtgcagtgtcaatatttttttttcacgtcagacggactaatgtgatctcgaaataagtttagaatctcaaaataagtttttgaagattttatttttaaaattaaaaataaaaaatttcacaaaataaaaagaaaaaatccatatttttgtgtaggagtagtatggtagtatcagtcagggcctgtttagttcgcgaaaagaaaattttttaggtattatatcggatgtttgaccggatgtcggaaggagttttcagacacgaatgaaaaaactaatttcataactcgcttggaaaatgcgagacgaatcctttaagcctaattaatccgtcattagcacatgtgggttattgtagcacttatggctaatcatgtactccctcaattctaaattgatctacatattttatagatacaccaagaccaagaaaggctaataactctctcatactatatttactctagcaacaaactcgatacatgcaccatccctaatattttccagccaatagcaaatcaagatattgcatgtgggttataaatacttgtgtgcatggatgcatgcatcaatgtccatttactccaatgcacaaataacgagtagacttaataaatgaacacaaatatgtagatcatttaggaataacctaaaaaaactatatgtagatcaatttggaatggagggagtactaattaggcttaaaagattcatctcgcgatttcctcctaattgcgcaattagtatttttaatctatatttaatgttttatgtatgtgttaaaagatttgatgtgatattttttaagaaaaatttttggggactaaaccagccctaagcttgcagcttgcagcgccatcatgcctgtctgtctcgcgacgagaggcaggcaggggccgcagggcaggcatccgatgccaagcgagcatagtagaacaacagcacaaacaccttttgatcatagtagcagcagaagctggattatcagttctgaatatatttgtgatgttgtgctcctgatctgtagtagaagagatcataatgatgcgtgtgctcggttcagtgctgcgcgcgcgcagcaggccagcagcattgctgctgaaatcggcccctttcatttgcagtactcccggtaaaaacatacgaaatttcagggatttcaaaggcaaaatgctaaggaagcttttgaaataaatgattgaatcacatctcttatttgaaattcatatgaaatgaacaattccatagagattttaaaagagggttagcaagagctctaatctctttggaaaatttccattcaagtctatatgtctcatctgattcttatatttttcccgtggtctattcaaatgatcattctatttttttccatgtatgttttgcaatcatctgttttgcacttgtgttcttaccaaaatcctacatttcttcatatgatttttttttcaatcatgtgtttgcaaggaagcctaatagaagtatgtaaacatagtcatgttgagaggttttcttcgacgcgtgaccgttagcagagaccagaaatataaaccatttccatcattgaaagaaaagttagagagtttttcgttaagtcgcattcaaaaaaaaatccatctttttcagtccggtgaatcctgcatgatcaaggcatgatcctgattcagttcttgatcctgtttcaattcttgatggatttgttcatgtgcagtgatagtgctgctaatacgttgtctatatgtaggaaaaggagaacatccgtatatccgcatggcatgcagaatcttcttggtccacggtctcctctgcactctgcactataccacccttttgctttctcgttctttctttctttctttctctctcccttgctctttttttgcatgttccaaggtgaccagttctggaatttgggcgtaggatttgtcgacgcaatcattgagccacaaagaaatgcagatgtttcctcctgcgaaaatggacccgtcggagacgaaatttgtttctgcctttttggggtccaacgaaacaaacttggaagctggttgggatttgaaggtgaagaatttgttcatggggagcaaggtttttagtccatgttcaaaattcagagactatgaattgctccctggccgaccgttgtagtagctttcttggttaccaaatggagaggctgaggaaagaaaggactagttttaagacagaaagggcctcattgtttttttctctacaacgaatcagcccaaaatttgaatttgaaaagttaactttagaattatttttacgatattgtcaacgtgtttcttttttaacattgtctttacacacaaatttttttttcttcccctaataactcttagccaaccgaatgaccgatagaaccgaaagaaacttcatgcccggttgggagggcttatttttgaaggctacagtttgaaagtctccattttttcgttctggcataaaaattgaacttttctttctttaagccttttagctgtaaacacaactttaatacccaattgggtatcacttgcatgtggttcttccttgagagtacatatgatcagtattcagacttcgtatgtctgaacatgcgctatgcgtctaattaagaaaaaaagcccagtagcccacttttcaggttatgtaacattttctttagaaaatagattaaaatgcggcctctacatccacaatggatatacacagcccaggttctgtaacatatggaacagataccgtgaactcatcagaataacgagcaaaaggttcatatttcagaattcaatcttttctcggcttcagctacagctacagcctcactcaagtcactgcatcaacggacatgctaaagccaacctagacacaacatagttcatacaaaggcgaaaaacatcaaagcgtataagtgaatcgcctgattttttttcaggttttaaaggagaaagttcatacgaaagcgataaatatcaaagtaaaaagtgaattacccgatttttctcacgataaaatctcgttggtacagctcgattccatttccacctacactagctatcaccttcctcccatctgttcgtttgtggcctcgccgtcatcctctccctctcaaccttctccaagcatatggcgatacaatttaacatcatcttttgtcttgacctcacctctgaaaataaaaacgaagggagaaggaaaaaaaattgctgggtttccacggacaccgcaaagcgagatggtaggggataacatccgacgtggacgctcctgcgcccttggcttgcagattggctctgcttggactcaaccaaacctgtcatttttctcactcactcactaactcacaggccatacagctctatcgcctcagccagccagcaagcaaagcgaaaccggattattattatttctctcccctttctagctccaatttctactcaaacagtaggatcacctctgcagcttgcttaactaattatctctgatgcaaagctttcaacaaaaaagaaaaaagaaaaataatttctggtgcagctaacaccttatcagatacagggaaattaagcagacatctgataaaattgggacgataaacaggacatatacatgggattgacgaagccagattactgtgtatgagtagtcgttacacactgtcaaaatccgtgcgctttgttagcatgctatgccagtgatggctgcagctagagctagagcagagctaagtagcagctaagcaccactccatgaggcgagctacgagggcctcacgaacagaaggcaccggcaaggccccttatctgccacgtcggacgggtgtgggccccacgaaaggacaccatggctccctatatagccttcttcagcaccctatccatcctccctgcctcctccttcgcacgtattacgtgcgaaaaaaaaaatcatcagcacaagatcgaggaggctttatctgaacaaggtacacacatccatctccattagcgtcttctattagatcttcaatgatcgtaggtgtatgagtaaattcagtttagccatatggttggattttgtatgtgcaagaagaaattgaaacttagactaagttcagagaaattttgctttgttattgtctagagctagcaacttgaattttcaaaacagagagccagtagccgcatgaattgatttcttctggataagcacgagttaatctgccaagtaggatcagagcacgcactaatagtcgtttctttaattaaaaaaaaggaagaaaggactaatggtttccttggataagtgaaactgtccaaattgataacgtcttctgcgttattagtgacaactagtactagcaagtactcctgcctttgtttttctttcgagatagtagtgtactgttatgtctaactaaagccatgtattaattatatgtttgctatgttatatagtcggataattagagcaaaacaattaacaaaccgtatatagtacaactaagatagtaagatgagattatcactagtcatttttcaaagaacactttcagaaggttatattaggcaggagtttttattgctgtgggacgaataattattttttgtttgggcctgatgggcctttgtgtgtgtgtgtgtgggcagggagatggcggactacgtgtatgggccggggcggaaccacctgttcgtgcctgggccggtgaacatcccggaccaggtgatccgcgccatgagccgtcagaacgaggactaccgctcgccggcggtgcccgccctcaccaagaccctcctcgaggacgtcaagcagatcttcaagaccaccaccggcacccccttcctcttccccaccaccggtaacccaaccaacctacctacctagcttcatcgatcgaccacgtccatagctaagggttttaactggctaacccgcaaacccgcttacaggtcaataaatgggtttacggtttattttaatctataagtgggatcgtaggttaaccatttacaccttttatctatggtggcgcccgaagattgattgattgcttgcttgcagggacgggggcgtgggagagcgcgctgacgaacacgctgtcgccgggggacaagatcgtgtcgttcctgatcgggcagttcagcctgctgtggatcgaccagcagcaacgcctcaacttcaacgtggacgtggtggagagcgactggggctacggcgccgacctcgccgccctcgactacaagctccgccaggacccctcccactccatcaaggccatctgcatcgtccacaacgagaccgccactggagtcaccaacgacctttccgccgtccgcaaaatcctcggtaacatcttgagctttttatcactttcttgtcttctttctcttgatgaattactcatgctcatccatggcaacgatggacgacgatacgcgcagacaagcacaggcacccggcgctactactggtggacggggtgtcatcgatatgtgcgttggacttccgcatggatgagtggggagtggacgtggcgctgacgggttcgcagaaggcgctctcgctgccgacgggtctgggcatcgtgtgcgcgagccccaaggcgctggaggcgagcaagacggccaagtcggtgcgggtcttcttcgactggaaggactacctcaagttctacaagatgggcacctactggccctacaccccatccatccagctcctctacggcctccgcaccgccctcgacctcatcttcgaggaaggcctcgagaacgtcatcaagaggcacaaccgcctcggcaccgccaccaggtcggtcaccgaggaagaacattttgacgtttagaacaagattcggtcaaacttttgaacgtgagattctgacggcgtgatgtgcatatataggctggccgtggaggcgtgggggctcaagaactgcacgcagaaggaggagtggttcagcgacaccgtcaccgccgtcgtcgtgccgccgtacatcgacagcgccgagatcgtgaagcacgcctggaagcggtacaacctcagcctcggcctcggcctcaacaaggtcgccggcaaggtgttcaggatcggccacctcggccacctcaacgaggtcagtacacacacaactctgcagatcgatttgcagatgaaaattattgcagcaacatctgactcatctcattgatctccataactctgcagctgcaattgatgggtgccctgagtggagtggagatggtgctcaaggacatcggctacccggtgaagctcggctccggcgtggcggcggcggcggcgtacctgtcgaattcgacgccgctcatcccgtccaggatctgaagcacaacgaacgaaggaaggaaagcaattctcagcagcgatggttctgcctgcagtttggcagaacggaacagcggcaaattaatcctattgcatataatttggtctctgtatgtaaagttaaatttttatacgctccatcgatcagctctatgctaaggagtaaggagtataattttgtgaaggtactgcagcttttacttaattaatcttgaacctcgatgtatacaacagtgaacagttaaattaatcatcattccctaatgcctcttaattttaactatatatagatcgatcgactgatctgtttctttcttcttcttcttcataacaaaagtacttactccattttatactgtagttgcttcgatttttttcagaatcaaaccttttaaatttaatcaaatttatagaaaaatataataatatttctaatacaaaacaaacatattatcgaaatatattttatgttgtatttagtgaaattaacttggtgttatagatactgctaatatattttttttataaatttggttaaacctaaataaatttgactcagaaaaaagtcaacgacttataatatgaaacagagggagcagtgctccgtaagattgtaacaatgcagtagttcaaatccaaattaacaccaaattcaataaaatttaccaaacaaagtactcaaattaatcgtcgtgggctagttcaatgtggttaattagctagctaggttattgaattaggcggccttggcgagctccctgtcgacggccaccttgaggaagctgccatcctcgacgaccatctggacggggaggaagccgaggccattggcgacgacgagcatgacctccttcatctcggcgcggaactcgtggaggccgaccttgccgtcgccgtcgcggtcgaagcgggcgaagaggccgcggtagagcccgtcgtcggcgccgccgtggccgtcgtcgacgccgaagtgggtgtccagcacgcggagcgccatgagctccccggacatgtcggcgtaggagaggacgccgtcgcggtcggcgtccagcgccgcgaagcgcccgtccaccgacgcgttgaaggcggcctcgtcgtccacgaagctccgcaccgtgctcccgtccacgatctccacgctcatcttgacaaatgttgttgttgttgttgttgttcttgatcttgggggtggtttgttgtgtgagtgagatgcaagcgtgatcgccgcgttttatagcgacgccggcgagatggagagatggcgcgtttgtgcgcgcgtatggtttttgaaaggctgagagagatcagagatgctacgggcgccgccgccggggcgtgtgtgcttgggagcgaattgaagcgaagatttcacgggattcgccgtgtttttctttttcttttttttttttggcgtgagatttgtgggcgaatgaaggatgtgcggagacacggagttagtgtcagttgggggtgtcatggtttctaacacttttgggtgtgtttagataatgggaaatgaggggtgggattaagataggaaaatgaatgaagggtttgggttaaatggaaaagggagaatgaatggttaggatttaaaaatgggtgggaaattatttccctttcccatttgacaaacactgcctttgttcacgcgtgggtcactaaaacctctaccatgaatagaaatttaagcggatgtgaaaagacatgcaattcacttatattccaacattctttctcacgcgagaatccttaagcctgatatcatgtcgaggttttagtgaatataaataggttgtaacttttattaaaaaacaatcaggatttgaactcgagacattgaactctgatatcatgtcgagttataaacacataacagcttaactcgagagtttaaaataataagaaaatatggataatttatttatttttgagtgtcattatgcaagaataatgagtgtattttttataacttgttaagatatgtttgtgttcgattgaattggtgtaataattgatcgtaactatttgagtaacgacctagattatatttcattattacaaaaagaaatagctagagcaaagggctttggagtttggaggtggtggacggcggttgggaatcaaaaaaaagcggggcataggtgtcaaggtcggcacggtgcatttggcagtgtgaccgcgtgggagcgaaatgcggtggctttgccgggttgcccccggcgacaagcatggaactttcggccgacgaggcaacgagaacgatgggctgccgctgcgttttatgttaggccgaaagaaaaccaccaggggttcgcgattgagcatgctgtacgctgtcagctgtaatgtgcgtatgtacatggttgcttgcttgtgcattccgccatttgattcggcccatatggttggatttcttttctaaatgaaaatatatacattaaccaaataattacgggaaattctgaaagaaaagatgcccttgttccttattaaaaaaaagaaagaaagatcgcacaactacaaaacccctaatagggacacccttatatgtatcggttcatttaaaaccgacacatatgaagcttttcccgtctatccgacatctcacataaggctaaaatttaaaaccagcacatataagtatctatatgtgccggttcgtattaaaaacctgtatatataaggttgtcatattatatgtgttgggttttttttaaaaaaaaagcccgaaacattaaatcaccaagctgagctaagccatggtccgttcgccctgacttatctatcacccacctcatttccggttttggcatctcctcgcttttctctccacactctctctcagctcttcgctcttttctcctcagcttctcctcgcttttctctaccgagtcatcagcaacgcgtgattctctcctcagcggcaggcaccttccccacaacggcgcctcggcggcggcgccatcctcaaggcgatggagacctctccacggtggtggcaccctcctctcgggcaacgccactctcatggtctcaccacgaatgcgcctcatcagtggcaccctcatcacgatggttgtggcaacctatccacaacacggtgccctccccttggccctgcgtccccacaaggtcagggttgctagatctaattgccacaagctcgaggtcagtgagatcgaagcgatacggtgagctcgacaacgatagttccccgacccgatctaatggtggtaattgcggtcgagcaacaacgacagatacacctcgtcctatcccccaaaatccccctcccggatctctcccaccacccactagatttggtcatggcctattggatttttgagcagtgatgatggtgggcggcggtaacgacctcagcctccagtgagatgcggcggcggcggtggccttggcctttggtgggctacgacaattaggcttccatgtattgatttgttattttgttttgtatgaatggtatgggtttgtaatgtttgggatgattctgattcattgcagttggatttgcgatgattttgaggctcaatttctgaatattgatcttggttcgaagcaatcaactcgtcttgatgaatcgagtcgggcccgatgcttttttagtcatgaactccccatagatgccgattcccaatccggctgcgatgagtcccctcatcgtaccgtcttcgtgttaccggttggagagtccgatatctatgtgagattcccaacatctattaggttttctatagtagtgtcaggaaaagttataacttaactttattttaaacgtacccttatttttatcttaaaattgaagttaccacatacgtcctatactttgctctaagtttccatcagtaccacaattttggactttataatggcagacgcatcctgaatttgtggaggttttgctttgatccagatgggccagattgacgtaggcccataggcaaactttgtccaataaatgggccaatccaagtctagaacacactcttgctcagttggttgctcttgcttggtccgtgaggaacaacacattacctcatctacggcgcatccaatccagtatgacggcgtccagtccagtaccaaaagcaacacaggattagctcgtcgtacccacacgtactagagttgtagtactactacgttgcgatcaacaaacgaaacggacgccgctgattgccgatttggcatggcttggaagagagcaaaaacacagagagagaaaaaaaatcagaaatagtactaacctgatttaaaatgttgttacatagtattggatgtgacacatcacagtataatgaatctgaatatgaaccaatagtccaattagtatgcagcaatattttgggacagagctactagttcattagcggccaaataattgaaccggtaattatgcttgggacgtctcaaacccgcatttgaatgctcttcaggcatcacatggatgggagctacaactattacgacaagcctgaagtggtaggagcagtcagtgcttcacaatttgttcaatttgctggaagttttgatagagttgcaatgcatccgaaactgtgtgattttgataggagaaccgataattttcgtagcacacaaaccgataattttgataggactgtcctgttcatttccagtaagataaagttttgcatattcgtggcacacttttcaaactactaaacggtatgttttgtgcgaaaactttatatgtgaaaggtgttctaaaatattagattaatccatttttaagtttgtaatattaaaactcaattaatcacacgctattaccacatcgttttacgtaaaacacttaatctttaccttcatctatatcttcaggagattcaaccaatcctattctcttctccaacaaaagttggatgaagattgagatttttatggcacgcttttcaaactgctaaacgatgtgtttcgtgcgaaaactttatatatgaaaattgctctaaaatatcatattaatctatttttcaagtttataataattaaaactcaatcaatcatacgttaatatcacccacgtaaaaaacttaatctggaaaagaacaccaaagatgaagataaagaagtgtgcattttgcagatcaagtaaaccttgtactcttgtggtagttggtgaaaagcagaggaggcatactgaaaggccccaagaggccaagaacaaggaccaaggtctctgctcttcaagtggtccaagagagcatcaaaacctggaacactagtactagtactcctactccaagattaagagagaggttaaagaaattgaaagttgctgtgggtcattaatggcagtcttaaagtgcagtaacacagatgccgctctggtttcttcaaactgaagggaaagcaaaacaagagttgagtaggagtacaatgtggaatgatacagcatgtgattgtgtccatgaagaaaaaacttgtgcttaatttcggcatgctgggctttacattctcactaattctgcttttgtacaccatgtgatcctcatttccaagccatttgattatgtcgattgcaaagtaagttataggagtaatgcttggtttaagcttgagaattgagagcccagctgagcatgacagctcaagaaatgcatgctaagtcccctttcatgatcaagccttcctcacctaccgccggaaacagctaatgactctgcaaattttgtctgattaagtactatacttaactacaccggatacgagccaccgtcagggcaggcagctggtcctccaccgacacaatctgctgcgacctcacgtaatcacatccagtttagagcttaattacatggagcttgtcgaattagagttagaggtagtagttcagaacttcagaatttagattcaggaatgtttagagtttcagactgtcatgcactgtcaatcgtgtggaaagaaaaaaaaaaagaaaaaaaggaaaaggagaagagaaggcaagaaagagaggagac

SEQ ID NO: 53626 - DNA, 5529 bp, Oryza sativa
aaccgagccgccgccctctcctctcctctgtgggcgcgcgtgccaccgccatcgcacgccatgggcgccaccgctaccgcggtttcgccgagccaccatgtcggaggtgagcacgcaggggcaccctcccctcgggcgcagccggcgacacctccccccgcgtgcaccaagctcgccgatgcctccccccgcgcccgccgccgccctcttcgccccacaactccggcgctggcccccacgtgtccgttgtcggcaacccctccccctgggcgcggtcggttcaagctcgccctgccgccatcgagctcgcgcccgccctgctcgtggcatcgccgtcctttttttctttccgccgcacaccgccgatctctggccactcgtcgccacgggggcggcaacgtgaccagctgcctcccaaggccgaccgcgaacgcctccttgccgaggaggtactctacctccactccctctggttctgcgccgcccttgctcccgcatcaaccggcggaggcacgagagagaaaaaaaaggaagaagggagaaaaaaataaaattattacatgtcatcgtccatgtggcatgccatgtaggcaagaccacggtcaaacgcggctttggtactggatgatacaataaaccaagtttagagacttcgatgtgcgctttgcaagttcgtagacctaagtgaaacctcctggaaagtttaaagaccgttggtgcattttacttataaataaattacaataaaaacataacaatcaagtttaaaattagataaattttagctgcggctgacaacacgatgaccaaacaaaagagctggtgaggaagtttgaggaatcctgctatctagattttataaagaaggccaaaagaggcacattagtgcttttgtcagtacatcacatgaactcactgagtcactgggtggtttgttgcattgatcatctttataacttgataaagcaataagttaagcaagcattgttcatctttacaacatcaccctttttggatcaccacattccagctctcctgcttttgttatttacactaaagcaaaggatgatcaaagaagcaaacaattcagttttttttttttggaaaagcaagaaacttccttacttgtaagcattgcaatgccactgaaaagtaccagcagtttatggatgctaatgccatcactaatcatccaccagaagcaaatgcaatctactcctactcccccagaaaacaaacaacagagagccaggacagaaaggggcagctcctatctggccagcttttatttagctgttcttcttttggatttactatctttttattttctccagatgaaagcctgaaaacagtagtgagccctctctgtcctctactcaatcctcatcaacagctgccacccatgatttcattatctttttactttccccacattttatatagccactctcctccttaactcccctcctactctcctccattccttcactgccttcacttccctgctcagctcagcagctcaggtcagtctcctcagcattgtttcagctgcaatgccatgctcagaatctcttctcttaattttttggtttccatgagttccagtatgatgtttcatgggttggtcgtcttggaggcagccatttgtttagggcgcatttggatctgttcctcgcagttcttggcccgaggaaagaacagatctttgcgcctctcttgagcttggcgtctcttcttggtgctctgcgtttatgttccttcaggttgaagggaaatgctaatgcaaagcttagcacttaactgttcttggctcccaaattccagagatttggatgcttccagtggtgctgagatctgcaggatgtagtagtaggagtactgtttttgttcttgtgttagattatgtggtctcctgatttggttggtggcacctaacagttgaagtagtagtataatgcagttgtcaattcggactagatcgagtcttgaaagtgccccatcttgtgcatttgtctctcttggtgacagggaaagggccattaatttgtgctaaatttcagtaatctgaaaactctgctctaggagctagaaagatctgaacaataatgagcctggttaaaattctcaatgttcagaattaccacgaactgtagtaatctgaagcacaagaagttggttttctggcatttcagaatacagaacaacattacagatctcttgtatgttgatttgaacttaagtactctactaaatgtgttcagtaaacactgtagaattcacaagattaagagtaattctattcagcagttacagacttgtgctccagaaacgcatgacaaaaaaaattcagtgctgaatgcttcacttcactgttcttgcgtgacatcagggacttcgaggatgatggaatccaaagcagccatgatggtgaccatcctgctctgctgctcctccatctcaccggcgttcgcgcagaagcacaagggtccgcccgccgcggcggccgtgagcctcccgccgtcgccggcgccgtccccggcggcgccgcgccacgtggacctcgccgacctcctgagcgtggcgggtccgttccacacgttcctcgacctcctggagaagacggacgtgctcaggacgttccagagccaggcgaacggcagcaaggacgggatcacggtgttcgtccccaaggacgcggcgttcgcgtcgctggcgaggtcggcgacggcgaacctcacctccgaccagctcaagtcgctggcgctgtaccacgcgctgccgaggtactactccctcgccgagttcaacaggctgggcggcgcggccagcccggtgcccacgctcgccggcggcgagtacacggtcaacgtcaccgacgacatgggcaccgtccatgtcgggtcgatgtggtccaaccccaagatcagcagcagcgtctactccacccgccccgtcgccgtctacgaggtggacagggtgctcctcccgatgcagatcttcaggaccgacccgcccatggcgccgtcgccggcgccggcgccggacgccaagccggcctccgacgccgccagcccgctccccgggaagtcgtcaagcgccaaggcgaaggcggacgagaagaagagctcgtcgtcgccgccgtcgtcgcgccgcggcgccggcattgccggctacttcttggctcttgctgcatctgcctcagctggattgctgctcctgtgttgatgctaagaaacttttctaattcttttttttttttgcatggattgttggttgctggataattttattctttggacatagtaggggcattgtgttaggattaagttttatgggagtatttccgtcatatgcttgtatgattagtcgatgattacttgtttatccgatgcatgttgcgaattgcacaaggtattttatagggttaatttgatccatgccactctaaatatggcaaataaaaaaataccactactattcgcgttattggctaagtgccactgaaaatttttaaaattggatccatgccactcccgccacttttaccatcctccttcctcacgtcagcatcctcaccgtcaccagcagcagcagtggaagtagcagcgggagcgggagtagcggtggcggtggcatggtgcacgcgaggcgcgggaggagaagtagcggcggccctcgccgaccggagctggaggaggagacagggatcgggaggagcggcggcggcgcttgagctaaaggaggagatggggatcgaggggagcagtagcggcgacagccctcgtcggtggggttggcggcgacggagctggaggaggagacggggattgggaggagcagcggcggaagcccatcatccgcggtgccgtcggtgtggaacctagtgctcgccggaagcccatcctcctcgctgcggttgtggggtgtggaaggtggtgcaaagggctgcgaggtcggggcaacgtcctacacggagccccctcgtcccatgggcgttcggcgcgcgacctcgtcggcggcaaccacggtgaggttggcggcgtgagagaggaggacggaaataatgacgggagtggcatgattttaattttaaaaattttcagtggcacccagtcgataacacgaatagtagtggcatttttttatttaccacatttgtagtggcatggattaaattaaccctattttatactgcatcggcagtgatatgcatgctcatgatctgtagaaacaaaccggcggctaaaaacgaaaactgttttgttttaagataatatatatgattttctattaaagttggttaattatatatcgagatgatataactacggtgcacactcgcggtcccttagtaaaaacaaaaacaaaaactaatggtcgggtggccgacggctagggctagtcttcctgcgcatcttcgtaaggtttcgactctctaatcctcatggtttactgtagctttggaaagagcggaacgttagggttttcgattctttcgtttcaccagggtttttgattcttccgtttcatcggtctcgatagttctggggtccatccgcttcattggggacctatttggagattaggaagctcctcctcctccgccaccccctcccgctagatagaagcaacagcttttagtttttactcttttttgggttcgaaatcctttccttgtaactggcaacgaccagtctggtcggctgcattgtgtaacaacaactctattttcttctaatatactgatgtgtaatatctattttgcgcgtttgcgaaaaaaaaactattggtgtgtggttaaacgtaggccccttgaaacgttttgacagtgcgaatgctaattaatattaatgaaaattgtttggcgattcaagaatattctcagggggggtaaaaacgctacagacaaggaacacattttcatctttgagccaaaacctggctacttatcagttcaccgccggagcatggctgatatcttcggtggccgccggcggcggcgaggctgaggccggcgcagtgtgattagtgggccaacgttggatcagccaatggcccggcccagataccacaagattagccatcaattagcaaaccgttggttgtttggcagataaagtttattttagatccctcagctaagcatcgagtttaaattgtgttcgttaatcataaaaccggatataaaacatcccttatcttttaaaactaattattagaagagagacctaaagtgaacatttttcttgttcagcggcctatttgtctaaccataattttccaagctgggcctttgctcgaaaggccgaaacagtgatgaatggagtggtaagagaagtactagcggtagaggccaaagcggttggtcggatgacacgtcacctctcgtgctaagttggttaactttggttattactcgcaccgattaggcgaagagtgcattgcaaatttaaaatgcttatgtaagtactccctctgtccacaactacaggggataaatgaccctttggtttgtccaatattataagg

SEQ ID NO: 53627 - DNA, 1304 bp, Oryza sativa
ttgaaggcacggtgtcatcatcattaccttgggatgatcgattaaggatagcttttgaagttgttagagctctttcatatctacattcagctgcatcaatgccaatatttcacagagatattaaatattcgaatatacttcttgatgacagcctaacagcaaaggtatctgactttgtagcttcaaggtatatctcgataaatgaaatgggaataactactgccgttcaaggaacaattagctacttggatctcatgtactattatactggatgacttacgagtaagagtgatgtttttagctttggtgttcttcttatggagttacttactcggaagaaaccaattggtggtacatttgataatggcgatggtcttgtttcacatttcgtctcacttgtctcaaaaggtaacctttatgacataatagattctcaagttagggaagaggaagatggagaagtccaggaagtagcaacactagccgcaacatgtactaaatttaaaggagaagagcggcctacgatgagggaagtagagatggtactcgaaaacatagtttcaaagaaaggcccctccaataaagagaatattcgatcaagtagcagatgcgatgaaaatcaaatttcagctctttacatgtcaattgaaggagttaccaatgatatacaaaacaattacagaaagtagcacggaagaggaaatactattgtcgtcaaggttttctagataatcattctatgttctgaaggagaacgacttgcaagaaaaccggtaacttagctaataaatcgatcatgtctgttctaaatgatgctaaagttcttttgctataataaaacaataattacacaaaataaaaaaatcgtcgtgtcagaactctttacttgtgatttagttcatgttgattaagcatgtgattcgatcagtttgctctaatggactgaaattgcaaatgtcgtttgtgttttcatattctttggtttattcggctagctgctgcagagcccatcggctttgtaggcgttcattgtacagatcttcaatcacacccgcaaaggacaataatttcgttcttgttctttcttggaataaaagggaaaaaacgtgcttctacttcgatggatgaaatgaatactctgtcctgtcaccctgctgtcgaaacgccgaaaccggtacaaacttccatcgatccgtcgccaagtatttcattgccgtttggtagttttgccatggcccattggctcctagagactggaggttctcctgtgcagatagacgaagttactcttttttttcgctagg

SEQ ID NO: 53628 - DNA, 3847 bp, Oryza sativa
catataacgtaaaagttgcagttttgtgataatttttcacgataatgttgcagcaaattgatagttttgtcactaaagttgcagtctgaaatttactctttaaaatctatacctgcaaaattatttttcgatcgctaataaatattatggcttatagcctaactactttttttttcttttgttgctggttaggcgtctccaaggggtgttcatcacaggccaccagacgtaccgaactcacctgtctgtagttaataagacgacgaacttgccggccagtcgtcaccaccgccaagatcgctggcttgctgaattttagctgatggcgacaagaattaactcaaccactccccattcacatcgagcagagccttgagcagcaaaccagatttaatttgctttactgatcagatgtgtttgtatatgttcaggttcagagacgtttacagctcaatcatggagtgtttggccgtttattatacggctctgaattttcactgtctcaaccacaagcttcaaactgtttcaaagaataacatgtcgaaataaaggatactgatctctctggtcacaaaaaaattgtgcccttttaatgttgcgaagatgttttcgtcactgatccatatcacaccgcattactattaagtttcaaccaaaatacaaattatcgagtagattgctaaaacggattatttgctccatgttttgggaaaaaataaaaaaaaagtcttctgttatattatttagaccacttgtatttaaattaattattgtttatttaccaaaatatttaatttatctccataactaaataaataatctttagtaatagtcagctcaatatttgttttgaattgagcttggtttggagtcaaatcaatatgtatgacctttgtgcatcaaatgtaaatattttaaaaaataatactcgaagtttttttaaaacgttttttttgggaggcaacgatcccattcattctccatgattgcaaccaactacaaaccagtcatgcacgctagcccattcagcccactacatatttgcatagccatttggctgaactccctacttctcaaggcatagctacttccgcattagctcggcttctcaatcctatatgtgtaccgatgtttgcactttgcagctcaatcttggagtgttcggttgtttatacagttttaaatttcaatgtttagatatcagccaaataacaacttgtggaaataaagtgaaactctctctggttataaaaaggcccaatcaatttaatttagacgttggtatggtatttaaaacatattttttcccactattttgtgtcagtattagcaagctttagtaaaatcataacattagtgtaaaagtaggtttcgtatcaaatcaatatcaatatgtgactttcgtatctactaaccattgggcattagcccattcaggcattcagctcagtacatatataatgctttcttgcatatttgactatctaaatcatgtgaatcctggtctaatggtggctaattttatagtggaattttagtaaagaaccaccttgcgataatgtttgcttttacctttttatccaacccaatcgatgcccaatatgcatttgcaccatttgctatccaccaccattctcttgctagtctcctaaaggcctatgccaatgtcaagcaccatgctaaaaaaggtgtctccaactgacttggcaactgtgtggcattgatcatgccttgagagctggacaagcaacaaaagaagcgagataaatgagtgaatagggaaacacatgtggtcattaataggatagaaaggcaagtatgtaaaaccactctccaacaatgaagaattgggtcagggcaaggtcaatagaagagtcagggccataactagaaatcagaggcccccggtgcgaatatacatattgggtcctaaaatttgaaagccatggtggccgatggcgggtagtcataatcatgcacggtgcacactgtcatggctggcggcatatagtcgtaggcacatagaagtcagaaacaaaaaggggcaattgcaaatttaccactgttttgaatcgttattgcaaaactgtcactagataattgaaaaaatgccactggaactgccattcgagtggcatccttgcaaaattgaaaaaaccagtggcaaatttgcaaatgccccaaacaaaaaccagcaagtgtggcggcggttgggagcatgttcatttgtgacgtctgttcgtgcccattgcctagccttatgtagcgttaattgtttgaaaaaaggggtaaatttgtagtggtgatgggaatcagaggagccaagaaggcgagtaagtgcagtgtgcggtgcatgttggtttgatcaaacgaggtaatgagagaatttagcttgttgtttggactttatcatggatgctagaatagcttgttgggctttttcatacttgcaatagtgtttattagattggataactaattagtactagtacttatagatttgggagccctaaattttgaagaccttgaacagatttacgctttacacgaaaaacgtccagggtcttccggctagctccacaaggtgatgaactagacaacctaggttcgaagcctcaccccttctaattatttgatattaggtccttctctaatattcacgtcttttagatttacgctttatacatatggatgtacggccttgagaagagtaagcaactatctttaaagcatacctgttagctgcattgttaccttgcattcttttttctattgagcacgtgtataactagtgactaatcatttctacttattttcttaatctccgttctctaacttatcactaaaggagaggtgattgtactactgtcggttaatgtacatgctcttatttgaattactagtgcatatatctttccatgtttagtttttcatcgagaaataacaatcagttctaagatttgctcttgaaataacttctatttgctataaaattgtctccacttctttcttaaataactttgatttgctacgaagttatcttggattgcttcaattagctcttagagtaaattgattttgctctccaagatccaatatattacatgttactgaacaaaggttacccttgatgtagaaaaacaatcgaaaacacatgggatcacgtggaatggccaagagaaacaaagatatgcatttcttacaaaaatgagtttcacgccacagctgcacatggtaaaaccgaattttacatgcaaagtttgtaatcatgtgctaactatattggtaccactagttcaaactctcaaaatttaaagttcgaccgatttgtttctttatggtggaacccatctatctgagccaaagtcctagatttaatataggccatcgtatttttcaaaacgaatattatgaggtaaaaaaaaagaactatcattgaccgggccagggctcacaatatcaattgtttttttgcgaaaaccgctcgtttttttatgaaatcgccggcgaacggtttgtgaaaacagatcaattattttagcttggcgttgaccgaaagtcattggtttaatcaatttttggacagttttttgggtaaactgggtaagaacccttttttcctaaaaacttaaataaatctaccataaacatgcaatggtgaaactggctagtgccactagtttgtgaaaaaatggtttagatccaatagcaaaatatctcagcacaaatcttagcacgggatccacgggccaaaaagaaatttaacagtcctgagaactgcccacaactagctagaaaaaaaaaagcggccgtaaccttgacttgtgagagcagggctgcaggaatt

SEQ ID NO: 53629 - DNA, 1321 bp, Oryza sativa
agacaatgctgccctcccagttataagttgtaacatactagtgcttaccaacaaccagtatatctctgtgctgctaaatggaaattgagatgacacccaatgttttaaacaaataaaggccagtatagcattctatttccaggaattatttaggcttggctctgcaatgtatttccttccagcctacttggtgcatgaggtcatgaaatatggtcttcaaattgaattatagatgaattgtgatgctgatattccttgtttttcttttcctttttcttcacagggatcttccgtcggatagtatggtattgtgctggacacactgttgactttcgtctctatgattatctctgataccgatcggagcattgcacctcttccttcgatcaatgggcattgtgaaggtagcaagttgtgcgcctacagaagagcgggcttacagctgtggagacgaggacattacacaagaggagaaaatgctgcttcagagatttcctattcatgaatccgatgactatgaacatgaagaggtcaattgtgagcttgcaaagtctggagatcagatctgtagtgtcccttatgggctttatgatttgcctgaattgaatgatattctttctttggagacatggaacttatgtctaacagaagatgatagattccgtctagcagcctatctcccagacatggaccaacatgatttctttgtaacaatgaaggagctgtttagtggcagtgacctgttctttgggagtccagtgaagagcttcttccacagattgaatggtgggttttattctccagaagtttcccaggctagagaattactgatgatctttgaaagacgaagatattatcattttctgaagtcccatcatgatggcatgattttcaagtttgcatccatggacaaggtaggaggacgatgtggggcgagtactggtcttcagggtaaggttaacagttggaatgacagaagacatgaagatcccctcacaggtgttgacataagcggttctcctttcaatagaagtctatcaattgccaatgaggttaaagatgcaacccttccacctttgaagcgaaccaaacgtatggatgggacagtaaccactcattgttcagccaagcgcaagggaatagtctacagagacaaatcaatggaaatgagctcattgaagagtcctgtctttcatgttcctggtgagcttactacatgtattagattgcccaaaggtgtgctgaaaataaagaccgattgtgcttccctcattgatcacaatgaaggaattcatcgtacaccagaaccgatgctagcaga

SEQ ID NO: 53630 - DNA, 1348 bp, Oryza sativa
agaaggattgaagctgaagactcctgccagccagtcagttacagaagttgaagaaggtcataggtaccctttcacatacaaaaggaggaagctgcagaagaggcttgaccttgttgatcctgtcaagaaatcaactatggtggattcagagcctctgagcgcactggctagcgtggcaaatgtaaaaatcaaaggcaatcaagctttgaagattggcagctgagaacaaggatagctgaacatagaaattggagcatggcttatgaacatctagctaacatagtaaataaaatgttctcttttgttttgggttctggttcgaagtcaggtggagtgcattcattgttaaatttgatagtagacaaaatgacatgaatctctagtgcaaagcattcagattctctgctttctatcatgcacatccctccctgaatacctcgtcttccagatgagccgcagtttacttagatatatacattgtgttaatgtttttcttttaaaatagtgctgttgacttgcaatgtacttcctccgtttcatcatactaaaaagccattttagctttgtaccaagtcaaatattttcaagattgatcatgtttatagaaaaatatagcatcatttaaaaaaaccctatatatatacccatttgaattaggtatatactcaatttcaacaatggtgcccgggcaccatggagcaccaaacaaatttactatatatatatatatataatgatgatttaatgaaactaatttgatattgtagatgttaccatattttcatataaacatgatcaaatttatatatatatatatatatatatatatatatatatatatatatatatatatatatatatatatatattgatgatttaatgaaactaatttgatattgtagatgttaccatattttcatataaacatgatcaaatttaaataggtttgacttaggataagcctaactctgtactaatgaaagttctgcacataaaatgtgtacaattttccactcatacagtagtatagaaaaaccagtagctagtgataaatgtttctttttctccagctttatctgatctcagccatccgatgcgcatccaacggctcacgttaatcacaagctttcaaatattcaaataaagccttctcccctccacgcggcgagaaaaaaaaaaagaagataaaaatggcgccgccgcctcacctcctcccgctcctcctcggccgcctcgtcgtctccggcgacctccgccggagccccgcccacctccgccgcatcgtcccgctcctcccttcccacccccacctcgccgccgccctgtgcgccgtccatttcccgctctt

SEQ ID NO: 53631 - DNA, 6942 bp, Oryza sativa
atggggcgagggagttgttcgatgtcatgccagagaaggatgtggtttcctggacatgcatgatttcagggtatgctcaggctggacgctatcaggatacccttgagctgtttcgcgcaatgcagactgagagcaatgtacagccgaatgaggtgaccatggtgagtgtgctttcagcatgcgcaaatttaacagcactggaagaaggaagatgggtccatgccttcatcgacaagcacaaaatggtgctcaacaacgagtacaatcttggtgctgctcttattgacatgtatgccaagtgcgggagaactgacattgctgtcaaaattttcaactccctggaccgaaagaacgtctcggcctggaacgcgctcatcaccaggttggcaatgaacggcaatgctcgggattccgtagacgcattcgaacagatgaagagaacgggtgaaaagccgaacgacataacgtttgtcggtgtgctcacagcttgttcccacggtgggctggtggatgaaggtcgacggtgcttccagagcatggcgtctacctgcggagtgcagccggaggtgaagcactatggttgcatggttgacatgttaggccgagcagggcttcttgaagaggcagaggagttgatccggagcatgccgatggcacccgatgtcatggttttcggcgctctactgggtgcctgtcgaatgcacaagagatttgatgtggctgaaagagttcagagtgagatccatagcctcaatctcaacgcccagcagtctggctgccatgttttgatttctgacatttatgctgctgctggtaaatggttcgatgttctggaggcgaggcaagttgtgcagaggtctggcatcaggaaatggacacgataggtttaagattcttgcagaagcctgatattgactttacgcttttgagcaatggaagtggtggcactggtgggtatattgcttaatgcttacaagttatcggaaatgtggttagaacatcacaactcataagccccagatagcaaaatactatgctcgttatgcttcagagctgattgaaattgccataacgccaaagatggattatgtcacagcatctgtctttacaggccaaaacttaaaattcatcagaatttattcagttggtcttgtttccttgaccatcaatttccttgagcatcaaaacataggcaaaacttatttaaatcatcagaattttttcagcggtcgtgtttccttgacccttatagaagatccaatgacaatatgctatacgtgcataagcgtagacataatcccacttcatggtcttcgagactcgtctgttagcagtgtttgttactctctgtttcatattgtaatttgttttgattttttttctagtcaagctttttaaatttaaccaattttatggaaaaatagtttcattaaatctaacattgaataattgtaatgatatgtttattttgtgttatagatgctactatgttttttctactatgtgatttataatatgatgaagaggaagtataaaatttagctgatgtgaatatgaacgaggaccgagtgttatgttgttttttggtttttgtcaggtacctactagtcctaattgtgtttttgtcaggtaatccggagtgagctgctctgaagaaacagtcgattgtttgctctgaagaaaaagttgattgttattgctaacagaaaacagatatatttaattgttatcgtgagctgaagaaattttcatcaggtgctccaaggataccaaagaaatcagctgcaaggattggacgccaacgggcaatcgccaacaaacaccagagcgagcaaaccaccaacaaagcacagtataaattgccaagggcattcgctgcaaggaactcctcccgttgctgttgatcaatttgatcagcgtgacaagatctcccattcacactacgcaatcatatgttctgtaactgtaaattgcaaagctggtgctcgaaggtggaattgaggcagaagaatattcgcaaaattaattgatacatctaacttgcagaggaaaaaatagacaactcatgaggacactaatataatactcatatttagcaatataattaacgtacgcagttcgagaacccatagcacaatctagccccatgcattgcaggctaggtaaaggtaaagcaaatcgcacaaaataaaccgaaccgacccaacaacgcgatgttcaaaaggtaaaacagataagctagctccaatgctccatggtgtactttcgctgcgaaggatttgacgaggggaaaaaaaaggaaacccgcttagtcgacctcctccatcttgctctcgccggcgtcgtcctcgagcggcggcatgtcggtgtcggcctccgccgtctcgtcctcgtcgatgctcaggccgagcttgagcatgcggtggatcctgctgccgaaggtgttggggtcgtcgaggctgaagccggaggtgaggagggccgtctcgaagaggagcaagacgaggtccttgacggacttgtcgttcttgtcggcgtcggcgcgcttgcggagctcctccatgatggcgttctccgggttgatctccatcgtcttcttgctcgacatgtacccggccatgctcgagtccctcagcgcctgggccttcatgatcctctccatgttggccgtccagccatactcgccggtgacgaggcagcacggggagtccaccacacggtccgagaccaccaccttctcgaccttgtctccgagcacctccttgatgaccttgcagagaccctcgaatttctccttgagctcctccttccgcttcttctcgtcctcgctctcatcaagcttgagtccctccttggtggcagagacgagcttcttgccctcaaactccttgagctggccaacagcatactcgtcgatggcatcaaccatgtagaggacctcgtaacccttcttcttcagcttctccaagaagggggagttctccacggccttcttgctctcgccggtgatgtagtatatgtcgttctggccttccttcatcctcgtcacgtaatccttgaggctggtcagctcatcgccgctcttggtggagtggtacctcaggagctcggcaatcttgtttctgttggtggagtcctcgtggataccgagcttgaggttcttggagaaggcttcatagaacttgttgtagtcttccttgttctcagcaatctcgaagaagagctcaacgcacttcttgacaaggttcttcctgatgaccttgagaatcttgttctgctgcagcatctcacgggagatgttgaggggaagatcctcggagtcaacaatgcccttgacaaagctcagccactcagggatcagctcctcacagttgtccatgatgaagactcggcggacgtagagcttgatgttgttgagcttcttcctcgtatcaaagaggtcgaatggtgccctcttgggaacaaagagaacagctttgaattccagctgaccctccacagagaagtgcttgacagcaagatgctcctcccagtcgtttgtcagggacttgtagaaagcagcatactcctccttagtgatctcctcaggcttcctcatccagataggcttctgtttgttgaccagggaccactcatgagaaacctccttgatcttcttctttttcttctccttttcttccttctcttcatcaacatcctcaaccttgccctcctcagcatccttcttctcttcctcatcttcatcatcagaaatttccttctcagtggtcttctcagtccatagagagatagggtagctgataaactcagagtgcttcttgatcaggtccttgaggcggcgctcttcaaggtattccaactgcaggaagcatgagcaagttgtcaataacaaatgaacacattagagccaggacaccttatagcacatttcacagttcaacttaggagttcaggtgattctaaaaattcacaacagtagaacagtaatacttgttactaattaattcatagtactccctccgtttcacaatgtaagtcattttaacatttcctatattcatattaatgttaatgaatctagatagagagatatgtctaaactcattaatatcactatgaatatgggaaatgctagaatgacttacattgtgaaacggaggaagtattagacaaccacacgcaatcaaactgacacaaaaccagacccaaagaaaaaaaatgcatacacaatcagtttatgagctcaacaataagcttatagatcctaagtacatgtgtaacatgattactcataacatccaaggcagaaacatactaacataattttcacagcaggagttcgaaatgttaaggcatctatctagattatcacaatgtcaacagtgtgtgaaatatgttcattctgttcaatcaattcaccaaatgcccctacatagagacattttttatgtcttaaacagaccgattaagcacctggctcaagcatgcctatggtgaaaacttgaggcacatcaacatgttctttctaaaagtggctataaaatcaagtaccaacaatattcgtaataatcctacgaggacagaattactagttgatgcatttatcaatagcaagccacattcatgaactataagggcattcagcaatacaagcagcacaaattgaacaagaattcaatgaaattctgttagtacctgatcatccttgaggtagagggtgatcttagtacccctcccaagctgctccccagatgtgtcacgtgtgacagtgaaggacccaccagcctgagactcccacacatactgctcgtcatcgttgtgcttggtggtcacaactactctctcggcaacaaggtaggcagagtagaatccaacaccgaactgaccaatcatggacacatcagcaccagcagccagtgcctccataaactccttagtccctgacctggcaatggtacccaggttgttcacaagatctgacttggtcataccaataccactgtcaatgatcgacagtgtgttggaggccttgtcaggaacaatatggatgaacagctctggctgagcatccagcttgctcttgtccgtcaagctctcgaacctgatcttgtccaacgcctgcagaacacaaaagcataagataagtggccggttttgtatgaaagcagctagcaattccaattcactatccgacaataatttaataatgtttccacaccaaaagttcagctatccccatctattctcacagctcaatcttgacaccaaatgggacatctctaccctgcccaaatttagcaactccaaagatttcaggatttaccacatttttggcaggatagagaaccagaccaatcctcagttcatagggccaattttaacaatgaatcagcagagtaaagcactggttgggtgtttttgttccatagggtcaattttaacaatgaatcagcaaagtaaagcactggttgggtgtttttgtttcatagaggcaattttaacaatgaatcagcaaaataaagcactagtcgggtgtttttgtcttatatatggtcaaaccctcctatcaatttagaatgtgacataactagcaaaataaatgacaaataaatgataactagcaaaataacaaccctctatgtttataggggatatgttttacaacatttaaacatcaacactcaaagcatgtgagacttttcagatgcgactttatcagagcaatcgtaaataatgctacgagattaattagcagaacaacgacagataatgctgcctatgcctgcagttatgtttataacattctaatcagcagcaaaattcaggactcttaacaaaattaaggaccgcatgatccacagattattacactaacaaaattaagtactgcgagcatgatccacagattgatacactgagaaacgtaattaacgtcggaatcgaaacataatcttaaaaaatggggagtgaaacaccacatcgcagatttatgttgggatgatgtctcagtaaccagtaaccagtgctgcagtgcaaactccctcacacacccacacacataacaacacacacgagtcagctcgaaccagattgggtgaacaaaccgatctaccaatcggaccaaaaaaaagcccttctaacgcgcgcgcgtgcagatctgaaccagtaaaccgagggcacttacatcggaggagttggagatgagctcgcggaggaagatctccttgttggagtagaacgtgttgatgatgagcgacagcagctggttgatctccgcctggaaggcgaacgtctccgtctccgaggccatggcgctgcggcggcggcggaggccggaagcttccggaggacgacgacttggaggctagggttagggctttaggagagggagctcgcgtggcgtgtgcgattcgattggagaaagatggggaagaagggggcgatatataagggggagatgggggttctcgaacgttctaccaggggctcgaaccagcgggggagttgggagatggacgacttgacgagtcgtcgggcccacatgtcagtcggttggttatggtttttatattttggaaggttctggaggagtggagaggcttggagtcggtttaaattaagaaaaccatcatctctatggtctagtactgtatgggaatagtgaatactataattcttgtaaggggcaattataaatttaccactgctttaaatcgttattgtaaaactgccactgaaaaattacaaaaatatcactaaaactgtcattcgaatagcatctttgcaaaatagaaaaaatcgcaaattagatgcaagaaggttcaacttaattacaggatgaattttggaaggttcaactgcacatcgcagattagatgcaagaaggttctggaagcgaatgaagacttgtggtctttatctttagggttatgttatttggtt

SEQ ID NO: 53632 - DNA, 14522 bp, Oryza sativa
  unsure (1)..(14522): unsure at all n locations
gtgcactattcaactactaaaagtattttggtaggacatgttttggcatatcaacaaaataatttagccaattgcaacacacggggacacagacaaccaaacgagatcagaatgcagacgtggtaatatatcaattcaaattcatgaacaaaaacttatatttcaatgtatggacttgcagaattgcacaaacgcaaaaggaaacaaaaaaaggggcaaggaattgtgctttgcttcactgcttggcaattggcaaggcgacggaatcaatcccggggaccataggctgaagggccagaaaagagggcacaagatgtcaagcttgttccgacttccgagaggaacttcgtacaacaaaatggaagtatatacgcctatcatgtacacatggatctatgaggtatatacagcacatactctgcctgttctaaaataagctaatttttatacataaaattaaacatagcatgtgtagattcgtgtgaaaaggttaatttatgagggtgtttagatccagaggtgtaaaactttagcgtgtcatatcggatgttatatagggtgtcgcatgtggtatttggacactaataaaaaactaattacagaatccgttagcaaaccacgagatgaatttattaagcataattaatatgtcattaacaaatgtttactgtagcaccacattatcaaataatggagcaattaggcttaaaagattcgtctcgtaaattagttacaatctatgcaattagttatttttctaagactatgtttaatactttatgtaggtgttcaaatgtttgatgtgatatggtgtaaaatttttgtgtaggatttaaacagggccttattctaaaatggagggagtaaaatggtgaaattttctgttgtactttgttagtgtcatcggtcagctcgggcgttgacctagtaatatgggaactgtggtgtgtaattccttcgaaatgaagctggtcacttcatctctccagtccatggctctgcaagtctcgcaagtcgttagatttgtttggtccttcatctgctttgcattcagattcagtcagcccaaacttactagaatcctgatgatcatcagtgtcaccactttgggatgtgaaaaatggtagtttctgtccaatgtgtggtgaaggagggagtgctgcaagattaatcaagaaaacaagggattacaaagcatggaattaagtatggtttaatgatgtggataggaccgtttggtgtccaaaattttgagggtatcaactaaacatatccagaacaaagatgatacttggggtacaaattaaagtcctcggtaataatatatcttctctggatgtctcccagtttcaacttgaatctgtttgcagtagaagtgccttcctcgctatgctgttctatactactccctccgtcccataatataagattttgagtttttacttgcactgtttgaccactcgtcttatttaaaaaaatttggaattattatttattttttttgacttactttattatccaaagtactttaagcgcaacttttcattttttatatttgcacaaattttttgaataagacgagtggtcaaacagtgtaagcaaaaacttaaaatctcttatattataggacgaagggagtatatgttacccatattactccatcaaaattcacctggtattgcaagttaataatcacagcagtcacaacctacaattgtggaaatcgttatttggtgagcatatgtgacattttgctacaaaggtaatttttcatgcgataaatttaacactgaacatcaaatcatatatttatattcgtaggccacaactaggctgcattatccaataaaagaaacaataacactctcaaccatcaaatactagtatatgagcaaagatgctgtacacatatgaaacttttggaatactacacagaaaccaaatgtgcggcttcattttaagcttatatattttgagtttttacttacaatgcttgaccattcgtcttatttaaatttattttacaaatataaaaaacaaaaagttatgcttaaagtactgtagataataaagtaagtcacaaataaaataaataataattttaaatttttttaataaaacgagtggttaaacattgaaagcaaaaactcaaaatcccttatattatgagatggagggagtacttattagtcaaaatttaaattttcaattttaaatttgaaattgattttaaagtttttttttatcaaagtttatttttagcatttacttttaattcgttaaaaacacgcatataaaagttttattcacaaatgactttttctttgcagatatgccgatgggcacccttatcatcgactcatcgtagtattagaatttattagagaaaacaaattgcggtaaaagaagggtaagatggacggcgtcagctatatttcccaagtctaaaacgtccagccgtcagctattacgcaatcaccaggagacggacggcgtttataaaccttcctccgtgcatagaatcgtcgtcccttccctccgagtgccgtacggccgctgccgccttctggaacattcgcttgcctccgccaaaaaaaaaaaaaaaaaatccctcctcccctctcccctcgagtggggcgcagccgcctcgctcgtcttccttcctcctccaccgccgcgcgtgcgcgagtgcgcagccgccatcgccgtgcgcttctctgcctcccgatctgcggtgcgaccggtgtgatcgcggagcggcggccgacgagaaggatttttttgagggaggggggcgagtggtgcgacgccgctgacctccttcaattccacctgccccaatctcggttgggaatcgaatcgaaaggtattcccatcccctcctgcttggctgagccatacggggctctgattgattcatatttgactcatattaagcatccagttttattctggatttttttttggcgcgtggtgtagtactactggagtagcaacttgtgtcccaaaataaaattgagggtttagccgccccctgctcattagatgcagtggccttatactttcatattgatatagcaagatagggtagtaattttttttcttccctgtcttgttgataacttcttggtaggtgccactatgatcttctgttataacatcatcatactatgaaattagtttgatggcataacgtgtttttttttcttatcaggaataagatggaagagaagagaatagctcggatttcggtcacttggagaggcagacagctcgatgtcgatgcagacccgagctgtacggtgaaggaattcgggcaacttttgcaggatttgactagtgttaacccagagacattgaagcttattgttccgcagtctacaaacaaaggctccaagctgatcacaccgttttccgaccctcattcagttttgacattgaaagaagctgctattagtgatgtaagatgcacaagagttgtacttgctcagcaatatgttgctacgttatggatattataatggagaatggaataatttatattcaatcattgtttgctacaggggaagcctattagaatgatgggtgtttttaatgatgaaatcgaggaagtatcggacaatggcaaaagaacagatctacggataattggatttgaggaggaagaacaacggctgaggcaacgaacatcaggcaggccccaagttccactcaaacttccacagggccaatacatcttctgtgattttcggacacttcacttacctgggattgaggttagttagcctctactccctacgtgctttctgaaatctataagaaacagttcatgtaggcatgtcaatccgccccttccatactccacatatcatttgtctcctcacggattatcataaaccttagcgcgcacattttcctctgaagtctgaactcttgcaatttcctgcttgaattaggatgcaagcagcgcacgaagtgttccatttgaacagtatgcacactataaattgtggattaaatagtttgaaggaattggaccattgtgcagtttgcactggtttctgtccaaaactttgtgaaaagacaacgttaaacaatgtggtgtgctcattttatttatcatagttaacaccttctcatttcatgacatgacttcactataataattataatgaaatcagtatatgtatgaaatgaatgggttcactatgacaattgtaatgaaatcagtatatgattcctgtaacttgctatagattatatatagtacattagatttgaacactagacattattttcatatatacctcattctttcgtaaaaaaaatacatgcatgctagtagaaaaacagatatacctgatttgtatgataacaaataggccaatcacaacatcttgaactatcgagttttgcttacgtgccttttgtttgatgccagttgaatcccccaccttcagaagctctgaaaagaatgcacatgctagcatgtgacccaggcataattgcgatcatgaacaaggtagcaatattttcaagtggtgtttctgttttttatgtttgtgtacattcgttattttacagttatcctgttggccttttcagcatagatggcgagtgggaatcatgactgaaatggcaccagtagggtatgtaggcgtcagtccaaaatgcattctaggcttcaataaggttagtataactgtataagctttttactactgcacatatggatacttgtcacacaacaatttctgaggttatatcatcatgtcttcctcattgttaatacagaacatgggagaggaaatatcccttcgcctacgaactgatgacttgaaaggatttaggaaatatgaaagtatcaagagaactctactccatgaacttgtatgcctccttggttttctgctttcatgaaatggagatttcttatgcagatcttccgtttgtcctctgtaatcatgcctattgtatattaaacttgcacttggtgatttcaggcacacatggtgcactccgagcatgatgcaaatttttttgctcttaataagcaggtgattttttttcctagacaatcctttcatgattggctactgtctctttatgtttttgagttaatctgttctttaatacaatgtcaatttcagttgaatgatgaagcagcttccttggactggaccaagtcaagaggtcatgtgctgagtggtcgcaaaatcttcgattcctatgaagacgaatttgttctggagccagacagtgttgttgttggccacaaacttggaggaggatccagttcactggcaagtgctcgtgtgttgtctgggtctgctgcttataagcgttttttgaatgcatcagcggatttagagagttctaaagacagcgttactatacctggaaatgaaattcttgtgcctaacacaaaatttgagcctgatccagatgatgttggtcaagatttttctcaggacaacactaaggtggagccagacccagatgataatgatgacatgaacgtggatgtagggactggggcatcttggtcctcagtttctagatcatttacagaacaagataccatcagtcactcagagcctgaccctgatgatattcaccagcaaagcactgctggttgcctagaacctgaccctgatgattcctcaaatgttgatattcttagccaggagttgacgattgatgggaagcagaatggagaacctgatcctgacgataatggtactagcaaatttattcccgaacctgtaaacaagatggaagtagagactgaattgggaagtaacttcgcagttcagaattctgaacctgatcctgatgattcctcaaatgctattctgaataagaagctgggaactgacaggtctgatgaaactacatgcgaagctgttgtagaagaatgtgtaaacaagatggaagtggagactgaacagagcagaaactcgacaatgtcaaaatctgagcctgatcctgatgatcatgctgctaattcaaacatcagtgagctccagaggatcgaagaaccagtggcagccctctgtgcacgccttcagaaggccattgaaatgcttcgctcacaagcaacacctacagaggcaacttctgctcttcaaacactctttaagatcatcaagaatgtgatagagcacccacatgatatcaagtacaggagactgcgtaaggtatgcttggctgttcttatgctcttttattaggttcaattggtccactaaaaaaattcttacttactaatcctcatttttcaaatatgcagtccaatccacagttccaaaggagtgtggcgaactacaaaggtatctatttgctttatagactcccctctttttttttcttcaggtcttcaaaaatcaactgtaactaacttcctcatttttttcgcctccctgaaaacagctgcaatggaggtccttgaactgattggtttctgtgaggatgtcgtctcggatgagattggtcgtgcagagacttacttggtattgaaaaggaacgatcctggcttgctgtggcttgcaaaggcctctcttgaagtttccatggcctgaattgtttcaccaagcaatctcctattgcttctgtatacctgtaaatcattttcattactgttgtggggatgctcatatgctgctcttaggcaaatgatgtagtatggtcttcctacacgatgattgtttgtatatggaaacaccaaaatggtctatactgtctgtcaacacacttcatgatttctcatcaaatatacaaactatagataaattacctggcaaaatggacacatcttcccttttgtgtggactctgatagaaattgattccagatgctcacaaatgccagccaaccgtatccacgaataaagtctcgactagacggtgtattccattatcatcacaaagatgttaattttggaactgaagtatataaaaccaaatttaatcaccaaaggtctaatgtttgggaactgatttttttttaaaaaatcaaatcttaaatctttgccctttttgttctgtattgggcctttccaacctcgatcccaacaaattccgggctgtaaattcggtgggcttggtgtctaacaacagcagaaggcccacatgcgtcccatcgcaatatcccatcggccgctcgctttcgacgcgtagcggcagtaacacacactctctcccttccgatcgtcgccggcggccatcggcggcgctagggttcatcgggttacgcaggcaactgcgnnnnaaaaaacgggggggcccccgggaaaaaaggggcggggggccccccgggccccggggggggggngggaatctcgcgatggaggcggccgtcgcttccaccggctccggcctgcgctgctcgcccaatccgatgcctaagcagcagcacgagcggcgaagtgctcgggtgggcttcgtctcccagccgcgacctcgcgctgtccgctgcgagcggtcgccccatccggatgctcgagcctacgcggcggtggcggtgggggtggtggcgaaggggcgtgaggttgggggcgtcggggtggagagaaggaggctcgcggtgttcgtttccggtgggggatccaacttccgggcgatccacgacgccgctctgggtggggaggtgaatggtgatgtggttgcgttggttaccgataaaccaggtgacgatgacgacgatgctttgcttccttgagctctttgggtggcgatgtgggtggaattgttgggatttattggggatttttgatgtggcttgcaggctgtggaggagcggagcatgcgaggggtaatgggataccggtggttgtgttcccgaagtcgaagtctgctccagagggggtttctattgatgagttgttgaatgctctgaggttgggttggttgctttgatctcaccttcaggctttgacattcgatgttctagctttagtagttcatctgttaggttttagataagtggatttgtagaaaaaaatggtcgatatgagatttttcacacttgcctttagtcttgtttgcaaaatgcatacatgatacattgctgtgtgctgataaaagttttctaatccatttatctgtcttatgtgtgcgagtagcgtttaaatgattttaaacgaagatgaattggtaactatttaaatgattttagtgtttacttattgaatgtgtgccactaccttgttttgccagatgaactttgatatcagttttatgctctgggttgacgtttagtccggaacctgttggagtgtgttcttcatcagttgtacagtgtgcccacacagtcagtcagattagcttccattttgttattgcctagctgatatactgtaatgtaccactgttgattttttcacgaatagccactgcatgttttacggtgtttgtagttcccacttcacttatatcctcttctacaagactggcttgcctactgcggatatttgttttggtcacttgcaataggtctcaagattctcaatctatccttaatttcttatgtgaaacagggaactcagggtagacttcattctacttgctggttacctgaaacttatacctgttgagctagttcaggaatatccaaaatccattttgaatattcacccttcactactcccagcatttggaggcaaaggttattatggtttgaaggtgcataaagcagtcatctcatcaggggccaggtacttcacaatctctctatcacccatcacaagcaactgctgtgcagtttgcatatctactcaatgctatttccatggaaagcaatatcttggcaatcaatttgagctgatatctcacattgtagaacaaaactaaagctcaactatacataggtactcgggtccaactgtgcactttgtggatgagcactatggcacaggaagtactctagcccaaagggttgtgcctgtgctagccaatgatactccagagcaattggctgcaagagtccttcatgaggcaacatatcttatgctcggctaatatttctttgatggaaatggccatgacaattcacttagctgcaaatgcaattgatgatatacgttcttttgctcatttattaaccttatttttcaggaacatcaggtttatgttgaggcagttgctgccctatgtgatgaccgaattgtgtggagagaagatggtgttccacttattagaagtcatataaaccctgaggagtacacttaactcatagtactacctcaaggattgctgtgcagcatgcacgtaatgaggcttctagaatgcctgcattgttttttcccaaggcatgaaggtcactcgtactaattgagataaataacttgtctggtgctgttactgaaacaaaatatcttgtgccgttcaactcaccgcttgttgtgtgactttgctccaacaatgacatgcgcataggccgatacttagaaacctcagtgtttgctggtgtgacttgcggaagcatactggttgctgcatgcaccaagttttttttttttttgtgtgtgtgacagagcggggtggggggggggggagggggtccattgtaccctttagtcttggaattgttgtaatcggctgaagtcaagtcgatcaaagagggagtaaaaactggtcagatcacacaggttttcaatgtgtaatctgattaccatgcttcccatatgttccatccttgtttggtctgaaggtgttaatatttaacccaactgaagttttctttgagattttaaaagttctcttgcaaatttcagtatgcgagagggatagaagaaggggatggtgcaaatgacagccattcttagagaaccctctccgacagaaaggttcctgccaactcttcctccattttgtttttaggtactacatttttgtattgagtttgggttagatgattcttgaagcaattaaggttgtttcttgtgttgatctcccctctcaatttgctctatgttctgaggaagatgggcaggtggttaatataccgtcaagctgcgtttctttcatatatatgcagattgcggttgtggaaacctacatttttagagttcccgacttaagacgactatattttagagtcaccatgcgtgaatatacgcaaccatgaggtccatgactagagagaacaatgcagtttcattattgcagtagaacagcgacactgtgatgctcagctgcagttcctaatatccctcaacaccatgattgagtaaatcaatcacactcattagataatgaaacaggaagaagctaactagtcgcttatgtaaagcaaactcaatcaacccaaaccggattgcaagtacttgagttatgacttgcaattttattatgcattattgtctcaaagcaaaatatcttaggaattacttagcacagaacattagcaatatacgtccatacataaattattgggtccttggcaagcttgctagtgtcctagctaacgctagactgctagatcataattatcgaggaaacgatagcatttcctcttccatggattgactacttgcttctgtggcaactccttcaattgacatgtatagtgctgaaatttgatttttactgggtctacttgattccctatttcccttatggaaggggcccttttttgataatatgttttccagtgccatctctacttctctcattgaaggccgttctcctcctttcaatttagtacacagtgcagctacttcatggacttctccatcttcctcctccttgacttgaggatctattatgttaataaggtttccttctgagagcagcaaaataaaatgtgaaacaaggccatcaccatcgaacgtgtcaacaacaggtttctttcgagtaagcaactccacaagaagaactccaaaactaaaaactcgctcttgtcagttagtcgaccaatatagtagtacatgggatctaagtagccaattgttccttgaacagttgtagttatttcagatcgatctatcggggtgtactttgaagccccaaaatctgataccttcgctgttaaactatcatcaagaagtatattggaggacttaatatctctatgataaattggcattgaagaagctgagtgtagataggacaaagctctagcaacctcaagtgaaatccttaatcgatcatcccatgacagtgagattggaccatcgacatgaagatgatgataaagggccccatgtgaaatgaattcataaccaacaatggaacttctgtctcaaggcaacatcctaggagcttcaccacatttctatggttaatttgagaaagtattgcgacctcatttatgaattcacctatttctctttgaactataatctttgatttttttatggccacaacattcaggtctagaatccccttgaacacgactccatgccctccatctccgacttggcaagatctatcaaaattgtttgtggccttttggagctcctctaaggtaattatcattcgctcaccaaaatctgtgtttcttgatattaactgctgcagtagcaatccatgattttgcttaaagaacttttctttcagttttttctccctgcgttgcttgaccacacgtgctactaggggagtagcaagtaccagaataagaacaattgatccaccagaaactattagagctatgcttagccctgaaaaggaagatccatgaagaggcaaatctagtgaataaatttttgagatatgttggactaagaaagatctaagctataaattttggaatgattatcaaactaccatagactcgctatataaaccgagtttgtattatcatgcaaagataaggatacataaatttggtaagatatacttcatccgtctaaaaaaaaaaccgaatctaggactggatgtgacacattctagtacaatgaatttggataaatgtgtcacatccagtacattggtttcttatgggacggagggagtatgctctttagtgaattgtcacctgtcaaagaattcttggatgtgatgcatcccccctttttaaagggatccccatatccattttgacatcgacaatgaaatgacccatgcgtatttatgcagattccatagcatgaatgcgccggtctgcacactcatcaatgtctacataaacaatacaacttactgaaagtacacacctagaaaggagatctaaaacaatgttgagaaatcaagagatatattagctagttgtgcgtttctctggtagtgtggattatatataaaattttgaagctattaatttcagttttttagactattaataaattaaattgtttttgttcttgagtgcttaaaacaaatttatataacttttaactaaaaaatggtgcaaaagtatgtaatgtaaattgcttgtgcgaatatatgggggttaccaattattgtactcaattatgtatcaatctaaggaagtaacttgttttgttatacatatgtcgttatgttgaaacactcgtatttatctacataccttcgcatccgtttggttgagtagcgttgccctttaagccatctcggcaccgacagttatatcctccttgcgtgttagtgcaatcgccaaaacatggatatatatcgggagaatgacactcatcgatgtctagatatgcaaaattgtattggtcaggagagggaaaagtctgatcgttttagataatgaagaaggaaaagtctaggttggaaaattaattgtgattagaactaaagttatctttgcaaaacgaccacaaaaccatacttggaagaaaacatataaggaaatgcacaaatctacccttttcaaaaagggacaatatccacatatatggggccacttctagcatcatcggtcactattaggaatttcttttgtacgttggtaattataaatcttatagttcatttgtgtaagagtatatatgaaaaataaaatcatttgatggttgattgcacatgatttttaatatgattctttatataaacaatgatccatgtgaatgcaaagtttaaggacccgtgttcataacgtatacctttgcatccatcaatgatgtatggattgccttgataaccataagagtacttgcaccgatacccgttgtttgcccaagcatcagtgtcttggcaagagctatgggcactgcgacactcgggggcagatgaatttctaggacaataacttgtcgaattactgattacccattccagcaaggctgggagcgcttgcggatctctgtcggaatcaaaaataatgagatcgacattggaattaatgaaattggtatagttgaatccctggtccaccatgtagatatttaaaaagtttgcatcaccgtgaatctggatgagataggatgagtagcctaaaatgatgtttgtttgacaacaacaaatgcccgagcacgcacttatcccgaaaattgctgatgggatccttgggcagatgacactgcaggaggcgatcgggttgtcccctcccagcccccagacgtcgacctggctatcgtggcccatcaacactaggctactccccgactccgacaggaagaacggcccgccatctgggaggccaccgccccatgtcccgtttgcgcttccacggccatcgtactccagattgattcggccgctgttgatgcgcacggttccattggggatggagatgtcgagcacctgcaccgtgccatcaccgaggaacagcctgggcgggtggtatgagtggtcgcaggtgaggttgaagccgactgtgtggtagcagccgggctccaccccgaacgggtactcgatgctgatgttaccgcagctggtggtgcagctcttgattttcttcgcggttggcaccgcgggttcttccgccgcagccaccatcgcggccagcagctgcagaatcagcaactgaacatgcactctcctgctgcccactaccaccctgaccatctctgtatatactccctccattttaaaatggttgacaccgttgactttttagtacgcgtttgaccattcgtcttattcaaaaaatttaagtaattatttattcttttaatatcatttgattcattgttaaatatagtttcatgtacatatatagttttacgtatctcacaagttttttttaataagacgaacggttaaacatgtgttaaaaagtcaacggtgtcaaatattttgaaacggagggagtatgttttatcgcaacagattatgtatcgaacgttctatcaatgctgatcctgatatggatttgctggtttgtaattaatctctggtttgtaattaatctccggtgtaactaactatatatacagatgtactctagacgactgaagtagtccctatcgtgcggccgtgcctaactaacgaaattaactactagtatgtagtaagatgaatggattgtgtcgtcagtcaatgacaatcatatatacgttccattctacacggaggtctcagataatatatagtataatgatgatataaaggaaatataaatttgttaattatacttgggtgcgtatgcat

SEQ ID NO: 53633 - DNA, 1053 bp, Oryza sativa
caagggcaacaacatccttaaatataatgaacgggtgggttcgaaaggtagggtttttggatggccctaccactaggctggctgccttctttcggatgggaagcaggccgggcctgatgggcgagctgttggaaatttggtcataattcgacatattttaattcaaaataacaagataataaatatgatatttacaatgggatttgatccagtgatagtggtgaatgtaatcaacatgagcatgcttaatgtagaataagcatcaacaatcacataataacataatgttgacattgggatgaacattaacagtaaaacttctaattgaaatattgtaagaatgttataccccaagaattgtcctccgctggagtttgaggcagtattgcctccgttggtgttgacgggagcctccttctccttgtatccagtgttgccgttgtctccagtgttcgacatattggtgaaggtgaagtagatgttgacgaacagtgagtagtcgcgccttgcactccccaaaaacctgatcgcccgcccgtccgtgcaaacgtcgcagcagcgcgtggtttcggaggcctactctcccaaagcgtgtgcacacactcgtcgggatgggattaccgtagcagcaacagcgttggaaaatggatgaaagtgtgtctcactgttctcgcgggagatcaaatccattctcattttataagaggaatggaagatgaaaagtaagagtcatggaataggaagaggaatagagcaactaattgtcatcaactagccatgaatcatcctccactacacaaccatcaaccaataatcaattaggagtaattgatgtaagttaccaatggaataggaagaggaatagagcaactaattgtcatcaactagccatgaaccatcctccactacacaaccatcaaccaataatcaattaggagtaattgatgtaagttaccaatggaataggaagaggaatagagcaactaattatcatcaactagccatgaaccatcctccactacacaaccatcaaccatccatcaattaggacta

SEQ ID NO: 53634 - DNA, 3260 bp, Oryza sativa
caattccataactgatactaggcaaccgttagtattccctcgggttggagcttataagtcatactccaggcctttcatgagtatctagagatcatccaaatctcatagactgtgactagcagtcgaactcatataggtgtgttccttctaagatgttctgcaggtcaacatctctgcttaatgaaagccactcggaacacattgaggcataaagccatgctaccatacagaatagaagagaagtacatcatgaaaatgagcccatttaagggtctcttctctcggttacacaatagtttatttcgccatccaaattcacgggatctccgatcacaatggacaggtttccactattgtgcaactctaagtgggtctcaagcccatttccctcgatgcactgtctatcacattacgtggtagccccttggtaaactgatctgccagatttttagctgtctggacatagtccagtgctatcactccggagtttttctgctttctgacagatttcagtcttctctttacatgcctagatgacttcatgttgtccttcgaactgttcaccttaataatcactgtttgattatcacagttcattagtatagctggcactggtttttcaaccaccggcaaatccattaggagttcacgaagccactcggcctttactgtggcagtatctagtgctgtcagttctgcttccattgttgacctcgttaagatggtctgcttgcaagacttccaggaaacagcgccacctccaagtgtgaacacatatccacttgtggcctttatctcatcagcatcagatatccagtttgagtcactatacccttccaatatttttgggtaaccagtatagtgaattccatagcttattgtaccctttagatagcgcatgaccctttccagagcttgacaatgatcatctcccggatttgaaacaaaccggctcagcttgctcacagcaaatgagatgtcaggcctcgttgcactagccaagtacatcaatgaaccaatgatttgggagtatctcaattgatcccttgctattcttccatttttccttaatagcacattggagtcataaggagttggagctggcttgcagtcactataaccaaagcgactcaaaaccttgtccacatagtgagattgcacgagtgtaatcccaccctcatctcctctcagtagcttaatgttaagaataacatcagccacttccaaatcctttatttcaaagcttttggacaaaaagtccttaacctcctcaatcacattgaggctggttccaaaaatcaatgtcatcgacatataaacacaagatcactccatctcccccaccatagcgatagtacacacatttgtcagcttcgttcacaacaaagccagcagatgtaagtgttgtgtcaaacttctcatgccattgcttaggtgcttgcttaaggccatataaggatttcaacagtttacacaccattccctcctgaccttctagtacatatccgtctggttgatccatgtagatctcctcttctagctctttgtttaggaaagctgtcttaacatccatctgatggacgagaagaccatgagagactgctagagcaagtagtactcgaatcgtggtcaagcgggcaactggtgagtaggtgtcgaaaaaaatcctcgccttctttttgggtataacccttggccacaagccttgccttatacttttcaattgtaccatcaggcctaagttttttcttgaaaacccatttgcatcctacaggtttgcacccatatggacgctcaacgacttcccaagtaccattagacataattgagtccatctcactgcgtaccgcttccttccaatagtcagcgtcaggagatgaatatgcctcttctatggttcttggagtgtcatccacgaggtatacaatgtagtcatctccaaaagactttgcagtcctttgtctcttactctttcgagttgctacaatgttaacctcctcaggattttcctcaggcgtttgatcattgtgttttatcggtgcaaggtgctcatggggtaaaacaggttcttgactagatgtgctaggtgtatttttcatgggaaattcattctaaaaaaatgtggcatctctggactcagtaattgtaccaacacgcatgtcgggtactccagagtttactattaagaacctatagcccatactgtggatagcataaccaaggaacacacagtctacggtctttggtccaattttacgctttttggctataggtacatttaccttggccaagcagccccatgtgcgtaggtatgagagatttaatttcttcctttcccattctttgaatagtgttacttccttatgcttcactggaattttatttaggacatgacaagcagtaaaaattgcctcaccccaccattccttggaaagtcccgcagtgtctaacatggcattcaccatctcagttagagtgcggttctttttttcggctacccctttgattggggtgaatagggaggcgttctctcatgaataattccaaactcttcgcaaaaggacgtaaactcattggaaaaatactctctacccctatcagacctcaaccgtttgattttcctttcaagttggttttctacctcagctttatagatcttaaagtaatgcaatgcctcatcctttgttttcaataggtacacatagcaatatctagtgcaatcatctatcagtgtcatgaaatatttctttccccctttagtcaacacgccgttcatttcgcacagatcggaatgaactagttctagtggtgccaaatttctcgcctcagatgccttgtgaggcttgcgaggttgtttcgattgaacacaagtatggcacttggaacctttgaccaaagtgaattttggaattaaactcatgttagccaagcgcgtcatacaactgaaattcacatgacaaagtcgcgaatgccacacattggactcatcattctcgctaatatggttcacaacattattattattattattattattattattattattattattattattattacacatgtcatccaaagaaaaacggaacagaccttcgctgtcataaccttttccaataaaagttccatatttagatacgacacatttattggattcaaacacaagtctaaaaccatctctacatagtagagagccgctaactagattcttctttattgaagggacatgctgcacattcttcagctgcacagtcttt

SEQ ID NO: 53635 - DNA, 1466 bp, Oryza sativa
cccacatgtacaacagcagtatgccagtatatatggcttcgtaagctggcttgaaacaacattaattggccgtacaagaaccaaacaaattggcagtaacaaagcctctctgcgcccatcaatggcaacatgaagatacgtacgtactctctagtcaacagcgtgtagagacttacagtagcggtacgaggaaacaaaggcgcaaatgtctcttttcccttgaagaaatgatcaaatgaatcaaggcaagcaaactctatacgttttcatttcagggtttcaaagcttaatcatcgccttcattttctatatatgtttatatcaacttttcttttacaaaaagagagtactgaaatcaaccgggtcagacacgcgctgctataccaaaaggattccaaagaattgcttgtgtgttgacgacgctaggatctttgatggcgtcaacaagaccccgatagaggtcgcttaattggggtattgccatggaaaaatggtgcgcgtgacgaacggccggtcggaggcattgtaatcgaagagatcttggacgagctgtgaatccggctgatgttgccaggcacatttcatgtgtgataccggcttcaagggcaacaacatccttaaatataatgaacgggtgggttcgaaaggtagggtttttggatggccctaccactaggctggctgccttctttcggatgggaagcaggccgggcctgatgggcgagctgttggaaatttggtcataattcgacatattttaattcaaaataacaagataataaatatgatatttacaatgggatttgatccagtgatagtggtgaatgtaatcaacatgagcatgcttaatatagaataagcatcaacaatcacataataacacaatgttgacattgcgatgaacattaacagtaaaacttctaattgaaataatgtaagaaggttataccccaagaatggtcctccgctggagtttgaggcagtattgcctccgttggtattgacgggagcctccgtctccttgtatccagtgttgccgttgtctccagtgttcgacatattggtgaatgtgaagtagatgttgacgaacagtgagtagtcgcgccttgcgctccccaaaaacctgatcgcccgcccgtccgtgcaaacgtcgcagcagcgcgtggtttcggaggcctactctcccaacgcgtgtgcacacactcgtcgggatgggattaccgtagcaacaacaacattggaaaatggatgaaagtgtgtctgactgttctcgcgggagatcaaatccattctcattttataagaggaatggaagatgaagagtaagagtcatggaataggaagaggaatagagcaactaattgtcatcaactagccatgaaccatcctccactacacaaccatcaaccaacaatcaattaggagtaattgatgtaagttaccaatggaataggaagaggaatagg

SEQ ID NO: 53636 - DNA, 8328 bp, Oryza sativa
taggaaaaaaataaacaagactaatcaatttttggatccaatgtaaaatagtagtgcatcatgtaatcaatgtgagcttgtaggagtgtatgtacagctttgttctccaagattcccagcatagattagagactcgtttaatcatgctctaactcgtaaatttaacttcaaaagttagatatagagctttacttctctagatcattttataagagcatgccagcttattccgctttctttttatgtggagctgaaacgttttaatcgtactttagcttcagaagaaatgaagcttaagttggcctgagctgtgtcaaacaggcctagctagcaaaaaggccgatcagtttttgattagtgaatgggagcagtatttttgatccggtcacgcagggccacaaattaaagctggattaattgcttttaattaatcgcagtagttcatctcgaaaataattgaattagttgggaccattttggcctcgaaacccctctataaatagcccctccacctcaacacatcgcttcacacacgagatctcatcgatcagtcacagtgacgcagtgagcactagcttccactgctcgcatcgcttgtcatcatcatcagttcatcaccaatggccaccgtcgaggcaagtagctagctactgatcattcattcatattcattcatcctgtgacaagacgaggtttgcatttcgattcgatcgaaatcgatctcgtgattttgttgtgctgatgatgagatgaatgcatgcatggttgctttgcttaagagcaagtttaatagtaaaaccaactaccgactccaaatcatttgagtcaatttagtaaccaatttatgtactccatccgtcccataatgttgcaacctaagattggatgagacccatcctaagactacgaatctggacatgccatcctacgactatgaggcatgtccagattcatagtcctgagacccatcctaggttgtaacattataggacggagggagtaatagttacctataaacatatactactacacaattcatatttggctatacatatcacaacacacatgtatcttggagtttgtgctacagctggctataaatctatagtccactatagtccactgatcttctatcttctcgaaatgtgtttatagctggcttatacctgctcaaatgctgcaggtccaagcagtcgccgccgcgcctagtctggcggcggaggaggctccggccgtggtggaggctgtccaggaccaggagccggtcgtcgccgccgttgaggaagaagaagccaccgccgccgccgctgcggctgcggctgcgcaggtcgaagagacaaagccggcagatgatcaggctgcggctgctccggcggagactgtggctgaggccgaggcagaggccaaagaggcagagcctgcagccgccgaggaggccgagccggaggcggagacggcgccgccggcggcgatcgccgaggccgaggcaggtgaggcgaaagaaccggagccagaggcagaggcagaggcggcggccgctcccgtcgaagaagctgctgcggcgcccgtcgaggtggcggaggaggctgaggcggcgccaccggccgcacccgaggtggctgccgtcgaggccaccgagtgagctggcgagagatggcgagccggagatgaagctgatggctgccggcggcggcggcggcggcggcggcgtacgtgtgtgttgtgtaatgaattgggctccaataaaaatgtgtcaggttggctaccgggcccagtgtcagtaggtgctgacgtggcaggtcatcactggccctggagctcgtgcccgtgtatgttctcggtctgtgttgtggtttcatcgttaaaaatgctagtaataattttccgtatctttttttttgttaagattttctcttttttttttcatttttgatgtcacgaactcatgatacgagacatataagacacggtattgagggagctaaaatagacttattctaaaaaaggagcacggtgtgtctgctgtgccggcccgactgatctcaggccatgcctgatcatgcctgggccgggttgggccggcggcccatttggctatctatatggggatgagcttttaataatcacaatgcttgatgcagtacagataaacacatataagtagtcactactatgactgcaccggatccttatccatagaagtatgtgtgagtgaactacttggtggagagcttttgtttttctcatgtataattggcccgcagatggtactgccattgcaaattttaagcagtgcaaatctaattcgagtggaatttatgtagcaggcatataattaattgaacacattacgagtttgtttggaggatgtagtagtaatgtgcaaagcatttttcagttgactgttttttctatgtatgtacaacaataaatagattgttgcaaacagatcctaatattaacttcagtacttcatgtcatgttcaacatgtttaagaatactgaaagttgacaacatatttatcctagtgatgtgaacatattcaaacttaacaaaaagttggctggagtgctactgtgaagaacggaggttaacttttgatgctattaaagtgaattagaatctttcggtgcatatatctgatgtcgggaactttcagtgttatagaaccaatttcccctataataaatattcattctggtgatgtgaatataatatttttctcagtaaattattttcttgtcttaagtgttattgtgaatatatattaatcatgcatgatggagaatgatcatttacaactaacttatatgctatttttagaagaaaaaaaaacagtttttgtttgtggcattgcaaaaggctatttgtttagttgcataagttcctcaaagtactgtagattaaagttaatggcattttgtgtatactaatgtcaccatataaatgcatgggggaataggagcatgattgcttaatttcggaaagattgttttgaccatggttaaacttcagaaaattgctgcaagtagtttgtatggtcttccatgcaaactatattagataatgcttaatttcagttgttatagtttacctctctttggcgttatccacaagcagttgtcaattgctaaaatttcgaattgccacattacatgatgtgctatttctatattatggtcttacacaatttttttttaaattctcctgtgatggcagttggagaagatgaagataatggtgtaaatcatgtaatggaaggctgtaggatctttttgtaggggtgctgaaggatcaattatgcgtctgcaatgcatggcctatttacgaaaattttggtagtatttcttatgtatttactaaattcagcaataaactacacgtagacacctttttttataactttaccaaaaaaaaaattgtatggttgaaaatggcaacaatctgaatagccccgcagttctttcacagtgtctaaagtagtaagcatagactcctaggactgttgatattctaactatattaaataatgctatgtttcaactaatatggcaaaagtgatatttgatcttaattggaaattacagttattactccactaaatgtattttgtttgtacgataagatattaattggaaattaccgttattactccacggatctactaggttttattggaggcctacgtaagcccatagcatttttagatcaagaccaccattagctatactcctttaaaaataatccaatggtgttgacagtgaatatgtcaccccacctaccccgttgtaatttttacatattacgctttaaacctcttaatattacatacaactagatttaaatggatagccacattttcctatagggaaaaagtgggctacatatttcatggtaaatatgatttattgtagtaaatattgtgatattttttttcttttatatgtagcaaagcacatggatttagctagtatggtgaaactttgctagacctaatgggcttcgtttcctggccttgggccatggcctgggtggcctaaggccatgacttgaggcctactcccttgatagtagtttccgttgggattaaatccccaaaccggacctgatgaataacaactccctcaaccaaaaaaaaaaaacaaatttgagtttgagttaaactttattaaaaatattatttttttagttcaccggtttatcgaggagttttatgtttgagcatatgataccacgtgcaatgatatgtccgataaacatgctagcagagctgttaccatcgatcgatatttgaaatcggcgtgcccacttggccctgtggttgaatctgatggagatattaagtatgggcatgcgaaacgagaaacccttttaacatgtgatttaatgagtttaaacataaaattagatttatgtaatattgtaaaacaacttttatatagaaaattgtaaaacaacttttatattgtgccaaacggttttttccttttttggagcggagtttgcagagctgctccacaaatttgtactacgggggtggagctgggtttttctgctccacagctccactccatcccaaaagacccactaacctttaattttttagtgtatttacacaaaaatgccactgaaataccccttcctacttctgtcctctcgttctctctcctctccatcttcttccccatcctcctccgacggccggttgtggtggtggcagcggcgtctacgtcggcggcggcaggcggtgtcggcagccgtgggcggtggcgcggcggccgcaacgggcggctcacgggtgacggcgtcgacaggcggcggcgcgtgcgcggtagcatgggaggcggcacgcgagctacggcggcagtggctcgcaagctgaccgatgccgacggctcgcaggctgcccggcggcggcaacggcagggtgacacctacaagatgttcgacaaaatggtgacgagggatatggtaacatggagctgagtaatctagtcaaacactttctatacatacctcagctcctaaaggagccaacttttactggagttgaagtttagagtttggagctctaccaaccgagaccttataagagggatggtcttataatctacaaggccttcaccagatcctatttagcttgtagatcgattataactcaaaaacctgggtcctaagctaaaacacacacacacaaaaaaaacactaaattggactttgactaggggttgaaggtctgaccgtttggacactggtctgaccacatattattgtccagtctgattgctcaaagattagcggtcaggccggcctggcagtaaagtttacaatcctttttctaaatttagactaaaattgatctagtgctaaatttagctgtcaacagaaacattaaaaatttgagaatgttatgttgtcggctcctgagattgtaatctatttggagttgataattgagatacggacaattacataatcaaccactcaacacatatcatactcgctcaacctcgatatagaacacacgggtctttccatgcgtctaggagacgacaataccgtttgtttgtcttccattcaaccgacgcttcgagagaagagggttggggtacccaagtccctagatagctagggcagacatcatagaatgccatattggtgtccttggtagtaggagtcgtatctacgagacgaaaaccaatggtgagtatcttaggtggacgtattgaactaaaataagatttaaaattgacaaggaggtctcactttccacgtaagtgtatcgtgagggtgttcacaatacgggctacgcactcaagaggcccaagagaccaactatgctcaagatcgttgtaagtaacaagcttcacactacatcgctcgtgtacgcctggcaaaaccacgccacgctaggatccgccctccacaacacggcggtgtgcccatctctttacgtcgcatgctctccatgtagacagagaacgcgtgtctatctttaattccgtgttcttcgtttgactccgcatatggacgacatagcgttgaatatttttttttccttttttgcgccatgggtacggaacaacacgtcgattgcattgctaacgccctgaatgtcgtaaacgctcacgctactgtcgctgctactgctgctcgtaaacgccggaggcattttgcatggaacggcttggacatatctctggtcctggacttggtcagtgactgaggtgagacctgtatattttggcgttgaattagaaaggctatcgcacactgtatttgtcatggactcgttcagaaaacatgggcaccaaaatagtagtgccagcgctcacacggcaatactaataagtacccataataagcacagttgtagctttcagtgtcaaattttgatcaaccgtcttatttaaaatatttttatgattagtatttttattattattagatgataaaatataaataatactttatgcgtgacttaacttttaaaaatttttcataaattttttaaataagacgaacggtcaaaagttaggcacagaaacttatgattgtacttataatgggacggagggagtaataactagtgaactggcgcacacatataagttacgtcgcatcatgcgtccaacgaaaggtacaaacctatttagcacagctctagctttaactttaacttttctagagctgaagttcactaaaaaaagtttcagtttcacctaaaacgaaagcgaagttaggtaaaagcagtctcataaaataatttatactgttttacaaccatattctagacccaatttctataccaaaattttaaagttgaaaccctaccgagcatacctcgatcgatcatgggaccgtcacacggcttcggcgtcgaaatccgggagcaacagccggtgtttctgcaaattgcaactgttagctagagggaaattaatgattgcgacctgttggccaaactaataattccatgaggatcatgacaaggcctgcaactactgatagtaatagtaaatagcaatccctttcgtcatggacctacactactacacaaaatccttggacaaaaacacatttagattgcatacggagtattactggtcgtgtttagaaaaaataagcccattttcacgtacggtcgcattgaaaaatacccacccctctttccctcctacccactttaaatttttccccctttctcacctcccctctttttctcctctccttccctcctatccactttctccacttccttccgtcccgtcctctcctcccctcccctccccttccctctcctcccctccccttccttccctccccgatggtggcaatgggcgtaggctgcggctgcggcagcggtggcgcggcgatcaatgacgcgcgggatccggcaggcggtggccgtccccgcatggatccgtcggccgggcgccctcccctacaggatcccgctctcctcccctcaccttcctttcctccctagatccggcagaggggaggggcgtcagcggcggtgcggccgaagggaagcgcggaggccgccgccgggagcagcgtcctcggccgccgcggggaggccggatccgtcgctggccgctgtggggaggccagatccgtcaccggcaactgcagggaagacggcagcgggtctcgggcaaagtggcgacgacgatagtggtgacggcgacgacggtggtgacggcgtttttgatttttttttgattttttattttcccatgcaggcagtttaagcgcccgcgtgcgggtgtgtcacccgcacgtgaaaatcgtgattttcacagacacctcgttccagacgggtggaagatccacacgcaaaaaccgattccgaccacacgaaaaaaatcgttagtctactagtgttattccatttttagtctctcttgtttaccacaaaataaatttaatttaaattttagcaatcattataccaaattttataaaagtaagagataaatgcattgactgggagtagataaagtgagagataaggattcgatagagcagaagtagtgtatgtggaagtgtgaaatataaatttatttagaacagagtagtgtgtatatctctttataaagaaatactactagaagtatactagtatatctctttagagaagaactgctagtataatacttcctcattttttaatagatgacgccgttgactttttctaacatatttgaccattcgttttattcaaaaattttatgcaaatgtataatatataaatcacatttaaagtattataagtgataaaacaactcataacaaaataaattataattacgtaatatttt

SEQ ID NO: 53637 - DNA, 3664 bp, Oryza sativa
  unsure (1)..(3664): unsure at all n locations
ttttcgttgttgccatgatcattgtggagactgttttattgtgggcggtcaacattcggtccattttacaatattaaatacccatgcattgcaatcagcttatattaaaccctacaaaataaaataaaattattccctatctaatcatcctaatatatgtggtaaaattttgtacgtgcatgtcgagttacacggttgctgaacaattgatataaatatacatgttgtatgaaattcatatagtgaacgctcaaatataaacccacatgacagttggtggcagcagaaccaccactaccaccaatattttaaagtagtatagaaaattacaatatggatacaaaagtgtaaattccaagtggccactcgcattttaaagaaggtggttgcatccctttagacccgttccaaagtccgatctgaaatggattaaaacgagaaacataattagcatgtgattagttgagtattaactattaaaaatttggaatatatatatatatatatatatatatatatatatataaaataaagcaacttctacatagaaaattttcgcaagaaacatagcgctaaccagttttaaaagtatgctaatgaaaatttagaaaataacaacccgaagcgtagtttaggacgcgcacttcgtctgatcaaacatttattcattccaaagagatcaaacattcatgtattgtcataggtttcattttgccccttcaatgtatcttgacttattgtgctttaaggttaatgttgtaccacagtattttgtttttgcagtactgtaaggaagtgatagcaagcatttctctattaggtgtgatatattattatcgtacctcatattatttcccaaaaaagtatggtgtaacatattacttttccgtatgctgaatatattttaaatagagtgtcgctagctagatttcaatgatctaaatcctcaaaaatttgcttatcctaggatccatgtcaagatttgtgtccaacgacagcgtgatgatggtggtggcgactgcgacactatgtttagggtctatgtttggaggtgtgtattgcgtgaccgtgtccgcccactaggcaaagtccaattcttctttttaacaattcggcagtgcgatgttcatattgatagagcagaaaaatgtaaagttcagttccaatttctaattccaagacgttggcatgccctcctccctctcaagatagcctctaccttcggttcaaaaataatttcactttaatttgctcccttctaatatgaatgttattcattcaatatgttttatttatatcttacctactcacgtaaaattgatgttgctagatttatcgttaaacaaactatcataatatgcaactctttttatttattttttttatttttatagatattgttggtcaaagtagcatattaaaaattgtgtcgaagtcaaaagtacttatattttgggacgaatggagtatcatagtacaataaacttatattattatattatatctaatttattttttttaaaggacggatggagtattctggtttgctgccgtatctgccatggcgattgaggtgatcgatcagttcagacttcagagcctccgtatgattgactggatcactggatccactcctccacttttgcccgaatccgtcgcagctgattgcgaaacagaagcgcacatcgctttacaagtttacagctgcttggcactatctcagcttcgttcttcatctataaatgatcagctttaggctgtgtttagttcagtgcaaagtttaaattttggttgaaattagagatgatgtgactgaaaagttaaaatgttgtgtgtatgacaggttgatgtgatgaaaaaagactgaaatttgaatccaaactttaaatctaaatacagcctagttagttggttaatacaaagtcagaggtatatacgcgtgttttcacctgcccagatgcatggtttcttctcctgaaaaaaaattatattctagctctatctgcaggtcgaactagcatgaagcaatcaagagtaagttaaatcccgtttgtttaaaagtttgaatgatcatttgcagtactaaatgagcagaggaatggaagcatgtactactatataagtaaaggccaaaagacaagcgggaaattaaagaacaatagtactttataaacaaacaagcacctctctatcccaagacttgacaccatttaccaataaaaattatcatgacaatctaagttggggttatcaaattcttcgttatacatttaacaagcgcaagcaaatcctgccattttcttttcaacgttgatatgtgagcgctatgttggaagcgaatcatactacaactatgatttaattattttcggccattcccacaactctacgagacataaaacgaggcaaattaattgattattaattattacaaacatgaacacgggcggtctacttatgttttaatgaaacctctatagaaaagtttttgaaaaagaaaaggaacattcagtaatttaggaagcccgctaacgaaaaacggaaaagttgccactgctaatagcccaaacaaacggtgctagctgcaacataacagcttataagttgatcataagttggtcaaatactatttaaaggccagttcttttcgtttatgtttatgcttataaactaaaatttgaattttcaacctacaatttaaatgtgatcgtgaggtttttctcattatagtttatttttcaacctttactttcaaatcgctaataacatgtatataaaagttttatttacgaattatttttcgtttgttaatatgccgtttggacgatggagttcttaaaaatgaactgcatctcatatttaaaaataacagaggtagcacgcggtaaacgataaaataaataaagtacttctctttccgtcctttttttttnaaannaaaanaaaaaaanaaaagggnnaaacccctttgggggnnaaannnnnntgttagtacatgtccaacgtttgaccgtccatcttatatgaaatttttttatgattagtattttcattattgttagatgataaaacatgaataatactttatgcatagcttatctttttaaattttttcataatttttttaaataagatgaacgggtcaaatgttagacacggaaatcgtttttttttttacgggggagtatactgatagctaggagtaacaaccaaacagttggagacaagcacgcggttcgagcgagcgtcgtctttgtggtgcaatttctcgggggacgccaagccccgctcggttcacgggcgtctcactgtgcggtgggcccatccccagccgtcccctcgcgggccaccactctctgatgctgacaggtgggtcccaccctctcgccctcttctcccctatatatacatatagtacaaaatccccgtgtgccaaactgccaatattctctctgccaaacaaaaaaaaaggaaaaaaaaccaccgcttttcgcagtgcgcttcttctctctccctctctgctctgctcttcctgagctccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53638 - DNA, 710 bp, Oryza sativa
atttaccactgatgttaggttaatgacactgtcggcacattggctggtgggaggtatgcggataacagtgttgttgctgctataatattgggcactggtacaaatgcagcatatgttgagaatgctaatgcaattcctaaatggaccggtttaccgcctaggtccggaaatatggttagtgtgtgaataccttatgcttgggattatcattagttgtctatgtcttatagatgatcaatgccaacactcttgaatgttaaccctacttaaaaaaatatgtaaacgtggaattatttggtattctctaggtaatcaacacagaatgggggagctttaaatcagataagcttcctctttcagaattcgataaagcaatggattttgaaagcttgaatcctggagagcaggtattctatccccagtattttcctctccttttagttttagccttttaggtggaccgcattaacttgtatgtattttccaacagatatatgaaaagttgatttctggcatgtatcttggagagatagtgcgaagaatcttgctgaagcttgctcatgatgcagctttgtttggggatgttgttccatctaagctagagcaaccgtttgtactaaggtatatttctgtaccatctctcttttgatcttcattccttccttttgtcatggcaaaagccgttttacttagttgttaacggggtgcag

SEQ ID NO: 53639 - DNA, 3575 bp, Oryza sativa
  unsure (1)..(3575): unsure at all n locations
atggtgtgtttaattcacgtcaaaattggaagtttaattgaaattggaaacgatgtgatggaaaagttggaagtttgtgtgtgtaggaaagttttgatgtgatggaaaagttggaagcttgaagaaaaaattggtaactaaactcaggccttacggggtggtttggtgagagggactaaacctcacaaaaaaacaaaggcctgttcaccttgatgccattttcaaccttatcaaattttggtaaagttgtcaaaaagtgactacatttaatttactgccaaactttagtaaatatataagaaatcctgctaaaattttggcaataacaaaatttaataaggtttattttggctacaatctaaacagtcctaaatccctcccccttaaatgctgatgcggtatctgataccgacctgtataggttgatagctgaaatggcatggaagttaagggaaggaagaagtaaagagtacacggacgagttcctgccttcttggcactggcagatcctttgcactgaagacaaaattgtggttgtttgttgcagtgtaccacaactgcattgctttatggatggcttaaatgttgacgtgcatttgatgtgaagcatcaggcaaaaggacgctaaaatagtaccctccctacatggttgcaaacggtggttgtctgataacacgtccagagctggtttggctcggaaaaagagtggccaaattcattgcctgagcgtatttggacgccgagatgattataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcctgcggcccacgggccgttcggggcacggcggcccgtgaaggcaggccgccagcctgcagtgcacagtgtttttttttaaaaaaaagcaaaggaaatgtataaggaaaaataataaaaatagaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttctaaaaacctcatataatttacgtctaacctcagtataaaaagaactataatctacacctatagtatctccaacaagtgataaaatagcagacaatccccttaatttacacctaggatctaaaacaaaagcaaaagcatacaancataggtatatttttccaatatttcaaatatttttgtttcatgtgaaagacaggttcagttagaacgtcatcattttcgtattctttaaataatgtagcaatttcaagaaggttgtgcaaaattatattagcagttggataataaacttgtgacaaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctctttcattcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctccactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaacggaggttctcgatctcttcgagccggtgtgtgtcgaaacacttccgctcgcggttccggaaaatccttccgaagctgtcgccgcctgaaccggtacctcctcacgacagccgtatgaacaggtacctcctctacagatggtggagttggagccgatccggatgtaccgtcaaaccccgac

SEQ ID NO: 53640 - DNA, 1131 bp, Oryza sativa
cacagcgtttttcctgtttggctgttgatgttgtctgtcatttctggtagtgactctagaaccagatttagatgtagataatcctgtctcttaggataaaaggcacacctgaaagtacaaagggacttgtgcgtgtctcccgagatgcatgagggaattgcttaaccgttactagtagcatcttggaccgtctgaaatgtgcagtgaccatattgttttcattatccaagcacatgtcagcagctaaccactgaattctgttcaaactttttcgaactcgatacaatatgtcactcgtttgcagcatttggaggatcgctgcgcggaatttatttccatcagctattctcgaccgcggagctaggacagtgcgacaatgcacacatcgatttggactccattgaagaggacacgacctgcagctgtcaatcttgtttttgctgacggtgtgagtcggaacggatggacttgagatttgtttttatctgctgctgctactgctggtggatctagatcaacagtagatctgagttttgacagtttagtattggtccgaactctgattctgtgtaggagtagttatgatgcagaagcatacggtctacggtactgtagaagattgtttttgtcgcctcggtggctctccgtaacaggtcaaggcccgttatcagcacagattatgtatttcacgcttctaaaaagacattttcttttccccgcaaaaaaaaagacattttcttttaaaaaactttcttattacgttatttagataacctgttttaaactatatcagttaagacttataatataaaatactactgtttaattcaaatccatgataaagaaaatcatccgttagttttcatcaatcagcccctgaaaaatacgctgcctaatcttgatgttgtcagtggctcagttcaatgtaggacagtaggagtcgaatacctactacaactcgtagtaagtactacagtgcagtacttctaatcctagtggtatactatatgactagaaaatgccgtgccgcgtaattgaccagcttttatgaaataaatgaatgaaatgctctgataagtacacctaatatgttttacttcctccatttcacaacgtacttcctccgtttca

SEQ ID NO: 53641 - DNA, 1405 bp, Oryza sativa
taacgaaaagaaatgaagttatcgaattcaatcaatagtttccacagttgtgaaagagggattaacctgtgagttagtcacagctgacaaacttctatgacaactgacaggaggaaattggggacgcagctaacttgaagtaaaggtgtttggatagctagagtgataaccaaaaaagtgggcaagttcacacgctctaacagcaggaccataggatattccatatgctgctgctgctgtattattgatgagccaccagcattctgtagctgttttcttgctctcttaatttgcaacagaaatcactattatgatctgaggattgccctgcagttcagtacaatcatggcatcgtactgtacacacttttggcacctttgtcaagaaatctataacttatagaattacaccaatctgttatatctgaaaaagagtaggtcatttacaaaatatgcagtttgtccactgcacctgcaagatgctattttcccattatcataatcatctgtacaagccaaaaacaggtcatcccccagaaaggtgatggactatggtttgcacaattgatatgtctggaccctaatatcaacgatttgctacttcacagggtcagctccaatctgtggaaggacataagaggaaaacaaattgagggcagaccttaacttgaggaagtgaatccatttgacccaagtctatagaattattttatataactaatataagtgcaatactatagcatggtgttatataacacaaaagtgcatccatttgatccaagtttaaccagagatacagtactgctatttatgaggaaaatggcgcctgttgaagttgccctatgcttaccatgtcatggggaagttctgacctcctcataaccctcaacctcttaacagtcgaaacaaataccctgcagcagtcaaaagcattagttagatagatagcagtattcacggcacatccttcgggctagtttgaatttgctaccttaccaaaactttggtagggtagcaaaccaaacatctgtattaaacactaccttcgctacaaatttggctttgctcatgaactagtctcttatgggcatagtttggcttcaatccaaataaacattttttaactttaccctaccaaagttttggtagtgccaaaacttacccaagatttggcactaccaaaattttgctggggcatcaatccaaacaggcccgaaacaaatcagtatgacaggctgacaccgtatcttgtatatggctagtgctaataaatatacagtaggagtaagcaacaacaaaagcttacttccatggtatgtccccagctaacattctgtctccatcattgtcttcatatactaaagtgtatacaccagttccatccaacaaccctgaaaatattttgt

SEQ ID NO: 53642 - DNA, 2386 bp, Oryza sativa
gctacttgaagagttcagttttgcactcaacttaggccggagaaagtgtcaaaacaaacgtgtaacatattctaaggtcaaagtgaaagctggaaagagaaaccgggaagagataggacttgtgatcatcaaatcaattcatgtcacaacctcaaagacgttttcgagcaagggaaatggagcctgcaaccatttattcggcaacaagataaagcactttcaagtctcgtgtcaaacttaagtctttcacgacgtgaaagagtggctaccaactcatgtccaaaagcattttcggatggacgcgatgtaactcgccgaaattagcagacaaagagattcaagctcatgcaccttgcaaccactcaagaattaagataagatcacgtagcagagaacatcaacagagcaagcactcaccactcaccagacaccaagaacagctgcaataacctgtccaactctaaggctcaacaactccaggaatggctatcagaaggccagaactaacaagaagcagctagcttttgtactagtgtgtgtgatgcctgccgttcttttctattggcctgctgcttcctagtgcccctagagctgagctctcctttttatccttgcacttttcagcctatctgttcttggcaagcacgcagttggatggctcaacctgtgaatgatgcaagtgtgtactagtaggcatgtagcacgggttcctttgcgttcgtgtgtacgtgaccgtgtgtatgggactggatcgatgattgggaggggggccaggtgcaccgagcatcgatcaaatggatctagcggaattgagatcacctgcagttgtttatgactgcaactttcgcagtcatacaaccattgttggatcaaatatcaagggctcaaatcacacaaaagtactgttcatcagatactgtagcagatgaatcctgtagcgcgtactgtagcaagtgataacaaacagtactggtactaaatcatggcgttgaaatcttcgatccgatggtattgaagacctaagactgctaattttgcagtccatgttcaaactgcgtgggatcccaatccgatctagcgacgcctacggggttatggcttatccaggcaagtggggggattggtgatgtgatggatgcggggtttgttagtattggtttattatatcatcgtgtagttgttgtcggatggtggtggtgtcatggtgacacatgctgcaatgcttcttgttctttcttactacactgcccttctgggaccactgtcggcgttgggagaatgcgttttctcttgatttgattttctgatcgctgtccactttgcatgtgctgattgctgaaactatgattttgatccatgctgatgaagaacacgtacctccggagctacggtgttacttactcttatatagcaacctaatactagattgaacagattttaatcgtacgaatttaatcaagtactaagttgttatataatttttgaaacaaagggagggagtaatttaatttcgttcataaagagagcatgggttcccatccttcacaactgctgcaacttgtaggaacgttcgcaacttcgcatgaaggtatagtgcacgcctacgtgttgccgctgcaggacgatgtatgctcctttcccttgcttgcccatgacgagaactcaacagaggccagaaaacagctagtgcaccggaaacacagatgcatggttgcgagtagtgcaccggacgcacgcacgcgccatgacatggagtatattactgtagcacactacgggatagtggactttgtggcagctagcctcgccctggcgcgcgacgcgaccacgcgagagaggcagagataaggagtggacttttgcgcgcgtgcggcgcgtccgccactgcgtctcgtggtcgccgatcacgcgcgcgccggtgtaagatcgagagatcagatggacggtgtggtacggtactccgtatccagtggtggtcctggtctacagcgctggcgcgctctttcctcgctcgtgcacgcaacgcacgcgcgagcaccaccgcggctagctgcgcacatcgacgaggaatcagtgcgttcggtaggcggtagcccctgtagacggtagtgtggctccgcaccgcagcgacgactcgcggcgccgaggtgcgctttggcgcagacggccgaccggcccatgcgggcaccgaatggcgctatcgaatatcgatcttggagacttggacatgcaggctaagactgtgccggcagtgtcctgtgtcccggtctttcttttctgcgattttggacatctacagttctacactttcatggacacggtctgttgatttgcaactgcagggttccgaggtacaccgaccgtgttttccaactcgacctgttcg

SEQ ID NO: 53643 - DNA, 2757 bp, Oryza sativa
ccagaaatgaaatacagtgggacccacgtgtcagacgcaacaaaatccctacccctctcttccctatctccctctccttctctctctttagctcttctcctgtaggccggcgcaccatgaaggtgatactggtggcagtcccaaaggtggtatccacgaccaacagggagagggccaccatccctgccgatttcggttctccctcaccttcgctgaccccgcgcgcctccctcatcgttgtgcaccgtgctcatccacggggttgtcctggtcgttccctagcggcgtaggcgcaatgctcgcctcgtcgatatggcaagaatctgtggtgccctctacgaccctaccaacaccgagggggaggctgactacaccgtagctccgtccgtctccaccgtaccctacattctaccagcccccaccatccagttgtgttttggcactgccattagttgcgacgccccacgtcgcgtaccaccattggccacaacgtcaacgtgcctatctgtgcccccacgtcgtgtcgtggtgtccaccgcatgccaagttgtgagaggttaaacccggcccaattttgggaaaaattttcctttaaggggcccctttttggcgtccccttcgactcctaattagaagattggggtagggttttttttgtgtgaatttgacatgtgggtcctaccatgtttcatcacctaaaagagttttggaactatatatttacaccggttttaacaattgagtatgtgttgtacttggtttttcgatgggctttagtttggggtctatctataatacattcgatagtttttggaggaaaaaaacttgtactaaactatagtataattaaagtgtaactaaaatatgtaaatttattttgaaatcaaaacttgcactattactccagtgagtaggagggtgcgggttcgagtccacaaccaattcaacagcctaaaatcaaaagtttttccctaaaaaaatattgcaagttacctggcaatttctttggtttgtactgccgtgtcggcgaacaagtaagacgtgatcattaccgtgcagcaaacgcatgcgcttttcccttttttttttcatggcacagtttttttttcctgctaagtgtgtatacatcaagagtttgtatttctaagagtaaatttcacaaaatcacaaattctttattcaaaatatcacaaaactacatatttaaaacggtgtatcacaaaaccatagatttaacaacaaattcgccatgaaactacatgtttaagataaagtactataaaattatagatctagtaataacaaaattatcacaaaactatgagtctagcaccaatttaatcgcaaaagtacaacatttacatcttcaatataacattagttctaagagtttaaactctaaaatatgcaattttgtgataacatcaatattaaatatgtagttttatgatacttggtattaatttgtaattttgggataatgcctttaaatctctagttttgcgatagttttgttaaagtatatagttttataaaatttactctttctaattcctgttcggatttcaattcaaattcagatttacatgttttatatctatattataaggtttagcttataaagtttttttatataaactttctatgacaacttatcatgatgggccagacgcacgtggggtcggccgaaacatattcgtgttcctggccgcgcccgaacattcacacattagatctaccgtcttttttttttttgaaaactaaacatccattaatataaaccgacagagttcacgggaataaatcccagtacattgccaaatagataaagagagagcgtaaaaccatccgtttctaaagaatggaaacctgcactaaggctacaaacttcataatgaaaccacacagcagataaggtgcacatcgatagggagctgcggcaatgccgcgacgaatgcaaccttgggcctccttcggcgtgcagcccgcttgacaaaccggtaatccccatccggttgactccacaaagactgcacaaaacggaggtctgctgctgagccatagattttggagtaagcaacaccggactcagcaagaggtgtccacggagttcgtcgttaaatctgaggagcgtgagctcaacccaaacaacaaaccctgcatggaacaagctgataggaaacatataggaagaaggagcccaaatccagatctccaaacccactgaaaaactcgaatggtggcaaacgaactgctgtcttcttggatcgacgtatggggatggggaagagtaatcctacgaatcttgactgatggaacctaagcattgggagctctcgaactggcaccagtgaaatcgtcgccaccacgccgacgggttgtcatcaagcaccacgagcagcaagctctgggcgacgatagcaccggacgacgcaagccacgagaagtcaccgcagccatcacacgagatggggcgatgacctcccagccactgacgacgaagcagccgacgctgtggccatagatgacgaagcagccaacaccgtggccactgacgacgaaacagccgacgccgtggccactgacgacgaagtagtcgacgccgaggccgcaggcgacgaagaagccgacgccgcggccacaggcgatgaagccgacgccgccgcaagaagccagctccaaccgtcaattcatccacaggtctacggatctcacacctccaccgccaccaaccgccgccgccgcctaccacaccgg

SEQ ID NO: 53644 - DNA, 3038 bp, Oryza sativa
  unsure (1)..(3038): unsure at all n locations
cttcatgtccagtagttggccactatttgtccaaggacccaggatagaccaaaagtggctgcctaactgttgggcttttatggccaggcgtatttaatcggttgaatcggtttgtcatgaatatcctagcggaccatgggaaatctccaggtttaataatgattttgaatgttgatgctcagctcatcagtttgtgagttgtgacattgatcccgagtttgatggttaacctgctgaaagcgtgttcttgcttaggctcaatctggaggcacttgacacacggccatggaccgaccttcgcctaaccatgcgcacatctcgcgtaaggcaagtgcgcactgagctcgtctttgtttagtcatggaaaccgcatgccttaatttgttaggagctggggtaatttttttccctgactagcgcgggatggcggtgcgttgcaatgcgaatggaaaagagaaccccatcacacatttaaagcctcaaaagttttagaaaaaattaaggtcacatttatcatcattttgtacctcacttcaatattttttttaagggatataaagtctaccaaacctgtcgatagcaccactatataggtacatgaatgtacatctaaggctgtaacactggtggagaaaccatctttacttccggttgggaaccccgtttagtcccgatttttcaaccgggagtaatgattcgggactaaagatacatctttaatcctggttagtaccaccaaccgggactaaagagaggggatctttagtccaaccgggactaaagagacaatagcgacagtaccagatggtccctttttctatttctttttttctttttattttctcccgaatcaagtaggcaaatccccaaatcaaagtaacatcccaaattcacatcaccaaatccacatcacaaatcataaagttacttatacacacaaatcaaatacatcacaatatcctaagaaattgctcaaatacatcacagatccaaacaatgaatcagaatttttaacttctcagtcaaatacatctaagtgaatcatcacattttttttttaaaaaaaagaatgccgccgctagccacgaccgccgggcgcggcccagccgcccgccgccgcgcgcggcgccgtcgccaggccgccgggcgcggccccgccggccttcgccccgcctgtagaatcgagatgtcgactagaggggggtgaataggcgatttaaaactaaatgacacctaatcaaaactaacttaagttgctaggcttggtgagggtcaactctaactaagcaactaagttatgttttgcaaacctagggtgatagtggctcaattatatctttagggaagtaagtcacactcctatgtcaatgtttagcaatcctagggtgatatgatctcaagtatgtctctaaaaatgtaaattgcacaaatgtaaatgcgacaatcaaatgagacaaggagacaagagatttttcaccaaggttcggaaattcgccggtttcctactccccgttgaggcgagcccaactccaccgctcaaccacgaagccaccgcacgcccccttcgtcaaggggtgggcaaggcgggagccggcccacggagaggactacccaagcctcgatcactagggtagttcttccttcactccgaaggtggtgaactccaaaccactcgcaaaccggcgccgggcctcctccataatcttctcggagaggtcaccgggcaactcctccacaagccgtctaggaggcggcaacctccaagagtaacaagcaatgacccggcgtgaagatgatcaatcaagtgccacactagctctacaaatggaagcaatgcacttgactcttggctaatcaaccctctaacacactagatggatgaacacaaagctcaagtgggtgtgagagaggtgcaatgggtgtatgcaattgaattgggtgccaagagagcccccttgctgctagaaggggagtatttatactcccaccaaccaaaactagccgttgggggcgaaatctttatgctctgccggtctgaccggaggtatgtggccggtcagaccgtgctactctgcaacggctagaaaactagccattgtagccctgtctgagggccccatcggcctgaccggtcagaccggcctcggctcggtcagaccgccatcggctcggtctgaccgaatacagctccgtcggctctgtatcggccatcccgagcagcaccatacccggcctccagggggccggtctgaccgcgcatgtgccgccggtcagaccggccatggccagtcagaccgccgttgtgaggccggtcagaccggccagggcacgccggtcagaccgccactatgtggccggtctgaccgcccctggtcaggccgagcccagtgaaagcaaaggtgattatgtgtgtgtgatgaaaatgtgagcacaagtgaaaatgcaatgacctaatgtggcaatttaatcatctctttgctaggtcattacccccctttatagtacggcgaaactaacaaataaacttgcaaatttgatcgtccttcacctcgatcaattttaaaattaaaacactagttttaccgttttcttttcttcgcttcgcgccatcaaattttaatccatcgatagtcatccatgcgcacacatgacgtggacctaacttaaaatatatctcaatagcaatggttagtccataattatcgcttgtcattaattaccaaaattaacaacgggggcctagatgcttcaatctccccctttttggtaattgatgacaaacaccacaaatatatataatcaaacatagaacacatggatatatactgcaaaggaaatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53645 - DNA, 2200 bp, Oryza sativa
cattagccgagcaacatcttgctcaccaagtttccttttctcttctatttttgacttctcttcctgaatgcagaaaaaaatatataatatgttatatagttgatataacagttgccataatttctaccggtctaggcggtaacaaaattaacatcaaatatcatccttatagcaataatatatgatcaaacattatatagttaatatttcatttgtttatattattacaataatataaagatagcaaatgtactataaagatagcaaatgtaggaaatcaaatcttttcagtgtaggtctaaccttaattatctgaagccggtttatagccatctgaagaaaggaagtccacaatgtcatcagttaggggggagaacttctaaattatgtaatttattataacaatgaaaatactgaatatttacctggttttcttcatttgtcccatttactaatatttcaagtgctttgatttttgaatggtattcatcttcccttgtcttaatgatcacattttgctgcaacaagagacatctgattcatgagttgcatttattagctaaaggatatataggcttcagggaaaaaagactctcttacacttcttatgtgctctgcttgaatacaaagacgacgctcaatttcttgaactactttcctcagtaggtacactacacgctgaggtgaggtagataaatttattagatttaaaagataccaatgaaaaagagagcatgcaattcagaaacacagacatacatgtggtatttctccctttttcctttcaatgctttcgtccaaaatgccattaacgacgctaagaagggattgggttggtgcattctgtgagaaggtaattactgttaggaaaggaatagcaaacaacaagatagaacaattcaacaagcataagcaatggaaagttacatctaaactgttagaatgcatcatttctgaaatcttggcagccggaagatcagcataggatccacgttttaattggaaaatctcacgaagctttcgtcctgcagcatatatgacgagctattataaactaaaaggtagggaacagtagtgacccagatatagattatacacaatagcttgagttacaacttgcagcaagcatacacgttaacaagtttgtagtttggagcttggaagccatgttgaatttaagaaacgttaaagtaaccaccccaccatgatcaaatctagcttcatcagaaagtttgtatgtccactaagattctatgttgaacatagttgtccaatctacagcttcaaccaataaatcgttgaccccccacaacatggccaagtgcccaatcacaaatagcccatgtcattttccctttgagaatttgactatatagtacagaattctagagccaaagcgtaaacatgtagggacttcttttcaactaatatttttaaactatgcaccaaaatagtcaacaatgtgcataccattaaagatgggagttttctgctgagacttagggtctggaaggccattcctcttgtcctctccaggggatgtcttcccttgtgccacaccagggacaagaggttcaccagtttctggaactcgccattttttcctcaaaggagccttggaagtaccatcacgtaatccagaactcacactttccctcagaaccaagaggcagtccactaccccagacattgaaccctgccatggtcaagttatgagttaacataagcaatcaggaactttggaaatggtaaacattttttttaatgaaaaactgtaacatcttacatccacaaatagtgaaattggggggatttgctccaatgcttgcatgtttccgtcaattgcgagtatttaaaagcatgtcattttaactatgcggtgtcaatcctttttgcagatttgcttcctagatgacagcatccggcatagaataaatctagaactaataatctaacctccttttctagcagtcaacaatctatcacagaatttgagttattactatagtgcaattatggttaggcgatattaagaggttattcatttattcctcacagattataatgggaaaaaaaactctagaaatatagttctacttatatgtgtatgcatgactaaaacttgtcagcaacgcaataccatgagcaacaaggccaagcaccattatattgactagcacaataagggggctgcaggaat

SEQ ID NO: 53646 - DNA, 1761 bp, Oryza sativa
agatttaaattttggtgggtaaaaaccccaaccaaattacttcgatttgctttcgatgctccccatatcaccggtggtgctttccagttagtttggattttgataatagaaaattttaacctcattgaggcttgactttgaagcattgaaaagcgtggaactattcatagacatatttttgttctttgttctttgttcctactatagtctagcataatttgaacaacgcaagaagtactccagtaaacaatttctttgttttggaatcctcaaggagccaattgggtagaacatctttatcggaaccaatagtggtacgcgtttgaatccctgggacctgattaagctccaatattcatacgacgtgcgcggcagagtgcagagtccaaactcaaacgccgaatcctgtatcaattacaaggataccctttcccatcgtgcaggcgacctgagtttttttttctttttcttttacacatgagccctaccttaagccggcacgccggagagttgacgtcgtcaaacaggttttaatcgcactcccgccaaagtggccaaactggctacctccgattgattcggtccgtgaagccgcaagccggaatcgtgaaaggattttttttaaattactttttgtactttttaatttttttattttaaaaaataaacacttctgaaacttatttacaaaatctagacattttgtctatatagagaacagtgtgaccaaataacactgtcacaccgttcaaatcttgaaaataagtcttggaaatatttagttttaaaattaaaaaattaaaaagttcaaaaagataaaaaaagatctatgaaagccggcggcgaaatgctactccactttttcccatcgtgctggtgctcactgctcagcgagagcttgacaggaaatatttctgaattcccatcatggaatgaaccatattggttgtgtgaaagtaggaactactacttgcatatttcggccggttttaggtcccaactttttcttcaaaattctaacttttctatcacatcaaaactttcctacatacataaactttcaacttttttctttgaactttcaaatttaggctatgtttagttcagcgcaaagtttggattttagttgaaattggagatgatgtgactggaaagttgtgtgtgtatgacagattgatgtgatgaaaaatgactgaagtttggatccaaactttggatctaaacacagccttagtcaaactttcaattttaacgtggaactaaacacacccttaggttgtggttttcaaattttccgtcgtcagagtttgctccggtgtcagtaacactgtaacagagctgtaaaaggagccaaacacaaaatgtacatcttgagtggttgcaacttaaccgccaagattagaacatagctcatgcttttgcatataggagtacttatcttagtagtagttagctcagtcatgtccatcacatagatatcagatacacccctgtcattccagttagttcagtaatacctatcacactatcagggctatcagtcctgattaccttcataaacttttgtcggccgatcacactatctccagcatagcaatggtcaccgacacagccggacagtttcatctgtggttatagctgtatataaacccatcgcaatctggacaacagcatggacaaaataagggcaaagagagcaatctcatgatgatgtagtaatcttgatcggttttatttttgtcataaacaagcagacatgca

SEQ ID NO: 53647 - DNA, 5048 bp, Oryza sativa
atcattgcccatttaaaagggcagtcggtggttacacgcatctctttgtggctatcaacaaattctccaagtggattgaggctaaaccggtcatcacgatcacagcagataaagctagagattttttcatcaatattgtgcatcggtttggggtacctaatcggatcattactgataatggcactcaattcactagcggagcatttaaagacttttgtgaagacttcggcattaaaatttgttatgcctccatggcacaccctatgagtaacggacaagttgagcgcgctaacggcatgatactgcaagggatcaaagcacgagttttcgaccgactacgcccctatgctggcaagtgggtagatcagctgccgtccgtactttggtctttacgcactactcctagtcgggctaccggccagtcgccgttctttttggtttatggcgcagaagcaatgttgccgagtgaagtggaatttgaatcactacgatttcggaacttcaacgaggagggctatgaagagggtcgagtagacgacatcaaccgactagaagaagcccgagaagcagctttaattcagtcgactcgatatttgcaagggttgtgccgttatgataatcggaatgttcgatcgcgagcctttttagtcggcgacctggttctgaggaaaattcaaacaacacaggatcggcataatatctcccttatgggaaggccgttcatattgtgaagtcactcggcaggtcttatcgactaagcgcaaacggtactctcatcaatattttggaatattgacacttcgtcgattttatgcttaggctctgcttgtatctttcctatttgactgcttatcaattcaatttgcttacttgatgtatcattgctctgtttgatttcttggcttagtcaatgaggactgaaagttttttaacaacttttgcgggttttaggctcaacaaggtttgacaaaaacttttaagaaatcaggagctaagttaagatatcaagcacagcataaattcatcagtattgtacaaattgtgcctccatcatcattaatcatcaaaatcattggtacattaatcagtatcagttttttcatcatcagacttatcagacctagtcggccgaaggtcgacatcttggaatctctcaactacatcagcagcaattttgtcagccgctttctgcgcatcactgatgaggtcaagagcacttcttcgctcgtcccgtctgcaaagccatcaatggcatcaatatcaactcttggataaagggatttggtcatcgccaacgccagacttgctcccatactcccagcttctttgatgttcttgaagtaagtatctggagcgactctcagcttgtcgaagatttcggcagcatcaagtgtactcgaaccggcgttattgaaaaacattgcttaaacaattggggtagcagcgttagcaacctcatcccgggttccttcaagttttttgatcttgccaaccaggacgtcgaattgagcttgagatttgatcttgcggtctgcatcaacagattcacattaataagtcagtatatggaggatattggcttttgaggtattgattgttgataccttcaacttcctttaaagccaggtctctttgtctcgctagttctgccttgtcattttccagaatttgaacctgcttctccaactgagatatcttggcagcttgcactacattgattacggttaatcaagattgcaaagataacattatgagtcagttgagcagagtttgtgcgtaccttttgatgagccactcagttcaaaatttgattcctggagctcagcgatccgatccctcagatcatgttcattcttcctggcaagttctttcgcttcgtgcagttgattcctggtagcttcgagggttccgagatgagggactaacctctctaaggttaccgttttggcttcgttcctaagatgaatcctctgcaagacagtttaatgagcacatgaattaaatggcaaacaagatggttgaaatcaagtaccagagggcttacatttacaatacgggttgcttgaccaagtgccttcttcagtaggcataactcttcgtcctctttttgcttatttatcacgatcccttgaggctgcatgttgtcatcccaccacttgaccagaatcggagggcgtgaatcctcagccgcttgtatccggaggatttcttcttcataaccaattattggccctagtgtatccatgaatgaagatgaagcagctaaataaagtctgttggatcaaaatgatttcagatagcgtggctacctgtgatgattcccggtcggggacgagtggactttggtgtcttcacaggagatctggtttctgattcactgtcggcatccttcccgagaggactgttcgtttgagcttcaacctcgggaaccttttggcttggccctgcatccgactggtttccagtcgggggctcctggttagcaccgacttcagcttcggccgactggttcccagtcgggggctcgttgctgggttctacattgtcggttgccggctgattgtcactcggatgatcctcaacagatggcccggtttctttggaagagcttgtgtccatgttagtcgggtcagagtctttcccagacggatctatatcagatggtttcctgcaaatttgattatcagtgttattaccgcaatgggtgcgcatcaatgcaaggaagatcgttatatgagttgcacctggaagacttcctgatctttggcacaggacgactggatgttttcttccatggagtagcctgttttggtagttttttggttgtctctcggtctccaggcctcctgatggtatcatcggcttcgtcgtcacttagaaccagcttcctctttcgagaatctggctggccgactggatgtcacgcccagaaattcccgaatagaattccaagcagaatgtgtattaaaacccccgtccaggaccagccggggtacacaaacgacaatgttgacctacagatccacgtcttacaaacaatataaaggtcttacagaaatgcagcggaaaacaaaagataactggagctaatccttgacttgaactgcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctgacccacgttgcgacaggcccaaccatccacctaaactatccaaattcaacagattacactagggtgagactaatcacggtgaatctggttgaccgcccgtaaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgcgggagggacctcggcgactatctcgaagtacaccggagcgtcggagggatcggaatctagcgacatacaaagcaaacattgcaaacaggctataagactactgaaacagagaacaaaaccatttttaatggactctacatatttttcttgatttactgagacttgaatgggattaaacggagctcggatgaattagatatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaagggggtggcggcgcgcgggcccacgggtcagcggcacggggaaaaggaggggcggcggcgccacgtggcggccgaaccgacggccccgatctacccaagggtagatcggacggcggcgggacctcgcggccggggcacgcgggcgcggcgcgagacggcggcgaccatggcgccggcggcgcggcgctcacacggcggcggcgcgcatgcggcagcggcgcaaggcggcgaccgaaggcgaccgaccggcggcggggagcggcggctagaggaggagcggcggctacgcggctaagcggcgcgcacgcggttacacggtacggggaaaaggagaaagaggagggggaagcctcaccgacaacggtcgacgacggcggccgacggaggacgacgacgacggcgggacgagctccggaacctcctaacgaacaac

SEQ ID NO: 53648 - DNA, 1663 bp, Oryza sativa
catttcgacatgtagaattcaagaaaaattccacatgtcaaatccgattattgtttgcattgttttcttagggttttatcctgatttcctctgcattttcttggggtcatttgtaatttacaatttggcttgggaggaaaacttcggggtgtgacactggatcagaagcacttggttgagtttcagaccgaattcttggtcctccgctcccttgtccagtttggtggcggggagatcggcgttgagcgattgggggatccgacttcattaaagcaaattcctgggtgtaatatccttcattgttaactgattcaacaagaaaacaagatcatattttgagaaaggttgcagtgtatgaatacgtaccagtggaggagggttgaatgcattgaatggcacaacgggcagcagatgtgagtagctgacaacgatggcgttcgagaagatcttatacatcctttctttcatgaccttgaagtcaagagaatctggatcttcacgatttgggtcatgcttgccgtcaaattcgaaggctgtgcgagatctttctttgattggagctaaccgacacttgataaagtgccgggtgatctgttccccttgaaggccctgttctttcagctttatcatcctctccatcagttctactgcttgtgcagcttcatctcctattggcagtgagttccatgtgtcctggtaaaccgaaggaagacaacagtactcggggagtgcgggctcaggattctgaacatagaaccagtttgcatgccagcctttgtttgaggttttgaagggcatggagaaatatttttggctcaaggttcctctgagttggaaaccagctcccccaacaacgcacggtttgcttttgtttggctggggcttggggaagaagatgcggcggaacaaagcgaaatgaggcctaatgcccagaaaagcttcgcatgcatggataaaattggcaatatgcactatggagtttgggttctagtgatgcaagctaatcccgtagaagttcagaatcccccggaagaatcttgaggttggaagagaaaatccgccatagaagaaatgagcaaataccacgatttcatgtgtatcgggggttgggaatgcctcaccaaatgccggtcgccacccgatgatttcttttgctggaagaacgccgtgcaccaccatctccttcagattatcttccgtcacatcggagggcgcccactgactctcgaagctttctctttcttccgccatgaatgtgaaatggatggtctgatttagttcgagatatggctggaaaaagatggggaatcggagcggtgaatgcggggagaaatttcgtgaagtttttgagggcggattggagcggattgatgaaccctagtttgcccggcgcagttttgcactgtagcaagaaatggggaaaatggcgagagtctcagcggggaagacgaagagacgtttttcacttcggtattattagggtatcgggagtactaatgggcctgggcctgtacagtacttcagcccagtcttatttccagcgtggcccgttgtgatccttagggacttaggcactttttgctttggcaatttgtgttcacaatgatgcgacccaatgctgttaaaatcctttttagtgcggttttataattctttaagaatt

SEQ ID NO: 53649 - DNA, 2201 bp, Oryza sativa
ttaggtggttaatgcaggcttaaagggaaggctgttattttgcaaacagttttgttttcaagttttcaacaatctaagtgtgtgctttccacaaccagagcgagacaagtctcagcttggtcgggaggtgagaagaacaaatttatttatcaagatttgcacaactcccagagttggcttcaaatctggttttttttcccaaaccaaaccaattttccaaacttcccgataatagtggtccccaaacgaccaatcacttccagggacacccggtcccgctgtcccccggacagctaaatgcttcccaagcattaggtttcccaaaccttaacaccttttcataaaacagggtaaaacaaaaactacgctaaggaatcacctcacatccgcccgtgaccgtgggcacggctgttcgaacagtttgttaacctctgcagagggggtacactttacccacacgacattactaacccgaatcacccagcccgtgtagaatggccacgtctggtgacctaagggctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccccgattagcaatttactcagccaggggcgtcccattccacccgtgtggtcgcactattgtatgctcggatgtaattccaaaggaatcggtccttagatgcgaccgcacaagtattccgcccaggaatggccttgtgtcgcgagttttatttttaaaactcattttctttcacaaggcaccgacccaggcgtcgggttttccaaagcttttgcaaaccaagttttacccaagaagttactcagattttaagtttgaaggcgaccgttgatactcgcacagagtgcacgaatatcgaggcgcaactagatggttacaagggaacatgatataacaattaacaatggaaggatcagatgcaacaagttgggtaggcccaccggtctgcctttcagacggggcaaacaaattaagtgtaatcctatcaatgcataatattttgcaagcaatataattaagttcaaatataggctcagtatgttcaagggtggcttgccttgctcagggtcttcacgaagcttcacgaatcttcaagatatccacgatcgacgaaaatccggtaaccgcaactatgctcaaacaaacaaaaacctaaacaagagaccaagaaaaagaccctatttagactaaataatagtgccattaaatagatctcaattttatggaaatactggaagtggaacggggtcaatcggacgattggatcgagagatacgaattttggaagtttaattagaatttctggcgaaggaagatatttgtggaacaaggggggattgattcatgaaatttatagaaataatattctcaagaatattattgaccgtctctgacgtgcgggaccaaaggaaatgatttataaggaaaatgattcatgaaattttggaatagagaattgttttataggatcaagggaaaaaagatttattaacccacgaaataagataaaatgatttactgaatttatagaagagagaattatttgtggaatattggaaagacattctcaagattatctttgactcattgacgagtggggccaataagaaggtgagagagagagagaggagcaattggagggagcaattgcggacttttagctcttcggtgtgtgagcaccggactcggaagagggagtaaaggtaaacttcctttgttttgttaggccgaggaggaaggctggccaatgggccaagcccacgagccaggggagagagggggagggggacgactgaccggctgactgggcaggggcgggcccggtcaatgccacgtgggcagccacgtcggatggggagagaaaaaggggggcgggaatggcatcggacggctcacggcgcgcggcggaatccggcgaacggcggcgagccgaagcgagcgacgaacaccggtggctagaggaggtcaaggcgaaccgattccacggctcggattggggagacgacgcgtgacgacggccggcggcggcggcgaagctcgccgggatgccgacgtggatgcgcgatgggaagggatg

SEQ ID NO: 53650 - DNA, 1353 bp, Oryza sativa
cctgcagcccgttgaggatgggaaggccgatggcggcgcatggacgagcagcggcgcacggcgacgaacgcgacgccgaggcggcatcgcgtcacggcgggcgtgccggggaagggaacggaggcgtgcggtggcgcccttggtcgcggcggtggcattcttggccgcggcgaccaagaaggcggcgacgctccggggttggccgcgcgacggcgaccgaggttgagggaggaggcggcagaggacggaccgtgcgacggcgagatgtcgccggacatagagctcgacgcgacggcgaggagttcccatggcggcagggctccgccgcttggggggggaacgaagcaagggagggaggaagcacggggggtgggttttatagagacggagtgggagcggcaaggtcggttcgaggtggccgcggttttctcggcgctcggctggtgttcatgggcgccgcgagaacgagctacggcgaggatgcaaagggtggtggaggcggtggatcgtgtggtggaaatcgaaccgcgagcacgggaggattggcgcggggcgagcgggtgcggtcaaggtgggggcggcgaggcgctgcagcggcgtcagcggctctgccttttgaacaagaagccaaggagtggaggcagggagctcgctacccgggaggggaaaaagcgaaaggaggaggaggaaagggagctttgctccttccggtttgggaggaaagggatgagagcgagccgcgcctcacggttttggatgcatgcggcatggggcgccgggcccgggaggatgacgccggcgacgactgcaaaaggacggggacggtttgaaggcaagcgcggacacggtggtcgtcggggcaggcgacgaccgagggtggcgatggcggcacccaggcggtcggccactcgcacgggtgtgcgggaatcgaaggaggcagccggaattttgggcggcgtcggcgggaagcgacgccgagagagagagagagagagagggggggcgctctctgagggagtcacgtgcggcgcacgtgcgatggagaggctggcgaaagaagaggatgggccgaggatggtttcggcccgagcgagttggagggaggcaaaatagacttttactggaaggtttgatttggagagaagtttgatgtggagattgaatttgaatttaatttgtgtatttgtacacgagggttcaaggtggatccaagggaggggtcaaggaagggcttcaaaagcgggaattttggtattcttgggatggatttatatttggcggcacgaaggattatttcagaggatttcaaaaagggaagatcattattcaaaaatggaacaagggagatagggg

SEQ ID NO: 53651 - DNA, 1426 bp, Oryza sativa
gacgtagaatcagaaccattggaatactgagattctccctgatagtactgcactggcgggtctatctcttgacgcaaaccttctcttgcttgatcctctaaggacattaccttgtgcttcttgtagtcctgcatttctttttctgcatcttctagtaacaaggctttattgaccatgtgctgaaacgttggaaagtcgtgagctaaaggtttcactcgcaatttcgcttccgttccttttagaaaccttttgatcttcttcttatcaatgtccacatcttccggggcatatcgagccaatccgttgaagcgactcaaatactcgttgatgcaagaggatccttgcttgatatttgcaaattcttccttcttcaaatcaattatgctttcagggatgtgtgctaagcgaaaggcttctgcaaactctgtccagatgatggtactagcatctgtatgggtagcacagtagttatcccaccaatttgtggtatgtcttcttaactgatgtacggcataaaagggttttcttctacggagtgcactgcaccaaatttaatttcctttccacatctttgatccagtcattggcttcaatggtctcagttgtttgggagaaccccggtgggcgagatcttaagaattcgttcagtcttgaccgacaattatcttgaaccatatggggttgatgctcttgcgtgtgttgtcgttgcataacaactatattctgaatcattccttgtaatatctgggtttgcatggccatgagtgggcaaaagtccactgttggggggctgatttctgtactgcggcatcattagttgatccagaaacaactgcatgatcacttctcaatctgttgctcatctgctaggctaattgactgatcgggaatttctgactgagctgacccttctttagaaccagggcggttaggggcacggatctgacggatagaacaatgtgccattggcttcagagtgactgagatctgactgaaccagaaatgggataagaaaagaaggaaaacaaaaacactacatcaaaacggttttcgaaatcacagaagacataggtggtgtattccagtcggtatcccaactggtctaacacctgaacacggactaccaaacaaaactcacgcacgcactagttcaccacaactcctaccgagcgggtgacggtactagggtctgcctaccaacgagggcttaactaagactcctagaggcttgagctcacctttcttcaactgggcgtgaagacaggtttactctaggataaaggtcaaaacactcgactagcttctacttttggacacgaaaagatttttcgcaaaactagagctaaaggggacaacgacaccttagctttcacaaatagtttttttttttggtactcaaataatgccatcctattaaggggtttcg

SEQ ID NO: 53652 - DNA, 1220 bp, Oryza sativa
aaatatgcagtacaagagggataacttgaacgtaaagcagagacaaatcgatacagagcaaagacatgggaacagagcaacaggacattagtgcagtacacattgacgatgcagggatgcacgatgcaatacctgaggacagcgcccgttgtacagcccaatcgcgagtgaagcggttggcgatgcagtagctcggcggcgcaaccagctcggcctcgcactccacaaccttgcgggagcgcacgtcagatcgagacctccgtccccgccacccacgtcgccgtccccccgtccacaccgcctgcagctctccgctagcgctctctgcccgcaacccacgccatccccgccgcccgtcgccgtccccgccatctacgccagcaacccacgccatccccgccgtctgtcgccgtccccgccgcctacgccgccaacccaagccatccctgccgcctgcgccgccgtcccccctgcccaaagctctccgctcgcacctccggcccgcgccatccgccctcctcgtccgcccttcccctcagacctcatcctttccattttcccctcttctgtcactctctccttgctatccatacgtatactcgtatagcggaatagaaaagaagagcaaaaaaaattagctagagttacagagtattagttgcctactactaattagtattttagtcaaagcaaagtgatgcaaaatttgtttggttaagtgcagttttttttcacaaatgcataattatttcatctacatagattaacaaaatttaacaatcatctgtgtttttcctgtacttgcgagacgaaacttttaaaactaattgcgccatgatctaacaatgccgtgctacagtaaccatttgctaatgacggattatttacgcttaataaatttgtctcacagtttatatgcggattatgtaatttgttttgttaataatctatgtgttaataattcagataaccacttttctctatcctctattttacacatgcttctaaaaaatcctacgctaccacatgatttaaaatcttagacctattattttggaccattacattatatcttttcaaaataaaaaacatatataaaatataagaaaaaaaatatgaccattgtaactttaatcggtaaaacaattatttacatccgatagaccaatccttaaaaatacaaatccattccacctccctcccgtacataatcactcatc

SEQ ID NO: 53653 - DNA, 1390 bp, Oryza sativa
atgtggcagtggaggcggggaaggagtctgtttggtggcggcgggcgacggcgcagctgttttgcggaggcggaggctggcgtcggtggcagcggtgacgtcggctgtagccgtgaaggtggtggcaacgtcggaggatgcgggtcgctggcaacagcaagtggaggcggggaaggagtcgggtgcgaggtgaggatggcgtcggcgaggtggctgggtgttcggcaacagcggctgcggtggtggtgaccgtgtctgcggccaccgaaggcatggcggcctcggacggctagccgagggcgtgggagacgactacatctagctggtgcagcatcgtttgggtggaggggtcggagaccagcttggcgcagagaagcgcagccgatggcagcggaggctggctcggcgcgagaggcgcgggcggcggagatggaggccggcttggcacggaaggcatggccgatggagggaggctggattggcgcgagaggcgcttccggtggaggaggccggcttgacgcagagtggcgtggccggcggtggaggaggcgacctaggtgtgaggaggagctgtcggtgggtgtggcgcggtcttcggcgcacgaaggctggccggcaggggacgccggtgcagaggtcccacatgtcggcaaagcttgtgtggtggtggagcatcagtgcgtcagccgtggattcacaggtggtgaacggtgggtgaaaacccagtccagccttggtcggactgacaacgatgtcctgagggagttgttgcgctgtctcacccctcaaggatgattgccgagcgaaagcccagtcttggctcttttaagtcttgacagacgacggcagcagtttttccgtcgcttctcttcttgaagacgttgttttggcatcctataggggcaatctcgcatgtgtccctttgttggtctagtggcggtcggtcacgcttagcagcggccggtccggtgttagccttctcctgggcttgttgttggcgatgtcgccgtgtgggtggtggtatatttggttgtaatcttgtaattttttcctgctctatcaatagaacttcgcaccgtctcgtgcgagtcgttcaaaaaaaaaaaactttctagcaaaggaaagagatctaagatagtagagagtccagcattggaagagtggagctagtatggagaggacaggctacctgcagtgatgaacggcgtcgatcaccaccggtcgccagacaaagtggggagcgagaggataaattagctagaggcatttcggtatgggcatatgtgaggaaaattgggttaccattttaatttggaagaaatttcgaaatgtcattctggcatcggcccctaagttggaaatagcattccacgaaatcaaattgaagggc

SEQ ID NO: 53654 - DNA, 2997 bp, Oryza sativa
cagcaccggcgcctggacgcacggcaacttcgtggctcgccgccgccggcggcaatggcgccgctgcctcgccttcgtcctccccgccacgcggacgctcttcttcttcgagcacatgtccggcgacgactacctcggcgtcatcacgtgcatcccgatgccggacgagccggtcggcggcttcctcgccagaatccctgtcatccgccggtgggcgacccctcgccggagcggcaggtgggactgcgtctgcaagacgtgccgccgcggcctccgcgtgacgcaccactggctgaagaggaaggtgatcggcgagttcccgtgcgggcacatggtggcggagagcgtctgcaagatgtgctaccactactccgacgtcgtccatccgagcccgggcaagttcgcgcgcgggtacctggagcacgaagacgaatttggccactacggccgtaatggcttgagggattatccatgttaactaaccccagcgtgtttctcttcgcttgcaatgctcacattagaagatctacactaataaatacgtatgtaacagatatttttgtcacttacaggtaggagtagaaatttgacatgttgcagcaaacaattcgtcatgcatgttagagctgcacaatttcagattttgctatatatatttcagaatttgatgcttgtgttggataatttcgtaggtgaaggcgtccagcacgctgtcatgatgcgataatgcttctctttggacaatttcgtatgagtgaaggcgtccagcatgctgtcatgatggtattatgaactgcactgtaatattattagtccaaaattctagaccccaggaaattggatattaatttcctattaccaaagtgctaaatgctgaatgtcctgcagagaaagctaataatcaggaaaaatccgccgtccgcccattacttgccttgctcaactgggcttgagcacatcctgatcaattctacgggcttctagaaaaactgtgaagcgaggcttaaaatctgaattttgattctaggactagaaggtgtttctttcagaacgatgaattcttgttagtgacctgtcctcatatcaacatctgaagccttgtgaaatcgaggagtagcatctagcagatagtgccgttctagaatcttgatggttacaatccctgtctggatctcgcgtgcggttttctcaaaagtcaaaaacacaagctgttactctctggaagcgaatcaatcatatagtcttcgggtacacttggaccatacagtagcttgcatctctgtccacaacctttttactcaaaactcaaaaaagtcgttgaagtttcagtacagaaggaactgacagagtagtgccgaactcttaacgaaaaaccaaattcgctacatctgcagcgcaatttttcctttgcggacagtgtgctaagcggtgaattctgcaacacaacgagtttcagagtctacaatgtcctagcctactacaccaaaactcagactaatcatggacttactgccagaatagttagtactaatgtttagcaatataaaacgcaacaatgtgctggtaggtagtaggagttgtacagacagtgggcatcagagtgacatcctttatgtgtttttctgaagctagtctacgcacaagtccacagtcagcaaaggcgagccgggctctttgaaattttcttcagtttctgacgttgcacatgagacttcctgctcctttccttcgtggccactctcactcatcgctagccactggatcaccgaacgtgcggctgagatcgaagctgggatctctctgtgggagacgggtcaatgggctgcacagctgcatcatccagaagcatttcctgtcgctgccagcattgtcatcgagcacctatacggtgtgcattttcaggttaaaaaaaaaaacggagtatccaaagctatactcggtattctagaagtgaagaaaccggataaacttttcactgtggtatttatccatatataccgactatatactgtatgcacgtgtggtattgagtgcagtatcttatgctccctttcacttaccgtttcaggcctacgactagtcaacgaatgaccacaaagagtttaaagacaacccagaggcgccagagccacatcattatctaagacttttctgtttgactcaactttagaccagggatttgtgcacgagtacatctagatgtgacactgacatcgtgggcccaactcaccctgaacccgtgacctcgtgctgacgactcacattcccggcctcaggtggatgatccccctgtaaaatcagtggaaacaaaaagcttatcatcatttgctaattgcttccactttaaatttacttgccgtgcttgaccggttataatctcgactctcgtaatagttttctttttctttgaagactaataaatagtgtgatactagttctaatcggtttgaagatatactaaaagaaatggtttcaacagcgacaatacggccagtggagcaaaattagatgtttaaattattggtggccatgggtgatagcaataagatcgcgcgatctgcaacatcttccactcctctttgtcgcaagtgatcgacacctctgtgcttccgaatagtttgaccattcatccgacggcagagtaatgtgccggcacatgctacagtccaagccaacggagcatattgtcgtaccttgatcatgaaaagatcgcaaaactcccataaagaaaccatgtcacgagctgtgcaattcgtacacgttgctcagcttagtccttaacttaacttagtagtagctgcataaacaaaccatctagaacatatccctttcaaacaacgccaccatctgaccagcaaaaaccaaacaaaagatgagctaaaccaccaactggtgaactagtatcaaattataaaggaaagcatggctgaaacttccaagcaagcagcacccaaaaactaatcctaaattcctaacaaattcaatcatttaaccaaa

SEQ ID NO: 53655 - DNA, 1271 bp, Oryza sativa
  unsure (1)..(1271): unsure at all n locations
gccgggatcgttcaagaacttgacgagcctgaagacggtctggctggcgcagtgcaacctcaccggcgatttccccagctacgtcacagagattgggaaaaaatgggggggaaaaggaaaattggggggnnaaagtatttctcgacccctgtcccagaattcattcaccggaagcatacctcctgggatttggaacattccaaagctgcagtacttgttcctgtacaccaaccagctcaccggcgacgtcgtcgtcaatggcaagattggagcagcgagcttaatttatctcgacatatctgagaaccagctgactggaacgatcccagagagctttggaagtttgatgaacctaactaacttagccttgatgacgaacaacttctccggcgagataccggcgagccttgctcagcttccatcgctggtgataatgaagctgttcgagaacaatctcaccggtcagattccggcggagctcgggaagcactcgccatttctgagagacatcgaggtcgacaacaacgacctcaccgggccaataccggagggggtctgcgacaaccgccggttgtggatcatctccgccgccggcaaccggttgaacggctcaattccggcgagtcttgccacttgcccggcgctgctgagtctccagctccaggacaacgagctttccggcgaggtgccggcggcgctgtggacggagacgaggctgatcaccgtgctcctgcagaacaatggacacctcaccggaagcctgccggagaagctgtattggaatctgacgaggctttacatccacaacaaccgtttcagtggccggcttccggcgacggccaccaagctccagaagttcaacgccgagaacaacttgttctccggcgagatacctgacgggttcgccgccgggatgccattgctgcaggagctggacctgtcaaggaatcagctctccggggccatcccggtgagcatcgcgtcgctcagtggcttgtcgcagatgaacttcagcaggaaccagttcaccggcgatattccggcgggattgggctccatgccggtgctcaccctgctcgacctttcgtcgaacaagctctccggcggtattccgacgtcgctgggatcgctgaagattaaccagcttaacctgtcgtcaaatcagctcaccggcgagatcccggccgcgctcgccatctccgcctacgaccagagcttcctcggcaaccccggtctctgcgtatcggcggcgccggcgggtaacttcgcgg

SEQ ID NO: 53656 - DNA, 2134 bp, Oryza sativa
caaggtcgccgacttcgggctcgcccggatgctggtccaggccgggacgccggacaccatgaccgccgtcgccggatcgttcggctacatggctcccggtaattcccctcaaccaacctcgctgctcgtctcacgattctcccttgatttcttctcttagccgagcgacttaccttgtgctgaccacgatcgtctcgtgcagagtgcgcgtacacgaggaaggtgaacgagaaggtcgacgtgtacagcttcggggtggtgctcctcgagctgatcaccggcagggaagcccacgacggcggcgagcacggttgcctggcggagtgggcgtggcggcacctgcaatcgggcaggagcatcgccgacgcggtggacaggtgcatcaccgactccgggtacggcgacgacgccgaggtcgtgttcaagctcggcatcatctgcaccggcgcgcagccggcgacgaggccgacaatgagggacgttctgcagattctggtgaggtgcgagcaggcgctccagaacaccgtggacgggaaggtggcggagtacgacggcgacggcgcgccgtttctgccgatcaggggtggcagccgccggaagcagctttcggacaccaaaggcatcgacgacggcaacggcagcttggacagcatagtatgagaacaatggtcaataagaagtataacctgatccaatggttaccatctaggagagatggcacgctagttaggagagcaggtagataccagacaaatacattcgccatccttcagttatttgcatgtaatgagtattgtaactttgtaaatgcatctataaaattttgggacagtgagagtgcagtcacatacatatatgagatcaaacaagagcaattagattatgtccccttctttattacgaagagaaaatacagagcaaaaaaatcttggttctcaacatcaattaagggggaaaagaatctgacagaacaggaatggaaattgcctgtgcctccatttccctgttagtctgctactgccatccaacgttttatgccattagaaaacctccaaactcattggcgctatactagctatatcccgctgcagaggcacttatgtttgccctcagaatagccaaaaaaagatggtaagatttcaaggggggagccaggagtattatgtggattttgaagggggaaatgagaacctacaaacggagtttgattcatcattcatcaagatcatccttaaagctagtcgatctcggcatactgggagtgcgaggctgcgagaagagcagctccaatgccagaaccatcgttggccagcttggtaaccaccgaagacgagacatcatccccaagaaggtctgttagagttgattctaagcaactgctgaacttcttgtaatgttcatagagcccaccatccaaggcaatgacagtcctaggcatcttactgccgtcttttggcatcttgtcccgacctagcttctttaggaccccatatatgccagcagcagccaagcgtgcagcacgctctgcaactatgtcacaaatgtgactggtaatgtatcttacttccagggaagtatctgggacctgaataaaagatcaaatcataaataagcaaccagtactcattgaacagtgttggatgttgcgtatccactttgggtcaagaaatttcataccccgacgatatcctttagcttagctccaacagttttaaggtcatgtgacgagtcatgatgcatggctgacatatccggtgtcctgtgatacaacaattgagatacttataaaaaattctaccagagttgcataagattgaggggttagaagcataaagaaaaactggtgagcaaaaaccaaaccaccctaattatccaagctagataacttctagttgcacacaattatgagaatcaaccagaaccagaagaaagtagtaatggataaaacaacaaagtgtatgtttgtcaccttccatggatttgctaactgatttagcatgataatttcaagatatacaaacaacttccccttccataatctatctgggtatattatcaacagtgcgaatattataatggaaacgatgccaacgtctttatatcatgtgcactcttatccagggctgcaggaatt

SEQ ID NO: 53657 - DNA, 1393 bp, Oryza sativa
taatccctgcctctccatggccttgcccaactcagatacaacatcttcgccaacctaattcaggagataatatagcaaaatcaaattattcttattggatgcttgacagttcacacagatatgatcaaccaggcaaacataatactgagtactattaaagatcctcaaattaaatatgcttcctgatcaaggtcgatatttcttttcactaacctagttaagttgattacaatgtacacaaagggagattgtagcaaatagctaattgaaatactccattgccatattcaatcaagctttatcaaggaaccttgtgacataattcatgtgtttaaagaaggatcaggattgtgttctagtcagggtatgtccaaaagttatttttgacttttaccgcgtcattgatggagaaaccctttgtccacttgatgagcgttcctgacgatattgatgtctggctcactgggaaggaaaaggtgaagcccagctctctctgtctcccttctgggaggtggaaatcatcaccttcagtatcaacaaattttgacaatgcagaagcaataaaatcaaacagttcctgcattaatagtcagaaaatacataagacaagcatggaatgtacagctccaagaaatttaaaatcaagcagcaaatgcttaccatggaagttccaaccatcagatgtggtggaattgagacttcctcgtactgttgttggacgacacgtttctccttgccaccgagttggactcgcaggacgcggaagttggttcctccaagatccaatgcataaaacaacccctgttcatttctgcaaagggaaatcattatgatcaaagaatgaaattactacttttggaagaaggcagcaggaaacattgtatgcttatgggtgagtgagttctaacagactggtagaaggatccgatagaataagaatgaatcattatatttaagaaacttccttcaggatgtgcctgccacatttagcttaacgatgtggaggttacagagaaacttattaccagaccaactataccatgagataagctcgactgatggatctaattggtcagattgctaacaaggaaaccacaatgcaaagaaactctctgccatacattagttaattacctgtcactgaagccttaacaaatcaaaccaacaagaaattaattaatcacatatcataatcagaaatcctaaagagccaaagtaggaacaaatggacgatcaaattaattaatcacatatcataatcagaaatcctaaagagccaaattaggaacaaatggacgatctactatagatcacaaaaccgaagatcatctgagaacgataggatatgttgacgggagacctatctttcctagcttagataggccaatttatc

SEQ ID NO: 53658 - DNA, 857 bp, Oryza sativa
ctgcagccccgaatgccatttttcttgttgcaacaacaatctgactaagacagaagctgtagccttaaaagaaaattttcaacaacatgtctacaccttttgagcggcagaaattgtgtgctttgttggccaagagtgacagccatggcggccaaccgtgaagctacgcagaaataggagcaaggaaacagaggaagaagaaaggaactggggggacgattttggatcgtcggatgataacgaacggtggatagagcagaactgcacgcctgtgactttgcaacccaaagtcagaggatccgcttccccagatgagccacgcccatgcgcacgcggcggagacgcaacggccaacggctcgtgcaacggcggatgctcgcggttttggggcggtgaaactcagggaaacccgctgagccgtagtacaaattcgacacgcaccggtgtcgtacaaatccgagagacacgatggtttccgcgcaagatgcacttccgcacgggcgcgctgccgaggatctcaattctaaaccgtatccagatgaattttactctgcttgttaccctatctatgtctgactaggttggatatacttatccatataaaggcgaaatgctatacgtatgacttgagcatctgacttctggacgactgcgtagtacacaacgtcagtaacaaatagaatatcttacaaagcctcacaccgtcacgcatcgcattgttcttataaaaggtaagtggaacccgttcaatattagatttgaagtcaatatccccaagccaataattcatcataactaaagtttaagttgcttttagaaaatttaggagtaactagcgacattattgactttcacat

SEQ ID NO: 53659 - DNA, 1128 bp, Oryza sativa
ctcctgacttgggaagccaagcacacgtcgtcttgatgatggggcctgtcaaatcttgccgcctgacacggggggtgcccctgtcagtcaccatttaatgggtgaagacttctgagctcctattacaccgggaaacgggagccttgctttgaccagagcgggaggaccgactccggttgggataagaggatgagaacctctcaccatcattatttgatgggatatgtcgggctgcacgtcgcctgacacacgcgatggtgcgcctgacatcttgggtcccatcagtcattcgaccggtcacagaccggttgagtgcactgcacaccgcattaaatgcggtgtggcgcgaccgctcaggacgccataaatgcgggtaggtgggcacctggaggcggacacctaacccactgtacgtggtgacctagagagggggtcgggggagcccgaaccctagtcacgggagggggcggtcgccgcccgaactcgggcccgatcccccctctggggggagccacgtggcacctggggcggccttctcccctagtctcggccagggagtggccgccgccctacctcgggcccgacccccctcgggggaggaccacgtggcattggagggcagcctcctccatccagtctctgggaaggagtgcccgccaccctacctcgggcctgactcccctcgggggagggccacgtggcatcgggggggcagcctcctccgactagtctttggggaaggagtggccacgtggaatcggggggcagcctcctccgactagtctttgaggaaggagtggccgccaccccaccttgggcctgactcccctcgggggagggccacgtggtatcggggggcggcctcctccctctaaacctgatacccccgggcccatatcatcgacaggtaacatgcaacaattagctaaatgtatatttttgttgctatgatttgtaggacaaatcacaatgagttgaaattagttgttagagttgggtcgtttttcagcttgctagatgaagggtcaaagacctatatggagggtaaaacatcgccaacccaacttgttgacatgcataactatggcttgctagaattagtaaatttcatagctgaacacttcatat

SEQ ID NO: 53660 - DNA, 1484 bp, Oryza sativa
tcatgatccatgtattgatgttggtgtggtgttcccagatgtgaatcaatgcaagtcagcagttacacatcattgtatcttgaatgatcatgcttttgacattatcaagaaagacaagaaaagatttagagccaaatgcaagagtgcggatcaaggttgcaagtggctgtttttgcatctactagtcccaagtacattggatgtaaggtaagttcagatttgtatttttttagttcttttctgcattaagtaatttcagccttgtccttacttaacatgaattttgtctatgcactctatggctgcaggttaagataagtggaccaaagcacacttgtggttcttttaataattgcggtgaaacaatggcttcaaataaatgggtagctgaccgagtagttgagttgctgcgggatgacccctcattaggacctaagaaactgaaggaagagctgaagaagaaatactcagtgaatataccttatttaagggttttcggaggcaaggagagagcacttgacatgataaatgtgaggtgggatgacagctataacttgttgcctacttatcaagatgagcttctgagatcagtgccaggcagtgtagttaagttggacactgaagagaataatggtgatgtgtgctttaggaggttcttagtagctctcaaactatgcattgatgggttcttgcaaggatgcaggccatacattgccatggactccactcacttgacaggaaggtctagagggcagttggcatccgctgttgcaatagatggtaataacaggctatttcctgtcgcttacggagtgattgagacagagtctaaggaaagttggacttggtttgtccaaaatttgaaggaagctattggtacccctacaggttcgtattttttcttacatctttcatctttcatccttcatgttgcatttgcatattattccagttgctaactacaattttgtaccattgtaggtttggttattagtacagatgcaggcaaagaatagagggggctgtagatgatgtatatccaggagtggaacatagggaatgtatgagacacttgtggaagaacatgaagaagaagtaccatggtcctctgtttgcccaaaatatgtgggcagctgctaagagcttcacaaatgtgaagttcacctaccacatggacaagataaaggagaggtgccctgaagccctaacctggttagatgacaatcatccatacatttggagcagaagcaagttttatgaggagtgcaaggtagattacatcaataacaacctctctgaatgtttcaatagttgggtctcaaaaatcaaggatcgtcagattgttgacttgcatgacaccataagaaagatgatcattagcaagtttgtgtcaagagccaagcttgcttgtaaaatggatgaaaggataatcccatctattactaacactctgaatgcaaaaagcaagaccctcaaaaaccatg

SEQ ID NO: 53661 - DNA, 777 bp, Oryza sativa
ggcaaaaccccataccaacattcttattgccaactacaaaaggattgtagtctttgcagcgatcactagacaaattggaccattcctggtacagctgatggtctctgttctagtagatcatgcggtaacctgtacacgggttgaacagatagtctttcatctcaatgctcaccagattcaacccatggcaaggcttggagcaaaccacctttttgtccagaaacattgtgcctagatttgcctcttggagccatttactcaagggaataaagttgaaaactgatttttcagagcccttacccacaagcatgatctttggcctcctgtccatgttcttatgctcaaagtatgcatgaacaaaaccttcattctttatcaatccacgccattgcttacaaacaagttccaatttcaagattgattcagctggtaatcggagtaggatctccttagtagccttagacaagggagtagagaaccctatctctttcctcgtcctatgcactggggtaaaactctttgtaaatgaactgaatctaatatcagatttctcgttttgataggcactgcaggtcaccatgattgagacaatggtttcaagagttctagaaactggatcataggcacacaccttgtgcttagatgtagcgatgattatcttcttgcttgatctgtagctaccaaaggaaccaataactttcacaattcgtggctcaagtaaatctcttggcaaattccctgtcaaaccaattcggtaatcaagcgaccaatcaccag

SEQ ID NO: 53662 - DNA, 2347 bp, Oryza sativa
  unsure (1)..(2347): unsure at all n locations
atgatttgaactatggcagtctctcatagcaaagcgtagcgacatggtagtgatgtctactgatggtcctcttggtgcgtatgtcaatcctcacggttttgtccatgaaacaatcacagttagcagggcaactgggcttgctcttgatggcaatccttcaacggttcacagctggtttccagggtaaatctacagtttctccttgttctttgtaatcttcatgtccatcatacaccctttaactgtaaaaaactaagttcatgcatgattttcttcttgtaaccaactttgtttctgctgctatgcagatactcgtggacgattgcatcatgtacggactgtgagtccaacataggctggttgttcaaagcaaccaagaagaatctgcgaccgagatccttctgggggatccgtagctcccaaattgcagatgatgcacaagaactagatcaggacgaatgatgctccgtgtacagtagtaaactttgtgtgcccctccctttttcttatgaagttatggaaaacactttattctctggtccataggcctagttctccgtacctgagtagtggtcgttgtgacgatcgctatagaataaccacttcctcctgtgtgtattacacaaccattgccttatgctaaagttccgtcacagaattttctgaaatgtagtgttactagaaatccatagtacaagatgaatgatgatatgatcagatgtttcaagcaatggtttgacatgtcttatgagcacatagaagttgggcttgataccttcacttgaggcaaatactcgtgctgtagtggtaattggtaaactggtactggtagtgagctagcactggcagtgccatgtttttgctatctgtactgaaattggggccaattgcacctgacgagcagcaactcaatatgggcatatggcatcctttttttccctgcgtattgtccttttgtttcagccacagtagcaattggccggtattccattgccacctttgatgagagggagggagagagagacctcacgggtggcagcaaaggcaaaggagcagcaagaagccgacagagaaagtaaggccatggtagaatgacaggtgaggaatcgatcagacgggaggaaaacaacaccgaaaaggaatgcacttctctgcttttgtatatgcatgcacctctacctacccattcgcgatgcaccaatgaaatacgttgccaaataccttaaaatacctagtctattgncaggtgatagtaatattgacactagtagttctctaatctctagttgctagtcttgtttatgtctattttttcttgtagcatagtagcacatgatcgtagtaatgctgtatgattgatgattggatggcatggaactatgaacggatcaaacttatctcgataatatggtaataacaaggagatgtagacatgtactccagcattgtagtcagacagccgaatcacgaagctagtgtggaaccatgacagaagaaggcactactcagaataaatccagtcacgggtttaaaaaaaaaacagagagagaggagaatcatcatcacaaagctaatgcaacaacagcacaagcgtacttccgcatgagaccaagcaaggaaaaaagaaattccaaactgtccccaagaaaattcctgccccaggagagcacagcgccggcctgtacaggtcatcgttcccaataagacagggggaagctgagaggcaaagagcaccaccaacaacgcgtgcactgaattgcattgcacatgggacatggcaaacaccggcgcgtcgccacccgcgcatgcacgcacgggcgcgggcgcggccacgggcacatcctctcctgcgactcgtgagccgtgtcattccatcgcggcttcctgctcgatccgctccctgccatgcccgtgaccgtgatctccataaattcccccaccctgtgcgcgatgcgtctatcccccacgataattagtaggcctgccacctcttgccgcgagcaagacgaccacaccaccaaccaccatccatggcggtgtccgtgtcgtggtcgtgggcgccgcggttcttggcctgcgtcgcggtggcggtgttgcttgttacgtcgggtttgggcggtgcggccgccggcggcggcgggcgacgccatgggcacacgaaggggttgcggccggggaaggcggcggcgaagccgtactatccggtgaacgcgacggcggtgaggcgatcgagcggcagttcacgcggtgggtgcggtccatggtcgggcgacgccacagcacgttccagcgcgcgctctaccgcgggctgctgcccacgcgcaccctcgtcgtcgacaagaacccc

SEQ ID NO: 53663 - DNA, 2954 bp, Oryza sativa
cgtcactcacgtggctacttaatttggtctctgtaattttcttccacacccccaccgtatccagagcgttcgtccgaatgcctacaccgatctccccgtgcaccgtgcagtgagaaggtgaccatctcgccgctccgcgcgttcgtgaccatcgagggcgccggcgcggacaagacggtggtgcagtggggcgacacggccgacacggtcggcccgctcgggcgccccttcggcaccttcgcctccgccacgttcgccgtcaacgcgcagttcttcgtcgccaagaacatcaccttcaaggtgagcaccactactacactacaaatgcggcatcatttgtgccgtggcgtggctcattcgtttcgtctgtcgcgtgggcagaacacggcgccggtgccgaggccgggggcgctggggaagcagggtgtggcgctgcggatatcggcggacaacgcggcgttcttggggtgcaacttcctcggcgcgcaggacacgctgtacgaccacctcggccgccattactacagagactgctacatcgagggctccgtcgacttcatattcggcaacgccctctctctctacgaggtacacacattgcttctttctcttggttgcatacacatttcctccatgaacattatagcagggaattgcatgcaacccgggtgattaggttgaaggtttgttgctaaccaagatagataatttaattagcgcctgaaatcgagtcaaacaggaaatctatgctcaatcctgtgtgtcagtgtccagtgctacagcccaaatgcacaacagatacaccgtgtcagtaaacactggcccgcagctttctgacagggcactggcctactgtggcacctactacaatgcaccacactggagtcacacagaagaaagaattctactatcgaccactgttaaaactcacagggttacagtagaggcaaaccactattatcggccacattagccccccgatcttgtgactggccctactacagctacacgaaccagatggtgccaatgcgttgtgcatgcccgtgtggcacttcgtttaatgcgaaatccaacgcaaatggaatgttgatgagcccactagtaatagcatagtgagtaatcagcctttcggtttttaagaggagtgtggtaaaacctgcatcgcttgtcgttggcgccggcacggttgccggatggggttttctggagcccggcaggttctctggtccccctggccccaggcgccgtgaccgctacggcccgtgacgcccatagctggacgtctcgtgccgtgcgtaggccccaaaccgtagcgtatgtgtatagccaccagtctcctctgcaaatcctgctcactttggtcgtacactttaaaatctggtactagtccaacactactaccagtagtaaccgacttttttttttggtcagaaatcaaaaattgacctttgggacgatagggtcgtccaagctccaagggaaacatattatctgctgtaccgtgctctaactttaagtgattgatatgtgtactatcccacatctaatatgtccacatgtcaatgacccattcacccatatcaaaggatagttctgtagagaatactcatccgtcgtgcaagtgcgcaacgcacctagcatggttcgaatgctagactttgtaatagtattcaccgtatttcagacattcagtaatactccacacaccacactagtggttattctaacgtgtgttacagtgtgtgatcgtaaagaatactagggtttacgcaaatatttgatcagaaatcctttgccgtgtattactttggtcatgtatgtactcagtactcacgttggtgacacgattgcagggatgtcacgtgcacgcgatcgcgcggaactacggagccctgacggctcagaaccggatgagcatcctggaggacacgggtttctcgttcgtcaactgccgcgtgacgggctccggcgccctctacctcggccgcgcctggggcaccttctcccgcgtcgtcttcgcctacacctacatggacaacatcatcatcccccgcggctggtacaactggggcgatcccacccgcgagatgtaagtagctaccactagtacagaatcgaacatcgtgaacgatcatatcactactattataatgatatgtgggtctcatcctatcataccccacccatcaatatttgtgatgatagcgtcataatggtagaggatgtgaaccccattcacccctcacatccatctcgttcttgtgttttttcgctaacgatgctggtgttttgtgtgtggttggtggcggtggcaggacggtgttctacgggcagtacaagtgcacggggccgggttcgaactacgccgggagggtggcgtggtcgagggagctcacggaccaggaggccaagccgttcatctccctcagcttcatcgacgggttggagtgggtcaagttgtagcaccacgtaggagagaaacacagctcactcgactattagttaacttgtgaagagaaaagaatagaacagaagaagtggcagataaacactctgatttgattcgattgcagatttcaactttgcagttgcattgtgagacagtcctatactgtgtccggccttcgcctcggttttgttttggactgcaaacagtataacatcaacttaggcccactggcccaggcagtagagaggtagcaatcgatgcgatctccctgctcagcctagaagcccatagagaattgaagtggggaaataggcccagaaaaaggttagagtagtgtagcagaagtgagcccaacaatcacaggtgtgttgcttccatgttccaacacgtatagccttttcgaacattattccttttttttcaaacattattctagacagacattttaatggatttctgcaaacttttagtagtagtagtattatagacccagtgaccaatctct

SEQ ID NO: 53664 - DNA, 6348 bp, Oryza sativa
  unsure (1)..(6348): unsure at all n locations
gccctccgggaaaatccttttcctttttctttttcttttccctccctttttccctctttttttcttttcggatgggccgccggcccattcccctccttcctccccctcctccttgctgggccggccgcaggccgagggcccagtccggcagccaggccgcccgctgctcctctctcggggtcgccgacaggtggggcccacctgtcgggcccgtctccctcctcccgccgatcccggcgcgccgccgcgccgaaaccgccgccgcgcccacgcctccgtctctcccgggccacgtcagccacgcccgcgcgtgcgccgcgtctcccgcgctctttcccctctccctcccgttcgcgcccgcgcccgagatggccgggattcgaaaaccgaatcccgcctctctctcctcccccactccccacgtcggccggcgattcccgccgctcccggccacgtccggccccctctccccttatttaagcatcgccggcaccccctctctctttttccccatttccccgacccctcccgtgctccccatcgtacccgcgccgtgcaaccacccaccgacgcttcttcccgctactccggccgccgctagccgtcgctaggctcgccgccgtcttgcgccgtcgccgccgttcgattcgcgtggccgagatccaccccgtccacccctcctccgtcgaagttcatcgccggagccctcatcccctcgcgcacgggtgagcaccacctccaccgccgccttcggccatggtttccgatcgccgtggttcatctccctctctctaacccctcccaaccttttctctaggtcctcccggaacccgtcgccgtcatcctcccgtctctcgtcgttgccgttcgccgtcgctcctccctcgcgccggccgagcccctcggtgaggatcggtctccctctcttcctctctctccctttgccgcgccgcccgccgcgtagcgccgccgctagggtcgctcgcgccgccgcttcggccgccgccgccgtctttgcgccgtccgccgccgcctcccgtcgccggttgccgtcgctggcaaccgtgcgcgcgcgccgccgccctcgccataaccggccggccggcttgaagccgagccgagccaccagccgcgccccctcccgccttgtgccactgtcagtggggcccatgtgccggcgcccctccctctctctcttgagccgctgcccagtgggcccacctgccagccgccccctccctctccccttgtgccgctgacccgcgggtcccgcgtgtcggcgccacccctccttgtgctgacgtcagccctggggtgaattattgcgcaataaatacattaaggcttttctttaatagtaaaaacacagagaatcttctaaaaatcataactaattcatccgagctccgattaagtccattcaagtctcagtaaattcataaaaatgtgtagaatccattaaaaatggttttgtttcctgtttcagtagtcttatagcatgttttgcttgtgtgctttgtttgtcgcgtagatttcgcccgtttcgtcgattcgtggtttctcgaagacgttgctgtggtctcatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagtcatgcttagttcaactagtgcacaaaaggggaccacattaaagcatagacttgattattggtaaaagctttggattagtgccaccgcattggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcacccctagtttagcttaatgaactggctagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtaccgtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatattctttgcaattggatttgtttcgggaaaaatttggggttttgcctctttggtttgtgggaaaaatcttggtcgttcattcggatcggatccttaaaattagctcggtctagggttttagaaaaattttatttggagttatatttgacagtcagttggggatttatcgggtgatatgcattaggtcgtgtctatgttcgatggggcaattttatgcgcatcattttccatgcaactagtttatgcattaagctatggtttagtcagtcgcattagtgtctttatccgggttcatgaaaaatgttctatgcataaaaatcatcatgctcggcaagttacttgagtcattcgttgctttatttaatttggttttgagcatgtgttggttcctatccctctgtactctttagatgtcagacctattctccgatcgcaagcgccgctccaagcttcagagtcgccgcccttagctttatcgtcttcttagtctgtttgcgtgctagtttttggtgtttaggtttgttgcttgtgggttagtcggcggtcgatatcatgtgtgagtggtatgacagcctttattaggagttgtgtgcctctttttcagtgttttaatcaagattaagataatggcacttaatttcataagaaagattagtttccgagccatctgttttcttcctttctcttatttctacctatcccctccagatggtgaagacaaggaatgatccccgtgactccagcgacgccaggggcagcgaagagcagaccgatggagctcatgtcagtagtgcatctggcagcagaccatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctctagcaaggaaccatgtcagttacagagtacctgcacgagttcaaccgccttgcgcgctacgctcctgacgacgtgcgcaccgatgctgagaagcaggagaagtttttgtttgggctagacgatgaattgaccaaccagctaatctccggagtctatgaggactttgagaagcttgtggacaaggctatccgccaggaagagcaacgcaacanaaannaanaaaattttaaggnaancccnccgnaaaaaaaagaaagacagctcagatcagctttcctcaggggaacaatcagaagcctcgtttcatgacgggacagctaggtgggccttccaccctgatcgtctgtcagcaccatccctatcacccgagtaacttcgacaacgactacaacggtggcagtcacaacaacagtaagcagcacaaccacaactcgactccacccccactaatggcaccagctcagtcagatccgccagctgtgtcagctcagtcagaacaacccaagaagggggctgtaggaaagccaggacactgcttcaactgtggcaagcacggccactttgctggcaagtgtccgaagctgaatcgcactggacccaggctcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgtccctcggtgactatagagatcaagagatcaccgtttctatccaacctcatccttctcgaatctaaagacctagatgtcattctcggaatggattggttgaccagaaacaagggagtgattgactgcgcaagccgcaccatcaccctaaccaacgacaaaggggagaagatcaccttccgttccccagcgtcgcagaagtccgtagcgagtctgaagcaggctgctattgagggtcagacagaaacagtggagaaaagttctaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggtgatctttgtggagaagaaagacaagaccaagaggatgtgcgtggattatcgcgcccttaatgaggtcacaatcaagaacaaatatccgttgcccagaattgatgacctgtttgatcagctaaaaggagctaaggtgttttccaagatagacctgcgatcaggctatcatcagttgagaattcgggaagaggatattcccaagacagccttcatcactcggtatgggttgtttgagtgcacggttatgtcatttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtaacttctggttatcggaggtcaaatttctgggtcacgtcatttctgctcaaggcgtggcagtggatccatcaaatgtggaatcagttacaaagtggaccccaccaaagacagtttctcagatccggagttttcttggacttgcgggctattaccgtcagttcatcgaaaatttctctaagattgccaggcccatgacacagttgctaaagaaagatgaaaaattcaaatggtcagctgagtgcaaccaaagttttgaagaactcaagaagaagttagtctccgctccagttctggg

SEQ ID NO: 53665 - DNA, 1273 bp, Oryza sativa
caggtaaatgatcctgaaatagctgagctaaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtacaaaaatgtaccaggacctcaaagagaaattctggtgggtcagcatgagaagagagatagccgagttcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacaccacctatactgggaaaaggttggcagagctttatctttcaagaatcatgtgtttgcatggggtacctaagaagattgtatctgatcgaggaagccaattcacttcaaaattttggcagaaactgcaagaagaattggggactcgtttgaatttcagcacggcttatcatccgcaaactgatggtcagaccgaaagggtcaatcagatcttggaagatatgttgagagcttgtgcacttgattttggtggagcctgggataaaagtctgccttatgcggaattctcttacaacaacagttatcaggctagtttgcaaatggcaccgtttgaagcattgtatggccggaagtgtcgtacgccactcttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgttccatgtatctcaattgaagaagtgtttgagggtacctgaggaacaagctagctcagagcacattgacatccaggaagatctgacttatgtggagaagccgatgggctgcaggaatt

SEQ ID NO: 53666 - DNA, 2619 bp, Oryza sativa
  unsure (1)..(2619): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaatgggactgacataattctgcaataaaggattcacattcagttttagagaaatatcacatataaaaaggcaacattcagatagtgctcatctagtttcagcagggggaacaatttggtgtaattatttagtatgcaacattctaacagttcacatatatatttatcaagtggtcaacttaaggatctcttactactgctgaatgttcatatatgtcaatccaacggacaaaaaacaactaaatgcattccacttatcataggcaagaatttgcatctttcaggttggatgcacaaacatacacattcaacagtgcaagctcattcgccaacatgtggttcttcacctgcaacctaccacactcccaagtcttcttgaagatttctttcctgaattaccaataatgcaattcactaatccatgatcagagaaaaagtcagggacatcaaagatgactgctgaataaatcgatcatacctccattttcagattgagcagcttctgaacacattctttctttgcttaactgcctcccacatcacctcctgcagccgcctgctagcttatcaagaaaccattagcaaatatgatagtacaagcatagcccaacatgagatctggtaaatgacattaacgctcaccttagcattgagctccgggatcatcttggaagaaatacaatagcgttgatgctaactgaagcggcagctaggatttggcttcagctcctgcatgtaagtacaagtcacctcacttctcaaatttgtgatgtaatagcatttcaaggcaatctttaacagtacatcaccaactgaattggggcaggcacaagtgtaaaaaagcaaaaaaaaaaaaatcgagggtagattacaagatataatggcaacaccagcagcagtgtccactacctccatgtgccagccgatgcgacgaacagcggaggcgtggtagacggtggcgccggcgaggcggagaagtacctgtccacccgtggcgtggcggcagcggtgcttgagggtagtcaggtggcacctgagatattggcaagacaccgctccctccgccgaccgcttcctgcgctgccgccggatcgacgggagcagcatatcgccgtgccgaccgctccctgagccgccactccacctacgccgccgccggatcgacgtgacgggatgcgacgacgatggaggagccgcgtgggagaggagaaatcgagcagtggcgaacgagggctcagccctgtgcggcaggggcgaagccgattgcggcggatgctagaagtagtcgacgacgtccggagaggacaggcgttcgcagtggggatccgagatggggataccggcggcgtggcggacaagcgttcacggtgcagctgacggttgggcgcgccgtgcgacgaggaaggcgccgagcgcggcaaaggagtggggtcatcgcggagcgggcgcgtcgcagaccggcgttggtggcgcagccgacggtggggggtgcgggccatgcgacgaggcgaccccaccgtcggctgtcctcgtaattatagtagttcataattcgtcgaccgcggcggaggaatggaggagtggggtcggtgcggcagccgatgaggctccgaggcagtttctggcgcgcgtggcggatctgcggcgacggcgaatcatggggttcggcggtgaggcgcggttcctagcatgggggtgggacaacgaggcgacggggagggatgcaacgcaagggcgaaccggcgaaggcatgaatgcggcgtgcgggaggagcgcgtgattgaagggatgagtgaggatttccgggtgtaccgtgcgcgacagcgcgagactgcgagagagagagaggaggggagaggggatgcgggagagagaggcgcgatcagagggaggtgcggagccatcggatcttaccccatagatgaatttggatagttggatgtgtcacatgatgaatgagtaaaaatatttgttaaactatagtgtagattattcttcagaacctatccatactagtagcatgcccgtgctaacgctacggtaacatttggtaatgcacgtagtcatgtttttcaagcatatatatatgtaacaaataatacataatcatattcgcaaataagtcgcgaccgaaatcgttcatcaaaatttcgaaacatctagaaaacaacaaaatacaaaaagtaattatgctagcaaacaacaactaaaaagcaaaatgcctagagatgttatattaactggtccacttcttttctccgactccgaccgccttccatgacgagcacatgatattttggctgcttgatacaatctctatatcacatgcttgcttcaacggaggaagtattattttcatttggatgtatagaaata

SEQ ID NO: 53667 - DNA, 10326 bp, Oryza sativa
gaatgctaatattagccataaaacaacatttccaatatggcccatgaaaatatatacaatgtttgatgtaatttggtagaaaagcacttggtaaattaccatcattttcttgatttaccattgtcacagttgcccaaaggaattttactgaaaacaccttagcaaacaaatggtgtatgtagagcttggcaaacatcttggcagattcacatcttccaaaattcgaacagtgtattcatatttctcattctagttgagaatgccaaaaaaatctggcgttctctctcatgctcctccctctcaaagaaacatgtattcacagacagcacaacgccacactgccctgacatgttttccagtacagaatcctcagtagacaaactaccaacaatctaggacaggaattggcaatctgggaagcttgaggttacaaacaaaagaataaaaaataatatttcagtcgatataacactccatctactgcaaactcaaattgttgaagaatcgttgatttgtttcttacccaacaaaatatgaaggcgatggatcgacggcaacctgatgtcagggtgacggagaccccagcaagccagcacccttgaccacataggagagattccctactattgactgcatttacaccagaagggctataagcatctcattaaatcataatatggtcgatagaatgtgcacttggagtgatcactgtttgaagtagaggaatggatttttttcttctaaaaatgagctcatatttgtcttaaaaaaaggtttctttgaacaattatgtacagcaatttttttgtctgaattaaccaaatgatccacatgaattaacctgatatgtaatttgttcagaaccagactatatatatgattttatgattgcaatttttttttctgttaccacacatacaaattttcatcatatattttcgctaaacaaaaatgatatatgagcaaaagacgacgctataattggaaacatatctacagaaactctctaattggaaacaacaaaattggggaaatttgacctgatctcaatggagattagcagcacaacaggggagcacaaagatcgttagagctgccacacagatcggtcgccggggagcgccatgctactgttcaagccgccacttgccaacgaggagcacaattgccgatggaagatggagcaatggcgctgtgatgttgccgaagatccgctgcagtccacgtcatgccggcgaggcgcctttcgctccagccactgcgccacctcagtcagaaacgaattgcggcgttgcgcgtcgatttcaccggagatcaccgcgccaccgcttcaccttcgtcgaggactcacagtaggcggcgacaggggagagatgagggcggcaatggagaccacggcgagccggcgcccttgacgacggaggatctaaggcggcggcatgcggcaggcggcgattagggcagcggcgtggttaggggcggagaggagacgtggatctgggagagcaagagagatagtggggcgtgcgcgattcaggaggtgggaggtggaatcagcgattccgggaggggggaggttggatcgatctccatcgttcgattttacacggacgatctgaaccgttgagtgatgaatgtaagagtaggagtgaatgataagtaaaatgagttggtgaattatatggtagatttagtcgacaaaagcaaaacgcgctgccacatatgaaagaagtgggcttcgtaacttaaaactaaggatgtgtttaattcccttcaaactttaaaaaatccatcacatcaaatgtttggacacatgcataaagtattaattgtaggaaaaaaaccaattgcacaatttgcatgtaaattacgagacgaatcttttcagcctaattactccatgatttgacaatgtgttgctacagtaaacatttgctaatgatgaataattagacttaataaatttatctcgcagtttacaagcggaatctgtaatttgttttgttattagtctacatttaatatatcaaactagcatggtggcccgcgcagattgcgcggctagcatcattatagtatctctcatataatagcatatatgttttctcaatatattattcaaatatattaaaatgacaacataattttaaagtttatactaactttacgaaactactaatgtgtgatattcacattgtattttatatacgtgttatttattaattatttttaatatcaaattttagttatttgtatgtgtgtgtgtgtgtatatatatatatataatattaaaaataattaataattaacacgtatataaaatacaatatgaatatgaatagtacgcattagtagtttcgtaaagttagtacaaaatttaaaattacgttgttattttaatatattttaataataaattaagaaaacatatatgctattatatgagagaaaatataatgatgctagccgcgtaatctacgcgagccaccatgctagttataatacatatgagagaaacaatagacccataagaaaatagagtggcgtaggtagatggaacatataaaaactataaacaaaatctcaaaatagaattttaatgataattaagaggagggacgacgagcagttcgttaagcagcacggtctcgatgattggcgggatttctagaaagtaacaaaaaaacctcaatgataattatgttcgatattcaaatctcaacgataataaaaatgagaggcagcgggcgggccgtagaggagtacatggtggcgtttggtgagacttctaaaaattataaaaataaaacccaacgatacaatgaactctaaaaccacaaggtcaaatttgtaaatgacggagaatgaactccaccaccagggaaccgtgagactcccctttgtgagttcggccgggggcagcggatgagattcgagtgcttggcaagcggagctgtgtgatcttgagggggttaggcccctccaagacgatgagacaaaagaggattatacaggtttgggccactgagaagcgtaataccctactcctgtgcatgattgattgaatgtagaatacaagtgcttggggttgcgagacccaagcgccagttcgctcagaagtccccccctccaccattaggcctggacctccttttatacctcaaggggttaccacatgggcccaacaacctaacctagctccggtggagaagtattataatctttacattaaatgcatgtcttatctcttgacttgggaagccaagcacacgtcgtcttgatgatggggcctgtcaaatcttgccgcctgacacgggggtgcccctgtcagtcaccatttaacgggtgaagacttctggtctcctattacaccgggaaacgggagccttgctttgaccagagcgggaggaccgaatccggctgggataagaggatgagaacctctcaccatcattatttgatgggatatgtcgggctgcacgccgcctgacacacgcgatggtgcgcctgacatcaagggtcccatcagtcattcgaccggtcacagaccggttgagtgcactgcacaccgcattaaacgcggcgtggcgcgaccgctcgggacgccataaatgcgggtaggtgggcacctggaggcggacacctaacccactgtacgtggtgacctagtgtcacgcccagaaatttaacccaaatttccagactattttgcgtattaaatccctgtccaggaccagccagggtacacaaaacgacaagtaatatacagttccaaacgtaaaataagcgtaaaatacttacagaagaggcacttagtcctcacaccgaaacaaaagcagcagcagcggaaaaaaaaacgatcctagcggggcttcagctccactccacaggccaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggatacaaggatggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattgggtcgatttattaagtgtgagactaatcacggtgaatctagtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccgcgctggcttgtggtaagtacgataagttcttccagggcatcccgcgaatcggtccttaactgccatgggtgcgaccagcaaaaccatgcacccacagcccaccattcagtcgcattttagttggataattacgaccatgaagcatggccagatgtctcgagcacgcagctcaacaagatactagaatgtctaatactgcaattatcccatcgactgagctagtggtaattaagcatggctaagcatatagttctagctaggtcatcaaagtaacaccagctaggcgatttattacccatggttgacaaaggacagatatcaagtaaacatgacacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcacttggatcttctgaactcttatccttgcgaacgcgatcttccgaaacgacgggaactacacgctggcacgcaaaacgaggaaaaactctaataaaaaccaagaaaatagtacataaaaactaaacaaacatgtagagctcaattttagatgaattttgcaagttgaatggctcaattcggagttcgaatgaattagatatgaattttagaagttttgagccatttaaatgaatttctagaattaaactcgatttattgcgcaattattatttatttttacaaaggaaaagcttaagtgctgacgtcatcaaagaggccggcgccgacaggcgggccccacacgccagcgggtcaagggaatcggtccaccgtggaccgggaccacggggtggtccaccgccggtccgcaggaaccgacggcccagatcagctcgagctgatcgggcggccacgaggcagggcgcccagagcacgggcacggctcagagccggcccggccgagacacgacgcacggcggcgcacggccaccggcggcgagcggcggcgcgagaaggcgcgcgaagggcggcggaaaggagaggaggaagggggatgctcaccaagcggcacggcaccggacggaggcgaggtagcggcggcgctccccgggcgaggacgacggcggcgccccaacggcggccgacgggcgacgagtgacggccgggggcctccgggaccttgaacggggaaaagcgggctcccgtggaatttcggcggcgaggggcggcgaccgaggcgcggcgacgctgaggatggccacgggtgcggctcgggacggccaggagcggcggtaaacggtggccggggcggcgaaagcggcggcggcctcgggttggcagtggaggtgacagcttggcggtcggttggggaggggagcggccgacaggcttgtcctcgcggcggcgaagccggctgcggtggtggcagggtgcgggagcggcgacggcggagagaggtggtgcacgtggtggcggtgtttcggagttggggaggggaaaaggactaggggccggggtagagctcggcacagtgatgccgacgacacaaacggcacgacgcggcaagccctagggcggcagtagcaggcggctggaggcggtgaatggcggtggttttggcttgcactgtgggaatggtgctgcgggggtggaaggagaggacggagcggtggacggggtgtgcacggcggctgcggtgccggggagggcgacggcgcagtgcggggtggacgggagcggcggcgcggcgctgctggagttcgccggagagcggcggtgcgtgggctcggcgcggggagagcgagggagggcgcggcggcttgggaaaaatgggggaaatggatgagggaaggccggggattgtttttataggggaggggaggcgggatcgagcccgggagaggcggagtcggggcggcaaccgccggtggcgtgggcggcatcgtggggtgtgggtggcggttttggaggggagaggtgggggaaaacggcgcggacgtgggcggcgaggtcccacggacgagcgcgcgcgcggggggtggaggaggtgggcggaaacggccgcgtcgtggggcggctcgggcggccatggcggcagttggagctggaggaaggggatgacaggtggggtccacgggtcccacctgtcggggagagagggagggagagctggatgggggacgtaaaacagacttcgcgagggagaggggaaacgggccgacggcccaagagatggggagggaggccggccgggagagggagagagagggcgcgggccgcgggaggggaaaagatcttgggccgaaagcggcccaaagacaaagaggggaaaattttatttgttttctttttattttaattgattaaatgaactttgtgctattaaaattatttcttgagctccgaaaattcacgggaaatttcagagagtattttagggcacaaagaatattacaaaatattcccggccaatgatttttaaagaaaattttaatttcctctataattcacttgattaagttgatttaacttttatttaatttctagaaaatgtattattaattgatttttaatcccgaacgaaaatcggggcgttacacctagagagggggtcgggggagcccgacccctggtcatgggagggggcggccgccgcctgacctcgggcccgatcccccctcggggggagccacgtggcgcctggggcggccttctccctctagtctcggccagggagtggccgccgccctacttcgggcccgacccccctcgggggagggctacgtggcattggagggcagcctcctccatccagtctctgggaaggagtggccgctgccctacctcgggcctgactcccctcgggggagggccacgtggcatcggggggcagcctcctccgactatgtcacgccccgaactaatcccgaccggaactagcccgtgacgctccaaattaacctgttgatcgataccagtcccaggaaacagtgctggtatcacagggagacagaatatcacagcaacagcggtctctttattatagagtagagatacagtcatgttgggctacggacagatcccgagctcacaactgcattacaaaagggaacggaaaccaggactaggaccaaccaacacaggcgcgacttgggaactaggccgaaaccctaaaactcatcgtagccggtttgctcctggaagaactcctcatcagcaggatccgcttcatcttcttcagcaactgggggggattatttatatagagcaagggtgagtacgggagtactcagcaagccaagggaaataagtgtttaatgcaggcttcaaggaaaggctgttgtttttgcagttgattttatttgaactcttttctaaaaacaactaagtgagtgcttctcaaacgacacggttgagacagtgcgtctcgtccggtcggagtacgtgcaatgtatcagtctttaaaatttgaaaacaaggttggcacccggccaacagcttttcaaacggccacccgggccaacaactttcaaacggccacccgggcctagctgatcccatcagctgcagattttacaaacatcgaacccctttccacaacagcaatttcacaagcagtagtcaaacaaaactacgctaggaatcatctcacatccgcccatgaccgtgggcacggctgttcgaacagtttgttaacctctgcagagggggtacactttacccacacgacattactaacccggatcacccagcccatggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttttgatgaaattccaaggaaacggtccttaagtgcaagagcggaaaaccgtacacccggtacgttccccggtccgcggtttcggaaattcatttagttcgcaagcaccgacccaggtgtcgggttttccaagtcttttgtaaaacccaagttttacccaagttgttactcagattttaagtttgaaggcgaccgtcgatactcgcacagagtgcacgaatatcgaggtgcaactagatggttacaaggggacatggtatcacaattaataaaggaaggatcaaatgcaacaaattaggtaggtccgccaatctgccttgcagacgggacaacaggttaagtgcgatcctatcaatgcataatattttcaaacaacataattaaatttcaaatataggctcaagatgttcaaaggtggcttgccttgctcgagatctggagcttgatcctcgaaatcctcgcgctgcgggtcttcgggctccgaaactacacgcgaaacaaacggcgaaaataaagccctattaatgacctctaagcatgccattagatagatctcgagatttgaggaattttggaagttgaacggagtcaaacggatttacagttgggaagatattgaatttataagattattggatttttggtctaaaggaaaaggatttaattaagtcctttttgaaaaagaaaagaaaagaaaggaaaagagggagggaaaatagacttttcctcgggcggctagggcgcggcccgagagagatggggcggtccggccgagctaaatgggccggccggcccaaggcggcccaagcgcgcgcgcgggggaggggaggagagagagggccggtggaccgggctcaccacgcgtggtcccgggtgggacccgcttgtcagcggctcggctcaccgtgcggagggagcacgcggcgcggcgctagggtgggggagggacgcggtgcacgcgcgcggttcgcggtggatgcggatgcggcgggcccacgcgcagcctcacggctcgcggtggaacgcgcgcacgggagggactgaccgggatcggcccgatccgatctcggccgagctggcgccgacgtggcgcctacgtggccgctacgcgggccggcgggaggtagacgacgacgccggccggaacggacggcggacgacagcggcgagcggcggagtgaaccacggcgataccggcgaaagcgagtacaccgggtggttgctcaggacgaggggagacgagccaacggctcggattcgccggagggagtccgtcggctgcggattgcggcggcggcaaccggcggagagaaaaggggaaaacggcgacgaggtcacgaggggccaattcccggcggcgagagcacctacgcggctatgggaatccgttgctagcgtcggattgggcggagctacgccgagcgaggccggcgacgagcggcgcttccgagctcgggcggcgacggcggcgagcacacggcgagcggcggcaacggccggggcggcgccggctagctacggggaggctactcgtgctactaccgaaaactaaggaggagagatggagcgaggaggaagaacggagggaggcactaccgtgcggacgggacgcagtgacgagaggccgacggcgcgggagtaaactctccggcctcgggccggggaagaggaagaagagggcgcgcccggagtccccttccgcgtc

SEQ ID NO: 53668 - DNA, 3192 bp, Oryza sativa
agatgggccgagagagattcggcccatcgaccccgggggaggcaaaatagacttttgcggagggattgatttggaaggatttggattcggaattggactcgacgatagatcggggattgagatccgagatggcacggacactagacaacaagcaaagaaacaaatttcgcaattagggtttttaagagataattttcccgctaggcgccacgacggaaagggcgctacagactagtctttggggaaggagtggccgccaccccacctcgggcctgactcccctcgggggagggccacgtggcatcgtggggtagcctcctccctctaaacctaatattcctgggcccatatcaccgacagtagcccccggcgttagccctgaccaaaacttttcctaggtggtcagggttgacgccactctgttagtcaaatgacatgtggaccagatctcttattctttctttgctggcactaagacccatgcgcctttttcgccccagcctgagggtgactcgctagcccgtgccttaggctgtgaacttattttctgtatatattcagcaaacgttgttagattatctcgggcccgtgaccttacgcttgcccctgccatttgttaacctctgttcatgttctacttcatctattcaaacgattattttcgcgagtgtgaggaatgaactttccatagccagcaatcttcacccgtgatcaagctaagctgggcgccgtagccagccggcggggccgaagccagccgctacggaagagctagcacagggggccccgggcgtcgacggtacccagagctcgacgcagggctaggatagagctaggaatcgtagcccccacactttaagcaaagaatcgtttgaatggatgaagcgaatacaaactttttgttaccaagggaggcaagcctgcgcgcgacacataggtaccgtgggaccgcgaggaagagataggcgagagataaatataagcaagaataattctatgcaaacgattaacttcgcgcaagtgtgaggactgaactttctatagccagcaatcttcgcctgcgatcaagcgaagctgagcgtcgtaaccagccgacggggccaaagccagacgctacggaagagctagcacagggggccccgggcgtcgacggcgtccagagctcgacgcagggctaggatagagctaggaatcgtagcccccacacttttagcaaagaattgcttgtatgaatgaagcaaacacaaaccttgcttgcatatcgcgacctttcaaacctttagctcgaagagggccccccactatgggttccgaaccatcttgggaagactgtgaccacttagcaaacgaggtcaggttcccacgagcctgtgtcctcacgctacacattttgtttgctcttttctttcggtggcctccttccaatctcttttccttttacatggacgattactttcgcacgagtgtgagagccgaaaactctagagccagcaattcctgtccacagttgagccaggccgggtaccatggccagccggcgggaccaaagccagccgctacggaagagccagcacagggggtcccgggcgtcgatggcacccagagctcaacttaaggctaggataaggctagaagacttagcccccacacttagcgaagaatcgttcatgtagattggagagaggttgggctcttaccaccgagggagcaaacaaatgagcaacacgcgggcgtcgcagggccatgagaatagaatggggggaaataaatataagatttcaagctgtactaggttgatgagttgaaaatttgaaagtactgaaaacatgagaggatgattagttgagccgggccaggcaccatagccagccggtgggaccaaagttagccgctacggaagagccagcacaggggatcctgggctttgatggcagccggagctcaactgcaggggtcctcccaggagtggaccgaggcgggcagcaggttcatgagccaaccccgcgcttggcccctgagggccatggggaagaagttcgccatgacccggtcgtcaccccccatcgcctctatgatcgtcatgtggatctggaaggactcaagggattgacgctgtcgtcgtacttctcggtgaggctaggccggaactttgggggccatcggacattccgaagactcgccacaaagacctggtagccaagcttacctggtggggatgtggggggccttgccccctgcctggggtggcacgacactcctaaggatgctgcgccttccccgtagcggtggcgcgacactcaccacgccagcactcaaaagaacctcaaaaatcacgaacgcaccgcctacctggcgcgccagatgtcagagaatgaactcctccaccagggaaccgtgaggcccccctttgtgagttcggccaggggcagcgggtgagattcgagggcttggtgagcggagctgtgtgatcttgagggggttaggcccctccaagacgatgagacaaaatatgtttatataggttcgggccgctgagatgcgtaataccttactcctgtgcatgattgattgaatgtagaacacaagtgcttggggttgcgagacccaagcgccagttcgctcggaaatcccccccctccaccactaggcctggacctccttttatacctcaaggggttaccacatgggcccaacaatctaacctagctccggtggagaagtattataatctttgcattaaatgcatgtcttgtctcttgacttgggaagccaagcacacgtcgtcttgatgatggggcctgtcaaatcttgccgcctgacacggggggtgcccctgtcagtcaccatttaacgggtgaagacttctggactcctattacaccgggaaacgggagctttgctttgaccaaagcgggaggaccaactccggctgggataagaggatgagaacctctcatcatcattatttgatgggatatgtcgggctgcacgtcgcctggcacacgtgatggtgcgcctaacatcttgggtcccatcagtcattcgaccggtcacagaccggttaagtgcactgcacaccgcataaaacgcggcgtggcgcgaccgctcgggatgccataaatgcgggcaggtgggcacctggaggtggacacctaacccaccgtacgtggtgacctagagagggggtcgggg

SEQ ID NO: 53669 - DNA, 2625 bp, Oryza sativa
aaggttccaacgaggatgaatgaaaacaatggtagatcgagaaagcaaataaagcgatgaaaacgaaataaggcgtagtaattggcatgactattaaaaacacggggatgataaagtcggtcttttaaagttctaacataagatagttatttaataaaatcatatgtaaaaaaagataattttgtatgggtgctagccgtataatagcgcaggccacctagctagttttaatctagaatccataaaaagtatattttagaaatatctaaaattcaaaatttaaaaataattaataactatcacatatatacaatacaatatgaatatatcacatatatacaatacaatataaatatcacgcattagttagttcgtgattggttagtttggttaagttagtacataatttaaagttatgttgctagttttaatatattttaatcataaaacgtgaaaatatttaaactattatatgagaaaaaaataaaacgatgctagccacatgttttatgcagagtattatacggaaaaaaaataaaacgatgctagccacccgatttatgcgggccactctgctaattgctagtaaaggaaaaaaaatgcaatctgaccgacgaagtggtacggagggcactagagatcgggcgcccgatccggggagacaaaaaatcgggcggccgtccggccgtcccagccatccgatccgggagaaagaaaatcacaggacccaaaactactacacgcatgcacagagagattatttttaggcactgcatgcacagaacatgcagccatgcatgtgtcaagttttttaaataaactttaaactaatttttctcaaaaattacttatccaattcacgatccgattgcaccactaaactcgttgcaattaaatctttaaaacaagaccacacattaatataatccgatgaaaaaaaaattagcttattattgaattatttttaaatattgcacgctgttccgccaagtatatagaaattgttccactaagtagatagtaattatttcactaggtagatcaaaaatatttcaatgatttaaaaagttgaaacacaaccaaatcacctcgtaaaacattttgctacaacgtatgaaacaacagtttctcaaaaaattgggcgttatttcactttatataaaaacaatatttcagcaaatagcgaaaaaatgtttcagttcactgcaacatttgagctatacgtagtgaaacattataagtacattaggtgaaacattttttgtggaacaaaaaatgaaacgaattcccttaatagagggtttctaaaatatgtgggtgatttgttgtaaaagaatgtttcaattcgctgtaacattatatctatacatagtaaaacattgtaagtacactaggtgaaatattttttatggaacaaaaaataaaacgaattcccttaatcgagagtttcgaaaatatatgagtaatttgttgtaatagagtatatgtagggacacgtgacgagggcggcagaggacaggtggcggggcggggcgcgcgcgcgcggtgggagacgccagggctggcgcccggcgcccgattttttgcagccgcgccggcgcccgacgtttaggattttcgaagtggtacggccccattcccattcaaaagctcgcgaaaataaaaccacattcccctcccataaaaaaataatatgttcatctttactgtgatagatcaaaggctgatattcggaaaacactaataacataattaagaacatctccccaaagtttaaatatgtagatatgtacccagctgattcatgtacatacctaaagcacaatttgtgtgcatcatcaacaggacgtagaagttgcgaggagagctcccttgttcttgttcttgtacttgaacgtgacggcgaagtagccgtaggcgagcagctcgagcgcgctgagcgcggcgatcagccagtagaagtagtcgaggtgggcgcggttgaggttgttggagaaccagctgccgcccctcgccgccgtcgcccggtcgatcccggacacgagcgcgctgctgatgaagctgccgacgccgaagatgctgaggtagagcgccagcccgaggctgcgcagcttgtcgggcacctggtcgtagaagaactcctggagccccaccatggtgaacacgtccgccgcgccgaacagcacgtactgcggcaccatccaccacaggctcatcggcaccgggacgcccgccttgtcgacgagcccggcgtcccgcgccgcccgcagccggcgggtctcgacgagcgccgcgatcaccatggacaccagggacagcaccatcccggcgccgatccgctgcagcatggtgatgcccgaggggacgcccgtgtagcggcgcgccaccggcacgatgacgcggtcgtagaccgggatgatggccacgatggtgatgctgatgaagctctgcagcgccgccggtgggacctgtatatggtcgccgatccgccggtccagcgtccccgcctgcttcgtgaagaacgtcgacgactgcgctaacgccacggcgtagatcaggcacgtcgcccagatcgggaacagccggacgatgcccttcgcttgctccacgaggcccgccttgccc

SEQ ID NO: 53670 - DNA, 32931 bp, Oryza sativa
cctgttgcgccacgccgcgagtgcctcgccggcgcgagcgaccacgcccttcttgctgccggagacgtagtagcggtacgtcctggtgccgagcaggaacacggcgagggcgcacgccatgacgacgcaggggatgccgaagccgaggccccagccgatgttgtcctggacgtagctgaggaacaccagcgtgacggcggtgccgccgcacatgccgaagtaccaccagttgaagaaggagctcctggagaccgactcctcggggtcgctcgggtcgaactggtcggcgccgaacgcctgcacgcacggcttgtggccgccctgcgcgacggccaccatgtagagggagatgtagaagaacgccacccgcagagtcgacggtgggcaggtcttgccgccggcgacggcggcgctgctgcattggttgccgccggtggagatcaaggtcgagaaagctaacatggccaagccctgcacgcagtatcgcgctgagtgatcagtgatgtagtacgttgccatacgcgcgcgcagatggcggcgaagttggaaagggaacaatagtaaagcattttataattggcaaaatttgttacaggacacctaaaaaatatgtaattagctatgagacatcacaaaaacgtaaatttgcccaaggacacttcaaaagtgtggtaatttgctgcaggacactagacgtattaaaatataatatcaacctaattgatgagagagaaaccacatcaaatgaccgttttgcccttatcttcttcccctcttcctgctgttcttccgatgcttccgaaaagaataaacaccaaaccaaataaaatgcgccggcgagccgccccatggctcctcacacttgaggcacaccctgaacacgctgctcgttatcacgtgcacgggcatggtgttgcccatcgcgagcgcctccaatcgcgtgaccacgccgctcgccggctcgcgcgtcgtgaatcacatgccacccatgcgcgccatggctcgcccttgcgacacggcagggtcgtacgcacgagcaacggcgacaagtcaaagcccttggaagggacatcaggtggaaggcgttcagcaccttgcgcaattcatccttgtcgttgtcgacattgccaagcatgtccactggctcctgcgcgagcttggtgagatgggtcacagaacatgtgccatcttccggaaccactgcatcttgtggaggccggcgaaggtgatgcaggtgtctgggttgaggtcgaacaacatcttgatgagcttccgtgcgtccgttgtcaaccacgtcgggcagctgaagtcacctgccgcatcttgtgatagatgcacaccaggttctcgtcttggaacagtagcgcgccggcgagcaatagaggatgatgctacaggactagaggtcggccttggtgctatcgtagccacccggcgagcacgtcggggacaatgtacgtcggcgtgccacaagcggtgtggaggagctcgtcggggcgcgcatggtagcagactgtgctgagcccgaagtcggaggttctcagcctagttaagcagcaggttctcaagctcaaggtcacagtggtacaccccgctgatgtgatttggtttttgttctttttagaaacgtcggaagaagcaagataaagataagggcaaaatggtcatttgatgtggtttctctctcatcaattaggtggatattatattttaatgcgtgcagtgtcctacagcaaattaccacacctttagagtgtccttaggcaattcacgtttttgcgatgtcccacagctaattacacattttttaggtgtcctacagcaaattttgccattataattttatcgaggaatgcaaaagaattgaaggcccaacttatgcacatatcggcccacaacttcatctgtaattaaacaggaataagttcactttgtatcccttatcttgaggttgagtttaaatcacatccttagaaccataataacagatataacaggtttcaactgatgaaaccagtgcaaatagactctcttagtggtttgtgggcaattttggctgatgtggaatcctaatcggtgatgagggatgtgaagtgaacaattcattagttgagggacacaaatggcgcgacgggccagtgtacaccttaccagatgctatcatgtaaacgatgaatataaagagcccgagtacaacaaagtactaggtgatgtcccatccaaatctatagggtcattgtttggcttattgaggaaaaaagccaaatgacataattgcaaacaagaaatgatttgtgaataaaatttttatatacatgtttttagtgatctaaaagcaaatgattcaaattttgacttatctaccctataattcaccaactcattttactcatctttcactcttacactcttacattcatcactcaacggttcagatcgtccatataaaatcgaacgatcgagatcgatccaacctccccccctcccggaatcgccgattccacctcccacctcctgaatcgcgcacgccccactctctctctcgctctcccagatcaacgtctcctctccgcccctaaccacgccgccgccctaatcgccgcctgccgcgtgccgccgccttagatccttcgtcgtcaagggcgccggctcgcgccgctcgccgcaatctccatagccgttctcatctctcccctgctgcggctgccttcaatcctccgtggtcaagggcgccggctcgccgtggtctccatcgccgccctcatctctcccctgtcgccgcctactatgagtcctcgacgatggtgaagcggtggcgcggtgatctccgttgaaatcgacgtgcagcgcggcatttctgtccgaggtggcgcagtggctggagcgaaaggcgcctcgccggcatgacgtggactgcagcggatcttcggcaacatcacagcgccattgctccatcttccatcggcaattgtgctcctcgttggcaagtggcggcttgaacagtagcatggcgctccccggcgaccgatctgtgtggcagctctaacgatctttgtgctcccctgtttgtgctgctaatctccattgagatcaggtcaattttccccaattttgttgtttccaattggagagtttctgtagatatgtttccaattatagcgtcgtcttttgctcatatatcatttttgtttagcgaaaatatatgatgaaaatttgtatgtgtggtatagaaaaaaaaattgcaatcataaaatcatatatatagcctttctggtgtaaatgcagtcaatagtagggaatctttcctatgtggtcaagggtgctggcttgctggggtctccgtcaccctgacatcaggttgccgtcgatccatcgccttcatattttgttgggtaagaaacaaatcaacgattcttcaacaatttgagtttgcagtatatggagtgttatatcgactgaaatattattttttattcttttgtttgtaacctcaagcttcccagattgccaattcctgtgccagattgttggtagtttgtctacagaggattctgtactggaaaacatgtcagggcagtgtggggttgtgctgtatgtgaatacatgtttctttgagagggaggagcatgagagagaacgccagtttttttttggcattctcaactagaatgagaaatatgaatacactgttcgaattttggaagatgtgaatctgccaagatgtttgccaagctctacatacaccatttgtttgctaaggtgttttcagtaaaattcctttgggcaactgtgacaatggtaaatcaagaaaatgatggtaatttaccaagtgcttttctaccaaattacatcaaacgttgtatatattttcatgggccatattggaaatgttgttttatggctaatattagcattcttatttttcagatccgataaatttcaggttgcaacttacaaggatcggtttttgtaggactaccaagttgcctaggatttttgggtaaggattatttgtttttctgatgcggatcatggaaatcgtgtgaaaaattatccagattctggtcttgaattatacttgtcaaaactaacaagattatatgaatatctataaaaataactccactgtttctttttgtgtggacatatattgtatattgaagtgattatatataattgtcgatggtcatggattattattttcatatagtaataatatcaggtatgctgatttagaaagcttttggtctagaatattctgattttctctctttctaaggccaagctatggtatttttgattcacctcagttgcaaattgtaatgagttttatttgtatacatccaaatgaaaataatacttcctccgtgcagccagcatgtgctgtagagattgtattaagcagccaaaatatcatgtgctcatcatgtaaggcggtcggagtcagagaaaagaagtggatcagttaatataacatctctaagcatttttgctttttagttgtttgctagcataattactttttgtattttgttgtttcctagatgtttcgaaatttttgatgaacgatttcggtcgcgacttatttgcgaatatgattatgtattatttgttacatacatacatacatacatatatatatatatatatatatatatatatatatatatatatatatatatatatatatatatatgtatatatatgcttgtaaaaacgtgactacgtgcattaccaaatgttaccgtagctttagtatgggtatgctactgtaaaaggatatgtaaaaagatgaggctgctagattggttttttttacattgaaagtagaaatttttgtattattgcgaatttaaagtgcagggcgtgcgtaaccgtatttgcccagaaactcatcagtgatgtgctctctctcctgggatagaatcatcgatcatttccctctagaaaaatcaaagttgatggcttgatttgccttcgtcatagaaagggaccctcttcgtcgtgttccacgatcaaacgagtaggttagtcgatccccgacgagacctcaccaaccactcgaataatttttgcgatctggctcctaataactctcagtgctacagctgctactggcttaacaaatatcttcatggaagaaacatgctcacgcgagtcacgagccaagaaccaattccaagccatggatagctttcagagatctccggtgtgctgctgacacgtgggccccgcgctagcgcactcctgagatctctcgcccatgccgaacaaacgggaattttttttctctctttttttttctatatctaggagagaaacagacgagagaaaagaagagaaaaaaaaaacaatggcgttttggtggtattaatttaccaggatgtagagcagcgaggcgaggaggatggtgcggtagcggccgagccaggagtcggcgagggcgccgccgagcagcggcagcagctgggagacgccgttccaggcgttgatggccgccgccgccgccgcgttcccttccccgagcgagcccgtcaggtaggtgatcaggttcgccgacaccccgtagaacgcgaaccgctccgcgatctccaccgctgcagatcccccaataatccatgtcaaattcaccaccacacaactcgtacgcatcgatgattctcagttctggcctgccaatcgagcgcactacttgcctatgatgaagagcgccgacctccagccgccggtggcgccgcggagggcggggcggccgcggtggtccacgggggcggcggcggcggcggccacatccccgtccgccatgcccgtcgtccagtgcgagcagcgggtcgtaggagccggagtcggagccggaaggcatcgtcgccggccggctttgacactatatatatgggcagctcgctctctctctctcacgcacacaactagccgcagctcggccgaaactttcgcagtcaatgcctactcactcacaccttggcttggcggcggctaaaataagcaaagcagcatgagaatcggccgggaatggatctcaacagaaaataagcgccaactggcgcgctcgatttatatcccatttatattatttttgtgttattaattagcacattgttcataaaaaatatagaaatcaatttaatttccttgaaactcataaaaaatcgtaggaatggaattttttgagtttaagtttaacataacgggtcatattgttgagaaaatcatcaaattttctctttttttcaatccatactattaattcttccattgtttttctaaaattataattaaattgtttactaatgataaaattggtgttgtttttttttaaaaaaaagtgtttcagatttttgttttgttaggagccacaatgttcatcatttgttttgatgacataacaatactaaattgggtttaaatcataaacattgtataggtgtttgtattgatggctaattagtgatgggtgacatatatacgttgatgatgagttgcatgtggtgatttcgctgattttagaagaaaaagaagttaattttaattcctgaactatttcaccggagtagttaacatactaaattgtttttttcttattcaacatttctttttaatttttttcccaccgtttatgcaggttgaaagtacataggactgatttaaacatcaaaattttaagttcaagcaaacaaccacattttgaaaaatatttttgaactttaataatattctaatgtatgactccaacaaatttcagcttaaagtaagaaaactacaaaatattattaaggagtaaagtgaaccattttttacagtttaggaggtaagatgagccaaaaaaattagattttttaatagtattcatcgaattagttcggagaagtaaaatatttttttttattttgagatatgctaactcaatttttcaaagatgctgatatgtatgaaaactgagtagttgtatatgcattcaacattttttttgtaatactaatgtactacctcagtacttatacatatgtagagcatgtgagctctattgacataggcattcgctgcttttgcctaatcgatccttccagaatagcctttcatcggcataggaggactggcctgccacaaccctgtacttccttcgtactcctagacgcacaactgctcaattcctttttttttctttgtgctcttcggatttatgtgccatgtgagagaggacacgtggaccaatcactgctggcagaagcagccagcattagaaataaagatccgcgccgcgccgcgccatatcggatagagtcggatacgattatgttgatatgtgaatacgattatgttgataatatttggataattattttgcgtttattttaaataaaattttaaattactattctatcgtggatctgatatttgaaattgcgctaagcaagacggaatagttatcactactagtactatggaacgaggggtcgcactcgtcacgcgtcgcgcatgttggatttgtttggttcaataccctaccaaaatactggtattggcacaaccaatattttggtagggtagagttgtatttggtttaaggccaatttaaaaactaagcttttagtggaatatagaaaatatcaaattggaccttggcattgccaatgatttggcttctaaccaaaaccaccaatacactattcaaactaccaaaatgttggtaaggcacgtttttagcactagtctaaaacacattaattttgacaatttgactctttaaaaaactaattttacaaatgaaccgccgcctatttcaaaagtaacctttttttcaacaccaaatgatgtggcgctgaacttaaacacctcagcgccacatcacctggtgctgaatgccgtgctaccgtggatggaaggctgagtcagcgtgccaacgtatattcagcgtcgtgctatttggcgttgatgtgtctaaattcagcgccacacgatttggtgctgaacagaagggtcacttttaaaataagttttggcagcagtttatttgtaaaattagtttttgcaaaaggtcaaattgtcaaaattaatgtccaaaacggcccattatacgcacgggtgcgtgaagcaacggagttgctagaaatatggcgccatatgctacagtcgattttttttcagccacttacacagtagttacacctcatttacacctcacttacatatgtaattagtatgtaattttcgaatttacatatgtagttttagtacttacatatgtaattttgagacttacattgtaaatacactaaaattacatatgtaatttagagacttacaatataaatacataccgactattttttgatgaaaaatatggcgccataaatataatataactacaccctgaagcaaagcggccagttgaccaggtggccggtgacggggccgtgggtcgccggacatgcatgcatggctagtcttggcgggcgccggacatggctcattggctggctggtgttggcgacgttgcgtgcttaggactcgcgagctctggcagtacgctgtcagcgtcagctgcggtacgcatcttgggtgcctcggttctccaccacgaattttggtcaaaatgagcagacgccagacgggcagattattctcgttttgaacgtttttgtaccgagaggaaggtcagttgggctgtatgtgcacactaatctacagtagcagtactacgttgtacctttccttttgagaggacgtacgatactccagtcctactgcggtgtacatcctcggacaaggccggggttccctcggcttcgatctaaccagtgcaagtctctcattcgagttaccttagatatcacgtaggacaaatgcatatagaatccactcatctcacagtgcaagttactttcacgggatccccaagccaaacaccctaacccaactactgctacatttcccttttaccggcgcttctctctcccactttcctcgcattctctctcacacttcccccatttaccggcgcccagcggagaggaggcgacatcctcgggctcgtcccagcttcgagcggcggaggggtgatgatggcgccacggatctggagcggcagcgcggatctagagtggagcggcgacggtgtcctcatgctcgtctccaggaagcgcggagcggagccttgacggcgcggatcggagctgcgcaagagctcaccggggcctccgtttcgaggcggagaagggtggtggttggggagctacccagcagcacggcgacgagctccccggcgacaccgaggtcggcgaagtggagtagagcatggggacttaggacgacgccaccgccactcgagatctgcaaccggtgcgatggctggcggtgtagagatccgccaccgaggccgcctcttgaagcgaggaggaggacaaccatgagcggtcatggcgagcggcggtggcgtcgtcgacgggatgacaggagggaggtgcgatcgtggcgggcggtggcgtcgttgacgggctaacgggagggaggcgcggtcgtcggcggctgcggtggcacggtcatggcgggccccggtggtgactccaccagctccacgagctcccccggtcggcgcccctcctctcccttcatgacagcacttcaaaccgacgaggcggcgacggcggtctggagcgccctcgtttcgagcggcaatggcacacggtcgatctgcttgtggcacccttggcaacggcaaccccgacggctgagcagcttcaccggctttggaggaccacggccacgctcaccaccaaggctgcaccggcctttttgcagagcaaggcgccaggctctcgttcctctagagagatgcgaaaaccaatcatagctatgcggcccactcgctttttcctccacgtagaccaggtaacgcgccacgaacttgcactgtgaaagggctagacaggtcttttcaaggcatggccagatggccaggtccagtccacgaacatagtaggaactagttgataccccgcactttgttgtaaaatatgtagataaaatgcatgttatacattataaaaagagataatccattctatgccgtagacaaagcacggattctacaatataccactgacaaagctcagttctataatataccatcgaacaactatttttcttccttacataccatcaccgctagtcaacagctagtcaaattccgttaagaggaagaaaatgtccattttaccccctagggtatcatgcgtactcagatttcattggtcaagatccactaattcttctcattgatgaaaaatagaaatcacttgtctttttatcctccaagattatttaatgagtcatgacattgtgcaaaatctcaattttatcctaggggtaaaattgtcatttttttctcccttaacggtgtatgactaacgactgactaacaccgatggcatataaggaagaaaatgagtcgttcaatggtatattgtagaaccgagcattgtcaatggcatcttgtagaacccgcgctttgtcgatggcatagaatggaaaataatgtatatgtttaaataatgtgaaaatgatctggagataatgatttaacattgcttgcatattgagttctaaaaaataacaaaattataaatgatttgtcatgtttgcattatatttaaactactttagataataattgttagtggatgatgatgtggcacacttgtatgtgatttaaaatactttagataataattaatagtgagtgatgacgtggcacacttgcatgttgatctttagaagttagtgggcatcaactatatagatagtatagataagttaattttttggtctcttaacttgacaccaagttcgattttcaaccttgaaccaaaaaccagatacaacaagcctcccaacttacaaaaccagtgcaaacgagatccctcaacagtattgttaccaggtttggctgacttggcacctacgtggctactttgactagttcttcatctcacatgatattgatatggcgcttacgtgacagtttgatcccggaaaaaaatttaaacccatggagcccacatatcaattacaacaaaaaaaaattacagtggcgaccatgtgggacccacatatcaaccggttgagttagcgtgagacccatgcgggcccccgcatgtcagccgcgggtgaatcctcaaccagtcgacgctctcctcgtgcattagtggcggtggcggctggagcagtggccggccctagggagagtggattcgttgggcctcaagtggatctcgtcgctgggatgccgacaatgatttccctcattgcgatggtcatcggcagcggtagccggttgatgatatcttttgtctgactgacatgtgggccccatatttttattttattttttatttttttgcttctagtgccatgtcactgtcacgtaggacaaggatcaagtcgaattagccacatagatgccacgtcaatcaaaaccgtcattcaaaccgtattgggatcttatttgactggttttaacaattgaggggagaagaccgaacttgctgtcaagttaagggagctaaatgaacttattccaacgtactatatgcgcatgaggcccatattccgatagcaagtccggctaggaattatttgggcctcactcctcaggctctaagtagactctcctcctactggctagtggctacgtactgcccttccctttgcgagcttgtacttacttcctgaattgatttggccgagattattaaatcttttgacggcagctagtgatgttaacagtacaagtgtataacacccagaaaagatgggcagaacaacacctgtaacaaaagttcaggtgtttggcatgcttaaaaccaaaggtaaacttgctgaaatggtgaaaccacatgacacatattttcaggtttagtggagtccatcgcgttgatggggtatatctttggccaaaaagtgaactcactcttctccgttcagcagcggggagcgtgtagattacagcacgcatgcaagcttagtgctcgtcagagaactaatcactaatatatccagccgctgatttctcatcgaagacataattaaaattgtttgcacgctgatctgatcacagaagcgattgatgcatgcaaggtgtggcgacgtggagagcccaacacggaaccaccaaggatggggggcgcacgcagagcttgctgtgctgcgtgctgctgctgcgtatgcgtgcctcctgggatacaccgtgtgatagatctggcagccccatccgacctctcgccctataaattgggctaccggccggcgtcttttgttcatcacctccacctcgcaaacagaaccagtactttaatttcaccttgcaaattcagttgaattcggctcgttcaggttcagtcgtttgatcatcatggccagtatggccaagtcgctcttgtgcatctcgctcgtcgccatcctgctcctcgtcgaggtaattaatcagatatttcaaactgatcttttaacctaaacgaaacggtttcctgaattgtatatatttcagttactgatccgatcctgtttatttcttgtttggtcttcagactactgctccacatggacaagcttacgccatcggtaagcaatgcgtgatctagttcagtttttcttttccctttttttctgatctgtgtgagtgtgatgaactgatgagttgcatgcaaatgtatgtaatctcgtgtagattgcggggcgaagtgcgggtaccggtgcagcaagtcggggcggccgaagatgtgcctgagagcatgcggcacctgctgccagcgctgcggctgcgtgccgccgggcacctccggcaacgagaacgtctgcccctgctacgccaacatgaccacccacaacggccgccacaagtgcccttgatcatctcgaccaatatatcaccgctcgatcaccgcgccgccgctttgctatccaaccgaccggtgatgatacatggcggcaaccttgtgatgatcctagctagctagatgtgctacctacttcgtgcctgcatgcatgtagcttgcatatgcatgctagctttgctatatcgcgtatttgctacttggaatatgtatgatgtgtgtgcatatatatgtggcgtgtcgtgatcgatcgatcgatcgaccgtgtacgagcaaataagtaatataatgaagtatttgcttttatgattaaattgcgtagcaactttttcagttttgccttgctatgcatggttgggaaaagcttggggtatagtagcgcgattactagcaacgatgcacgaaaaccattttgtgcgtgtgcgtgcgtgtcagctattcagcaagagaaatcatgactggcacggcttacaagggaagattgctcgtacgtacgctagctactctcgatcacacgggtgcattgtagctttggcacttcgctgcatgtgaccaatatatggcagcaaatctgggtgcagacgaggcactagaagagtaggtgcagccaaaacacgggtcggcgtcgtcagccaccgatctaccaaacgcctgacagtgttaagccaaactaaccacaacttaaacgacggcgcagaagtaaactgtcgcgtgctcatgcgtagcagggcccaagaatgcactaacaaagacagaggcctaatccatcgggcctggcccagctagcaacggaagtgaacgcggtaataagctgcttgtggaatacgttcacattaggtccctcaatttgtcgcccagtctgattttcatcctcagttcgaaaaaccggtatattgcatcccccaacttacaaaaccagtgcaaacgaggttcctatgtggtattgacctcggttttgactgacgtggatacgtggcatcttttgactaagtcttcgtcctacgtggcgttgacgtggcacttatgtggcagtttgatccggaaaaaataaaattggaaaataaaaaattacaacaaaagatgtgaggcccatatattagtcaaacaaaataaaaatatgtaagtgggtcgtactacctccacctcaccccctctctctatcccctatgggtcccaatgggggtcaatggcgacgcaaggcagcagtggcggaagtggcctgcgaggcagcaaggagggagctgcggcgttccggtggcggagaaaaggatggaggtgagggagccgatgagccgaaggaggaggccgagccgcatcggggcgacgcggctaccaccagcagtggcgacggaggaggagaaggcgcgggtggggaaggcggcgagggcagtagggtcaatgctagcagtgccttgcgggcaagccctggtggacggggaagggtcgggttttttttttttttgggggggggggagggggcggcggcggcggtggaggggcggagatggcagcttcgatgttgagaatgaccgcttcacccggcgccgcccactgcccctatgttccactcggtgcctggcacccgccgttgctccgcccaccgccccgccaacgctccgcttccacccaccgcccctctgctccgcttggcgcctgccgtcactctgcccaccgccctccgccgctccacttccacccgccgttgctccgcttccaccctgccgcccgccatcgctccgcccaccactccacttccactcgctgcccctttgctccgcccactactttgcgccgccgcttgccttttgcagtgtaggggagaaagagagagaggggggtgagggaagaggggggatgacatgtgggaccacatgggccccacctttttaaacttttttgtgtgtggttgacatgtgggtcctacagtttttattattttttgagatccaattgacacgttgttgatgcgaaaaacatacactttgcttttgaaaagcaaactctctccaaatcctcttcgattttaacttcgaatccgatctatgatttgccaaatttggtcgttaacacacgtaagcgccatgtcaatgccacatgggatgatgacctagtcaaagggagccacataggtgccatgtcatccaaaaccgagcataatactgctgagggacctattctgcacggttttgtgagttgatggatgcgttgtatctggttttctggactaaggatgaaaattagactaggcgacaaactgagggatctagagtgaacttattactaaacttgttgaagcagagaggggggggggtgttaaatgtcgtcccccctattcggcctaaacagtttagaggacaagggtgaaacatgcgactatagtgaggtgcagggcgagagaggaaatgagagattgagtgagagagggatgcctgcgaaaatactttaagtgattggaatgtaacttttaaacttgtaaatgttgagaatacaaaaaataattgataacagtgtgattatgtgagctgtagtacctactttcgtataaaaaaataacttataggaatgaatctgcgcaagcattatgttcatccatataaattggttttttgaacggagggtgtagattctagattaatgtgttagatgtcgaactttatattttctttaactttaactatagtaaacagtaattttatggaattcactcattttttctcattgagaatttgatctgcaccataaaactgcaattgccaattgcatgctggaattcacacaatttatttagggcccatttgattcaaagaattttatgtagaaatttcataggattcaaatcctataggaatttttcctgtgtgaccatttgattcaagaaagctttcaaattctataaaattcctatggaatggctcattgcacatggattttggaggaatcttagcaagagctacaacctcttagaaaattttcttcgagtctatctttctcatccaatttctatgttttttatgtagttcactcaaacggcaattcctgtgtttttcctgtgttttataaaactctgatttacatttatttttttatcagaattatgtgttttttatacctttatttttttcgatcctaccattcgaagtgcacttagttgcgaagtgtcattaaatttcgagaaaccacagatcgatcagatccaagtccaacgatcaactactccacctcccgctacaagccttcagcgcccaaatcgagtgcctacctttatctctcacctttcgcaaatcgcagccggccgccgctgtagtagcaaacatctccttcgtcttccctacgcgtccacccgaaaaagaaaaaaaaaagaacaggagaattatccccacttccagagtccaaacctccccgtccatggcgacggcgagctcgatccggccgccacgcgcggcgctagtcctcctcctgctcgcgctgtccttctccctcaccctcgccgcccacttcgagggctttggctccgacgacctccactccgcccacgccgacgcggcctcggcagacgacgaagacgacgaggggctcgacgtcgagctcccgccgccgccgcgcatctccctctccacttcaactccttcccctcccgtcaccaccaccaccaccaccacctccgctccaaaccctaaccccgatcccaacccgacgctgaccccgccgaaccccaccccgacgctcgatctctgggacgaggacgagttcgagggcatccctgtcccggaagcggcctcctccgacgaatcctccacgccggcggaagccgccccgtcagatcccgcggccgatgccgcggccgaggcggcgccagccccgccccggcggcccgcggagctgctccgcgcgtacaccgtcgagatcgcgtgcgtcagcttcctgatctgcttcctgctcaactacttcaccgggaagcggcagaacgaggcgatcgcgctcgcctgggccaccaggttcgccaccagggactccatcttcgacaagaacttcagcctcctcggcaccggcgacggcaaggacacgccgctcctgatgaaggaagggcaggacgtgttcaagttctacgcgagcgggaggcggtactgccaggggatgctcgccaccatggagatgcgcgcgcggcacgacctgctgtccaagctggtggagctggtgttccccaggaaggacaccatcacgttcgaggtggtgatgaacgaggaagccatggaccacgtcatgttggccgtggcgaggaagaaggcggccaagacgatgcagaaggaggagagggatctgcagaaatttgccggggttctgacctcggcacccgccgggaggagatgggttgcggatgagcttgcggtagtggccgagtcaaaggaggttgctggggatatgattactgaagccgtgctggaccaggtgatgatttaacctgcttacttatttttagaattgctgtttttagcttcggtggtactgggtaaatggttcttctggtaagattgtacagatgatatagtgaggtgtcctgttgatgttgattcttttatgaaagtaatataggtaagtgccttctaaaacgaaacggtatatattacaaattatcatcaaataatttggaagtgagaaaggtgcaatattcgacattcgagaaacatctcactcccttcaattatatcattaatcactaacttcaatatggatgaagtgtaaaggaattaaattgtgaattgatctgagtttcttactttttgggtgaattggcaccaattggattctattatgttcataactattcttgtaccaagattttcccagaatagtaactgtggatcaagtaatgtgatgatggcttgtattatcatttcattatgtttgtaatttaataatatcatcaggcttttgcataaggcagtgttgatattgaacatgccatatttgtcttgggaaagtcggggtactgttcctagctgttgatgttttgcacatttggatagcgaagaacttagggagtaccttgaatttttgactgctagagttctaccaaagtcgccatctatatcttttttaacgactgaagtagcctgtcttaatgctatgataaagaaaattagatggaaggtttagtaattaaggattgacatagctttgctcagaattttgtcatgggctggctcaatatgatccgcatgtctttagtaagactgagcaatgctatacagtggcatacatatataatgttttacaacctgtttctctgcaggtccttggtgacaaagcttttgagaaatttgggaaatggttcatctcacttcatttttcagatcaactggcaggctcttacaagaaagtcctttctttcaagtttgtactgccagatgcaagcaacatggctgagatgacaagattagttgctctcgtgccatactacattgatttggtggggcgttacaagctcagcaaccatgtgagtatctcctctatctttgttttaggccacaaccatttttcggttacagtgtctaattcttcttattcatggtaattgcaggctcgttccaaaactgaagctgcaagaacaaaagcttcccaggaggctttcagggagcaacagggtctaaggcaggaagcccttcaaaggaagaaggctgagaagaaaaaacttatggaagaggcagaggccaaattgagcgccgaggcactccgcaagaaagaggaaaaagaaagggctcgtcagatgaagaagtccatgcccaaagttaaaatgctccgttcctagtaacatcaaagatatatcacagcactggctttagctattcagttgctgattagcttattgttgcctgccagactcttttatgttcttctgggccatcaacttttctttgccatggggggatacaagcgaaaggaaataggtgaagataatcttttgctgttgtttcagcttgtcgcttgttgggggattaatttgaaacgctgttttccttgtattaatatacgcaggctggaatggcgtcaagtttgatttgcccccacgatcgttcattttagttcatctgaatgttgttatgcagcagctcgtttgtaagagaactccatgacttgctgtgtaatgcgtttatagatacgctgccagaaactcaagactagatcacataatttgagttgatttatgagtaaatctcatctatgcatgtcttctactggttgaagcagtaataactgttgggattgtcgtatactgtgttatgcagcgctgtttggcaccgctctaactcgagtttttatggagctccagattaagatcatcactgttctttactttcgtgtaaaatcagattattggatttctttattcataataaactctattttctgcaaaagttcttgagttgcagtcttgccaaacagagcctggtcaccaattgtcaaataacagatctgcctactcatgctgtgtttttcccctttgctacctcacagttccttttttttttgcacgcgcgctttcgcttttcaaactattaaacggtgtgttttttttttcaaaaattcttaatatgaaagttgctttaaaaaatcatactactctattttcaagttcttttagactaatacttagttaatcacgcttggatttgtctacttattaagatatgttctttccccttctttctcagctcatcttcctctttccttaagcatgccttttcaaacggctaaacatcctctttcgttaagcatgctttttcaaactgctaaacaatgtattttttgtaaaagttttctataggaaagttgtttaaaaaaatcatattatctatatttaagtacttaataacaccgggcttgtttggtttgctatcatgccaaaatattggcaataccaaatcattggcaaattttggtagtaacaaatgttttggcaacttatgtgtcttattggcatattttggtagcaaaccaaacactagccaaactactatttaaaataccaacaatttggtagggcatcattttagcatcaaaccaaaatggcccaccgtttctcgtgcggggaactcagccttactatgtgtgtcatccaacatctctatgataaattttggagaaaatttgcgaaggtaaacgttgcaaatatgcaggcaaccgaatcatcgcaacaactctcggcagcacatctcccctcttcttcctgagtactctgggccaatctgccgccctccgccgcacgcgccatccgatggaggaggcgcaggccgccgtgatggcgcacctggaccaggtctcgggcctcgtccaggcgctctccgccgagctccgccgcgggatcggccccgccgccgacagccttctcgccttcgtccgcgccgtcgactggacggtaactaactccccgatccccagattagcggagatcaccgatttccagccgccgcgccgcgccgcctcctttctcttttgctgatgattcgcgtgccttgtgcttgtggcactgaggctatttcaggaaccatggctgatttgcttgatggtattccatgcgactctgttgctcacggccgtcgggttgaggaggaatgccaatttccagctcttcatgctgtttcttgcctgtgagttttcttgtttctttttgcatatttttgcagtatgtttaggactgagacattgtcgtcggagaagagaggctagggtataataatattttggtagtataatcttccatttgcataaaccgaaccttgtcgtagtaattgggtcaatagcaactaacagtttaaccgagttactgcatttgcttaaactttagcacatacagcgctcacctagatgctgctttgagcacaaagaagttaaagcagaattggccactaaacctttctaaagatgtgatgccttggcagttggcacaagacaaatattcaggatatcgcaatgcgaactatgataagggtttgagtggaaagaatgtgataaaattatgtcaggaggctaaaacttgtaatgtgaaaggaatgcataaggctgaaacttgtaatatgaaacagagggagtgcactataaatgatcaacattttattattctgtcaataatgtagaattagagtattcttggtgtctgctagtgtgccactcaaagtctactacagagcttgagtttgtggctattgtgagtttctataattggtatcttctcaattctgatattaggaagagacaacggatatctcaggacgttaggtggcagtaaattatctagaataaaaacctggttgtttgattgatcagagtaggctgcttggtttgattaattgtctgattggttccatggttgcctatctgcagattcaggagtttatcttgctgaaaagataaatagctatatggcagagcactggaagagcattgccacacgaaattacttcgaccgcgctggagtttttgtttctgtcgtctggtcgggtccccttatcttcatatctatggtcattgtggttagtaaaagaccttccattccctgttattaaagtccttattaattagttggtgttatgctctctatctatttgcagttcatcttgtatgcatattgaacactttttactattccaggttagctcccttattacattatgtcggttgatggtgaaatggaagagagcagaactaaggcatcgggctcagcttgctcgtgacaaacaggattgactgaaaggttccttagtctggtagaagaaatgattagagacatgcgtcttctagaattgtaactgttggtgtttaatcacctgatgtttttcagttgcttgctgctagtaacttactgcgtcggttatattctggtgttcatgaactctagtaacagctaaaaacagaaatactagacccagtatctgatttcatcatgttttggttcagtagccacgaacatggatgtgtaattttatttaaaatcgattgtgataaattgcaaactgcatccttgtgctagctgtatttaccgtgaaattatacatggcgacctcttatagttataaactaaatagagacaagttagtgggggtacccgtgggtggatccacttccatccctacctctccacagaagtttcacattagctaaatccctcactgatcccctataaacattgtaaatgtagttagaataacaaagtagtgcagagtagaagaaatgcagaaccagtaaaatactgggaaatgtttagtaattccaactacagaaaattacagaggaattgaatcattgcatgacagcatgttacacctatataatttattttcttaggaactgatacacaaatatgaactgttgttgccagcattttacatactacacgtgaaacaattatgtgtatgtactgtaagcataattgccttagtttcataaccgtttagcaggcaaagaattcctgaactttttcctaaacaagataaaacccagggcaccaaggaaaggccaagatgttacaaaagcaatgtaagtaagcaaccaaacagatctcccctgcgatcgaatgagctgattaatggatatctttacaggagcaatagcatcctggattttatctatgttttgttttggctgttcctgtgatcctacaggaccttgggctggcgtcacattctcttgtgacctattaccgtcacactcattctgtatttctgtggcgattccatcctgttgcacaccaaccatgccattgcggagttccatttcattggaaataggattatctgagtcactattgttggcatcatcatttgtcaccgcagttaccatcccatcttccatgaaattcacatatgggcttttatcaatggatgattccaacgaagtgtgcaagctgtgttcttgtgcctgcattcaactacatgttatatcatgtattcatgctatcgtacgccagtttgcgatttaataatctctaccttttgccgatgcatgcaggggctatcatgtagagcaagtagaaactcagaaacagctcccacccacctaccaaatattcataaaggaacacactgacttaatcgctattggataataatgtatattgaagaaacatcacaagtgaaaaatggaggtgtgagtggaaagcggattaaagaattgtcttttcatccctgcccaattatatccccgcacaaaatagtataatttagccgcttgcacctcaaaatacataatttttgtgtttataaatgtatattacttctacttatctaaaatatcctacaaattatcaactacaactaaaacaagctttccccggtaatcgcaattccttacaaatatctattttcaagtttcttagaccatgaacagaaaggtaacggtactttgtccttactattcataataggggcaaacaacataccacagctttccagcagttagcccttgaaaaaaggcaagatggccaccgttaggtgcagttgccaaaacaatgtttttgtttgccctgaatcacacaatgtggacctcatcaatacacaataaaactttaggatggtgatcttttgaaagaaaagtaagcttacctgcattcgtcccagggaatggcctcccttgtgcaaagtgggtcatcaagagcactgatacaaagcaggggcactgacacattactaatgtaatttgcactgctgcaccgacggtagaatgtgtccactgtctgacaaatttatactgatgcaagttagaggcttactggtgttaaaagtagattaagaggcttactggcagttcaatttgaattttgcttatttgttacaaaattggatttgatgcactagcttatggtcaattctgatcacatccctttgaaaatcaaaggtggtaaattaatttggtccatttatgtttgaaccaaatagttgtatgttgctttgccagtccacctctaccttcaaatgtaattggaacagcacaatgctatttgatttgatctaagtatctaactcatgatattaagcaatgctaaaatatttagcaggtacactagcattagaaagaatacctcatattttgcaaccacacaagtggcatgacggtcgaattccctgatagatcgtgactgaaaaaatgaaatagaagatgataggataagtacaaatttgtgtaaccagccaattaatttaaagggacaattgctcttttgacccttaaaagtaatctactgtagcctctgtgaactacaatatataacccttttttatggaaactgaaacaacactcaatactttgtcatggttcacagggaaagttccaatgtacagtacatactatatacacatgagataatagaacaacagggtcagtcagtcaatgtacctttctaatatcttcccagttagcaagtcttgccaagacgggttggtgtctgcaaaaacaaaatggggagaaaactcagtagttgagtatgaagaaaaagtgcattcaccatctttggttgtcattacgcagcacgggcttatactacatccgttgctctggatgatggtgcgagactgctaagcctaaacattttatcaggacatttgcatattcggtatattatgtatcaattaaattcattaacattgttagaaattacaaaaagtaagaaaaatcagagttaatgcagatggaaatgggtttaatggtctgaatgtaaacatgtactacctccgtcccagaataagttaatctattactagatgtggacatatcctaatactatgaatctagtaaggaggtagtacttcaagttattgtcctctaatcagattatcagtaaatggagtgtacattctgcagttgtggcacttgtactagaactgaagatggtaactactcgagagttagtgctgcaagaatttgctacaagacctagtatcttcttacggcacagatcagttacagatcacaatatgaaataccccgattactccaactatcacataactatgagaaaattccttcaatgtagtctggacctcactagaatagtcgagtgccttaacagttcagctagcaacagctatttgctcttcaagtatcagatcacaagtttaagcaacaattcatcagaaaggtccaaacatttccttagggctcacatgggattggaaactcatcagtcaccatcaaagcaaagccataagggagatgtggtctacagtaaatttctcgagagtaagaagaaatacaaaaaaacaactgttcagggaacataaacttcatatttactaatttaatcattcttggttgactgcaagcagaagttctttactggacgtcccaccctctcctcattctcttatttgatatttgtcaattagtgctggtttctctcctaccacttaacaaaaagccctcttgaccctccaaatccccataagacagcacttgacgataggcaacgagtaagaccattatgtgggttctgtcgcaatgagcaacatgatcacaaagccacactaatcaaactgcttgtacctaacatataaactctaacccaggatactagtctacaattgtccacaagattgtatgggatgcaggcccttgataccatgagctcaagaatagtgtctcatcttgatttgtccacaatgaaattaattttaacaaagatcataaacacacatttcaattgatataggcaagaacttggatctttagctaaaggtgcaaaacgcaaaccatcattgccattgtattttatttgaaatgcaaatcaaataaattgaaaaaggatttatttgataatcactaaaccttgattagcacaaactatagtaattcaatgaataaaggttgtggcaagttgtatacaatgttagtcttgtttaaatgcttagctggtaaagaagcgtaatgagaacatacagttttgcatatcctttcagaccaattgcaagagctttgtcataacatcgttgcacaagcttgcgctgaataaatctgttggtcacctgcaatattgattgatataacaaaatattacggatagatgtaagaaaacaattaagaagtattggtgtgaaatgaaacactagaagaggatattatttgctatttgttatttcattaagtgagacacagcgaaattgttagcaaacaaaaatataggtatcataatgcaaaattgtgtttcaaaacaaataaacattatttatgcataaaataatatctatagaaccataaaaaaaaattcaaaaaaaaaaaaaaactgtagacgctgaccagcagatcccagggtgagcaaatagatacagcaccagccacaggggtaccctcaccttcttctccgagatacttaacctaaaagggcaacagatgaaaacaacataaacaaattgcagctcacttttacaatatcaactacagtgtatagcagagtgcgtgcatgcgtggagtgagagcaagcaagagagattatgcaaaacaaaacagaagatcttaagaacagacaaagtctaccagaatattggcacctatgcttgtcccaacagcaaataatggagcctgtggatacttctgatgaaggtaattgacaatctcacggaaatcttctgtccatccagcattgtagaagcaatcagactgcaagaataaatactaggttgaggaacaagtaccacctgaacatttttcatcaactgctaccaaattgatgattctgggacataattttcctggagtcagaacatgtattcaaggattttctaatttccacatcagcatcattgattgatggtttaggcctaacaccatttcacccattttcactttcatgcacatatcatgtaatagactgggaatatggaccacatggttcaaaagcttaataaaaaaaaaatgttcaagtggttcaaaacaggaatatgcagtgtctttacatttgctatcaatcctaatatctaccttataagacaaacatgaatcattcagctaacagaatttaagggagcacaagtaacaaatgtgctttccaccatatttaatcttatgacactggttaattaattgcttgtcctcgtacggaaggtgcagatcgacagtaagcttcagcaatgcctctctcgaaacttctgccctgtagttcattttatcatccttttgtctttggactttagtttagacaagcatggctattaaaaccaatcagttaaagcagatgacaccatcgatttttcaatgctgcatatcactatagaataggaggaaacttacagttatggagatgccacccagacccctatgattgcctacaacaacattccaccctttgcttgccatagaaaagaccaagtgcttcacatactgcaacagacagctgcatcttgtttagaacaattagggaaggtagcccaaatacctaaaattgattttatggaaaattccagattgtgtttaaaccaaagtttggtagagaaatcatagggacttacagcagcagtagaatcactagttaatccaggtatcacaacaacaagaggcgtcgaatcatccctagagataactccatcacaaaaaccaacatcttcttctgcaacatagaactaactatcaggcatctctagcctattgatctgaagctatccaacaaaaacatcagcaccttcacaatcagaggctagtaaccaatccaaagcaatggtcccaccatcgcgaactgtgtacagctgcctgtgttatagagttcaatgaatatgggaaactaatttcataactaagaatttaataaatatggcaaactaatgtcataactagctgcagcaccgttccaagtttaatttgtaatgtccaaccaaaacagaacatgagtctctaccttatagtagctgatcttactgaacttggaactggaactcatgagaatactaaataccaatatatatcatataataataaaggaacagcatgccgcaattctgcatataccagatttcgcacaaaagtttattgccccttatttttatacaaaatggtgcgcaacaatcataacttcatagggaaaaaaggaagctaaaaccgcacaagcatatccatattgagaagtttcaagtgataccgttaggccattgagccatcagaacagtccattaacatctcataccaatgtacaatcaaacaaatactcacgttggtgcagagagaccgtagacaaatgcaacgagtaaatgcacaattccaagacatgaatttactcctacctcctatacgtgaacgaagggggtctcccagagatgctcaggaacagtgtctgcaaatgagggctcgcaagccacggcgtcgccaagtacctacgcgaccgaccagcgttcccgatgttagcgatgacatcgcaaaaaaatattccgacgaatccacacaactcggagttctctcatctcacctgccatggagggagcggcacttggatgcgacgcggtggtagacgtgggaggcggggtggaaggtgagcgcgacgcggcccccgcggaggccgcggaggaggtcgccgatgaggtggagctcgaggaagcggtacagtaaggcgcaggcgaggaggagggcggcgagggcgtagtgcgccggcggcaccagcgccgccgcgcggagcagcagctcggcggccgaatcgccggcggccgcgtttcccatcgggttgggggggagggagggacgggacggagttggatgccaacttgcgaattgcgattgcgagcgatggtcagacacgtgagcccgtttcgtcggttaagaaatgggcgcttggtggggcccaccttgcgagaggtattccccactgtgcggagctgggaagacactgactagtgggcccatgcgtatttttgtcgtaaacgattattgttactacttcctccgtttcacaatataaaactttctagcattgtctacattcatcatataatgaatctagacatatgtatgtgttagattcattacatctatatgtatatggacaatgctaaaaagtcttacattgtgaaacggaaggagtactacttttgcgaatgtgaataacaaagcaaatacgaagacagggaaggtcttccacaggtgcaaactcagcaacatgaagacccaaaattctaaaagagaataacattagatcaacacatagttatatatagtatcaaatgatcttgttatacattagtgcattacagccttttttttaatactcattacaaacttaggatacaagctaaaagatcattgtatccactggggatgtacaggtgttgcatctcttattgttactaccatatagtattacaaccatgccatgagatgcacacaccagaaacacttgcattacactaccttatcagctaggccggtacactacacaagactaaaggtgttcattgtgccagtgccagccccgggtccatggagctggtatgtctggcttggtacaacctgaagaacacctggttgctctgcaacaaaagaggcaggagccaaatcagacgtaaggatacaaacagaagtgcaaatggcccaagtacgattcgcactattggcgactttagcatacatacttcagaaacttaaccaaaatccaaagaaatcatgtgccgtattgtaatctataaccacacgacactggcatgtacattagataagttttacttgattaatgataaaaagaacagtacactaagaaatccggtagctgcttggtcatagatagcgtatatgtaagatcgaatcatgttagaaatataagttaaaatggtattaataaaatccacggtgaaaagaaaaaccttgcatatataatcctagaaaatgaacagatgcaagtccagttcataaggaataggttttatttgcaaatatcttatcagtttggcaaatacttacaataacagctaagagcatcagaattcacaaatatccttcaataggattgttcatactatatgggataagtaggatgtaaattgatacatcctggtctacaaaggaaatattgtacttcctggttccaaagtaccaaatattacatgacaaatatgactgaagcacattattatggggcaatgaagaattagttatagttataatgtacaatccccgaacaggttcttagtagcttacaatcctatgatttgtgagtgtgcacttaagcctgaacctgggcttgtgagagaaaagaatgattgctttcgcaattattgcaacggaagactacagtgtgaaagaaactttgataaccatcaacattaccacagaacatcaccaatcaatcacacctaagtccaaagatctaaaagcttaaggatcatacttaattttactcaacaagatggaagttattcagtacggccgctgtattacagattgacaaatgatacatttatgttccaataagaatttgagactccgatgttcatccattggtttggtgccagccaaaaaccagatttattcctctcgtttcattttccagatatagaagaacggtaaacgggcataattctgaaagaaaaataggatagagtactcactcttgagctcctcgacctgctggggagtaagttttgcagagaaaccgcttgcggcgtgcttgtagtggtagagcaccgcctcctttgccttctcctcgctgcaatcaaccaaccccaaaatcagcaaatcgccatacaatccacacctctcagaaaaccctattcctacccagtatcaccacggtcatattggagctaatcgagcccccagaaggacacaagtttctatctcaatcgaaccaccggaatccaaactcctacaaccggagcaacatagatcgcacaaatagtagaaacaaccaggcgggggatccaaattccgcgagtatacctgccgaggacgggggcgagggtgcggatgtggaactcctcggggtcggcgtccgcggggcggtccaggtagacgatctgcacggtcgcctcctgcgccgcgggggccgcctgctccggctgctcggccgacatggcgatctggggaacggatgctgccgccgcgaggaagatgaggaggaggattgggaaggagttgctgagaacgctcgaggatttggtcttcatcacccgtggattccgaggtcttaatagccgtgatattctcgttctcttccgcgttatcttggcttgatttgctttgccttctcgacgaagtttttatttttcttcttctcccccacaagtttttgcagtttggcttcacaaggtttggtttattctataaaaaggttttctgtgttagatttaattgaggaaaaaaaggttttcttctgggataagaaaaggggaaaataaaagaagcttgtatgattatgaagcttttctcggattacacctcattctctttcatattatctgtttgcttattaggtaggcagagtcaccacaagaggaagaacttttttcaatgggataaacacatggcatgatttctcatattttttccaatccgtgataagtagtgtgatggcaattcacaagtattgaaaatataatggttttgtttgaagccaatggtaatgcaaatgtggcaaaatttcttcacaatggaacgaaatttgacattattttttttaagataataaaatataatcctgacctttgctcacagaattacagctaattattaaaaaaaagtttcaaacataatcacacctcaaaagaagacataatagggacacatccaaactgatagagacgcacaccggtactaacaccaatagaaaaaaaataaaacgcacatttattgaattctatctgtgaacctccagccaaaattggcaaaaagttgcacaaccgttcagtctcattgtttaataagccaaacggcatatttgcaaacgagaagtatttgtaaacaaaacttttatatactccctccgtcctataatataacagattttagagggatgtgacactgagcctgtccagattcatagtcctaggaagtgtcacatccctccaaaatacattatattatggaacggaggtagtatgttcttagcaacctaaaagctaaggctgaaagataaacttcaatgaaaaaacaatccaaaaatcaacttcaaatttaagattgaaaatttaaattttcgttgataagcataagcataagcgaaaagatgaggccggttgactccagtttgcgacatgcaacttttattaatttagtgtcatcatcacacttttgtagaataacctatgatcgaagccaatatgttacactgaaaagtacatgcaaataagatttaaatgatattttatgaactctgatatcatatttataataaactaaatatgagcaatatatctctctcctatcaacaaattgatagtttcaaattttaccaagattttaacgctactaagtactaacaaatgggtacgtagagaaccaaactaccgaatgacgaaacaagaacattaaacttgtaaatcattttattccaataataatttgaagagcctcgtataaccaggttcatatacgagaagagtagaacagtgtgctcctctgctgctctgcatctcccaacgaaagcaacacaatcactcaatcagggtgtgaatgatcctgccgtccgctacgagccgaggcaatcaaatgaccgtttgatcactactatcccaggcccagattaaggcgtgaaaagtctatgcgaaggccccagcttgggcccagccatctgggccgcttcatgggccgtagaacaatcctacttactcgccgaattttttttatttataattttttttattaaaagttttacaaaaataattttccattttgaaaattgacggaaggagtcgcctaccgccttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgca

SEQ ID NO: 53671 - DNA, 6822 bp, Oryza sativa
gggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacacacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcattgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctatttttgtacgaaaacatcaccccgtcataacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatctctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtactcccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctatttattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcacccttgcggagggcggcaagggggccgcctgcaaaattccatgccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccttcccagagggcggtaggcgactacttccgtcaattttcaaaatggaaaattatttttgtaaaacttttaataaaaaaaattaaaaataaaaaaaattccttactcgccatcgaaatctcgattcgtagccgaacggattacgactgacgggggtcggagaagaaaattccgaacccccaccaaccttcgcaaccacctgcgtggctgcgtggtttcccatgggccatgggccatgggcaccgaggaggtataatcctgctttggttaaagaccacaacagagagactccttagctggttcaagtgtctccaatttccatcggaggaggttacccatcggacgtctaataaaaaacgaaatatcggccgcctctcacagcccttagtagcagcgcacctagcactacatttaaagcgcaagagcatgcagctacatgtgctagcctgtgtatgcagcatgtacggctactagcactatattataatgtacacatatatttttattctttgaactcttttctcttaaaatatatatttgatatgtaatttgattgcatcattagatttgttataataaaatctttataacaagatctcatatggctatattttgatataaaaaactactgaaacatcatgaaatgcttattgcaacaacagctatatgtgacatttcaaaaacccattgcaacaaaaaaaaactttaaagtgcaacatagtccatatctaattgaaacatttgtttctcattgagtgaaacactgaattttaacagtagaaacatatatatttttttcgtcagaatataatcatgcaagatttaataacaacaaatataccacaataatcggatcatgaatcgcataattagtttggaagaaaaatagttttaaagatcatgtctcaatttgcatgttcctatatacttgcatgcaagttgtgcatgcatacggctgagtaaaagtaacttggaaagagaaaccaggaaaaacaccaggaaaggtaaatcaattttagactagtatagaggaggaagctggcgtccgatgtttgtcttcccgtcggacgcgcgacacgaagcattttccatttccatctggtgttcagttgcccatcgagatattaatgccatcgataaaagcaacttcctagtttctagaaatgccattgcacaagcctctttctcccaaaaataccatcaccgtcaattcaacaccattacaaccgttatttttttttaacaatgaccattttcccctcagtgcagaatatacccagtttttatggtaaaagaaaaagagagatgaaacagtgaaaatttctaaccctaaccctagaacgatcctgatccaggcggctctcctagcggcagctcggtgcagggctcggtgacagcgatgaggcgtcggtccacggtggcggcatggcggtccatagcggcgatggggcaggacgcggcgaggaggtcgcaggcggcggtgcggctatccatagcggcgatggtgcggggctcggcgacggtccacggcggcggcgcaacggtccacagcggccgcaagggagaggcgggtttctagcggcggaagcccccaccgatggctccgtccctgctcctcctcccagagaatagctactggacctcggagtggagatggcaccgccgccgtactcgcctcacgaaccaggagcaatgacattggcctcggggtttcttctttctctttgtgctcgcttcccgccgatgtccagtggtaggttaagtttcttttggatttctcttccgatgcagagatactgagttgctgcctctgcagtggtgtttgccagttgctcctcctcgtgtggaggtgcagcgcgtccggacgaggcgaatgtgtgaaattggtttgtgaatttgatttatgtgaatttaattctaaaataatttgattgatagcaaaattgatgtctgtatttagatgctaacagaaatatggatcaatgcaaaataatgttgtgtgagcaaacaatgcaaatgatgttgtgtgagcaaatggttgcctggggtaaaattgtcttttcatacaacttaacggagagatgttaataacagtttgactgtgatggtatttttgggagaaagatgcaatggcatttttaggaagatgcttttgtcgatggtatttctgggattatggtgcttgtcgatggtatttcatggattttctcttaaaaaataatctaggaagtcggtcgatcctactgttcatggtcatgccaaccatggcaccgaccattttggatggacctgaaaacatggtagcgatctatcttctttaggcttttaaccaggcaaaagctatgttgatgcacagatgcactccaaagagtactgctatacgtacgacccagttgtacaacgatagacatgcaaccatagatcaattaaaggagagcatcttcatatgcactgtggccgtttacaactattgatcaaatccaatcgtacgtgaatcggacaattgggtcgtatgcatagaaaaatttcactccaaattatccagattattaagagatgctttgccgcacacaatggaaaatctctttatccaaaagacaatcggatggattcatgtacaaaacatctctccttcagagtgaatcttaagatcacacatacatattcgactaaaattatgttccaagatgcaaaaaggtataatttagactacattgtatctgcagccagaattgcatacaacctaccaaacgcaaactacatagcgatgcaattatcaacatgcccgaccttacaagtagcaccatctagccgatgctaagtgctttcatattcggagtttccttctcttggacctcccttagaatcttgtcacattcatcttcctcttcctcgttctcttctggcccctcctcctcttcctgcatttcctcttcatctgatctgtaatcaatatagccatcgccgaatgatttgggtattttctgcgcttcttccatgaaagtcatgatttctccactagtttgggctgagaaagtagggaaatagtcattctttgtgaagtagatagattgtgcctcttctgtgagctccctcgggaaattcttcaagaaccatggatggttctttatttcctgcatggtgattctctatacaggaaaagaaaagagctcatcgaacttgagttctagagtaagaccacagctcgatatggctcattcactagtatggtttaccacatgccataattaatcaccacatgaaaataaagtcacttatggatatcaatatggaaaccgagataaatgttaacttgcgttcattaccttcgatggatcactgacaaagattcgtgatatgagttctctgcaatcagtagatatgtggacttgctgtggtatctcatattgaattgcttttattagctgcaaacgaagataagccgccggaattcatgagtgtaaacaagaccgcaaatatattcacagaaatgccaatgaaatatatccatgagattataggactgagctatcaccttgacggtcttcataatattcttgggatcatccttgtcttcaatgagtaggcccccacaagcatgacatagagagtaaccccacacgaccatacatctgcaagctacaatataaaaatacacttgtcactaattaattaactgtgctgtctaaaaaacaggatgtcacgcccagaaattcccgaatagaattccaagcaaaatgtgcattaaaacccccgtcgaggaccggccggggtacacaaacgacaaagtcgacatacagatccacgtcttacaaacattataaaagt

SEQ ID NO: 53672 - DNA, 1731 bp, Oryza sativa
ccatccacctgaactaatcaattccattacactagactagggtgaggctaatcacggtgaatctggttgaccgctcataaccgcgggcacggctattcgaatagtttcactctgatcagaggtgtacaactgtacccacaagacacagccccacgacacgtttccgtgtgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcacacccttgcctggatgagtcaactagaggaaagctacactacaagcccagccgttgcccacgctggcttgtggtaagtacgaggaattcttccagggtttcccgcgaaccggtccttaagtgccatgggcgcgaccatcaaaaccatgcacccacagcccaccataaggtatattttaattgactaacaccaggacggcggctttaatccaacaccaacactagaacctgaagtctatgcattaatgtgatttcccccacggtgtgctagttgaactaagcatggctaagcaatccctagtccaatctttagtcatgttatatcccaagctaacaaaggagcatggtacaaaagtagcatggctgtaacagtaggtaaacatcccatagtatcattataaaacaatgcagtatttaaaggaaaacggtagagcatttgcaatataggatcaacatgttcaagtgacaagcatgacttgccttctctgctgctggaggaacctcggcgactatttcaaagtacaccggagcgtcgggagagccggaatctaagcgacatacaaagcaaataatacaaacatgctataagactactaaaacagcgaacaaaaccatttttaatggattctatgcacttttcttgatttactgagacttgaatgggcttaaacggagctcggatgaattagatatgaattttagaagattcgctgtgtttttactataaccagaaaaatccttaattgatttattgcgcaataattaaaatcccggggagagagagggcggcgtcgacatgcgggccccacttggcagtgactcggggggagggcggtccgcggtggaccgggtccacggaccggggaaggagcagcgcaccacgtggtgcacacgtggcgtcgacacggcgcacacgtggcggccacatggcagccacgcgggcggcggggttggatggccccgatctacccgagggtagatcggacggcggcgggagcgcgtggccggcgcgcacgggcggctcaagccggcccggcggccatggcgcacggcggcggcgcaaggcggcgatcagctggcggcggtgtcgtggcgacgcggacggcgacagcggcggctaagcggtgagagagagagagagagagaggaagaggaggaggggcctcaccgacgacgattgacgatggcgagcgacggagggcgatggcgacgacgggacgagctccggaaccacctagcgaacacgaagaaaggggttagagagagagagagagagaggaagatggaagagggcgaggacgccggccgaaggcggcagccatggcggagctcaccggcgcgcggtgcgaacggggttcccgcggcggaaagcg

SEQ ID NO: 53673 - DNA, 4428 bp, Oryza sativa
gcgggattcaaaaattgaatcctggacgtctcgagcgcgggcgcgggcgggaaagagagggagtgggcgcggggaaggcgggcgcgggcggcgatgtgggcaacgttgcccgggaggcacgggagcgagggggcggcggtggttgcgggatgcgcggcggcgactggaggttgggggaggacccgacaggtgggccccacttgtcggtgaccctgggagagaggaggggggctcgggcggccggctgggccgtggccttcggccggcccagcggggagggggaggaatatgggctggcggcccattgggaaaaggagggaaaaaggaaaaagaaaaaaaaaagaaggaaatgaattttcctgggattaaatactgcttgtgctcgtttttaattggttaaaattatttctagagctttgaaaattccactaaaaatcttgttagcatatttcgacatgtagaactcaagaaaaattccacatgccaattctgattattatttgcattaatttattagggtttctctcttgcttttacactgatattttctctaggcgatttataaattcaatttaggcttgggaaaagaaattcagggtgtgacacaggagtaccattgtaaagtaagagatatatcttctatctgagttttcaattggtgataacaaagtatgcaaccaatcagttaaatcattactaaaagttcatttcagccctgcagtgcttatctttccaaaactgtgtaactgtactatgaattaagagatcatagtagagtatagcacactaacgctggttgaacttctctcttgtttacaacattactccaaaatcatcttcaagaagaatctaacatgctatacacacaggaactaaacctatctcaaagggaaaaaaaacaatgacaaggtcatccacaatttgtcaattttagttagtgtaactagtaccatgattcaatcaatagtaactgtgttgaaactagaaacgatatcatactctgtaagtcaaaactattcttgtgatgaaagcacatgaacgtataccattattcgcatatggcttgctaatgtgatggttcttggtacatcaaaccatatctgtgcaatagtctaggttaattaggcaatgccaaagtgcttagaaagtaataattctatatctaaataatcaacttgtacttccagttccaggtttttgctgacatggaaagtattaatatgcatgccataatgaaaggaaaataagaaaataagccatatatggaaccaagataaatgacgtgcttctgataaatgttaccaaagaaacatcaaagtacatatcataggtaaacaagaagctatttaactcaccttcccatcatactcctggaggtttagtatctctggtgcaatatatgccggagtcccaactgctgatttgggccttgaatgcaacattgatgactgttagaaatggcaaacaattattcctgttcaaactaaaaaagaactaaaagcatgagcaaactctgaataattggagacaaccttggagtacccaaaatcacatatcttcaggcgcggagctgcgctgccatccaagagaacattctccagcttcaaatctctatggcatattttctagaaagtagcgaagatggttgcaatatttaagcattttttcaggtcccactcacgttatttgagaaaacatactagcagtttctactacacatactacagagcaacatggaacattagattattgaatgtgctgataagataagaccaatttattgtttatccataccatgtgatggcaatagcttacaccccaaatcaattgctggaagaaatatctggcctgcattgagtagaagaaacaaactttagaagcataaaactttaaaaaatattattgaaatcaaaaccagagattatatattgtgacctcatcctcactaaatcgctcaagatcgacaatccgatcaaagagttctccaccagatgcatactccatcacgattgcaagatgtgtatgagttaggatcgcctgtgcaaattgaaaacaaagcattgtttattttgttccacacggcatgggattatgagagaaaggagtaagatcaaaaggagatcaaacttaaatgcacccataaaaccgagattaaaccataaagtgattagaatgaagaagaaacatggtacattccacaattgtcaccttcaaatagaaaacacatcaccaaaacccatcaaactagggaggaaaaaaaatacaaaatcgaatccttacccattcaatattcatgctcaagaaactagtaaatcatggcatagcagacaattaacccagacggacaaaacaatgagtgaacaatccctgactatctgctcctattttttctaaaccaaaaatgtttgctcctcatcaacaagacaacaatagatacacacctctatgaactggatgatgtttgggtgccgcagcgaacggtggttgatgatctcccggtacgcgctcttgttaatctgcgcaaaaaccaatccaaagccccatcagaacaaccaaatgttggccaccggatccacacgagcaagacccaccaaaccccagcctacaaccccaaaaccctattacgctagtgaagagggtagaaggactcggacccggtgattgccgcgtgggatggtcttgacggcgacgagctccccggtgtcgcggttgcacatcagccgtgtcaccccgaagttgcctgacccgatgctccgcacctcctcgtacgtgtccatgccggccggcgcacgcggcaacacacccgcacctacctagtggggagctgagcactctgatctgtctctcacgctgggggaggccaccgccaccgccgccggggagaggaggaggaggaggaggaggggagatcgacgaatcggtgattgagggatacaggtggaggcggcgtgtcgcgtgtgtcgctttgcggtgcatggcgcggcgtgccaggagcctgtgtgccttatatataggcactggcgcactgcgtgtgggggccactgtcactgccattggcgtgtataggaagaaagacgccgacgaccggttctgtggcacgacgagtacacagcagatgcttccgaaactgctactgtatgcaagtatgtacagtacataaataggggcaatagaggggtaataagtctactgcacgatcgatcgctagtccaacgtcccgcgcgatcacacgatcctacaaccccatgtgcggatgcgtgtttgttggacttcagtttggacattcctatttaacaacccatatattagcctatttttatttctcaggcattttcttagcccacatttgttttcttcaatgaacactatcttgtggtttagaaaaaaaattgtctgcaaagccttattttgttttcccggccattttttttgaaacaacccgcataagatagtatgatgtttctattgataaagaaggaataaaatacaagcctatagtcctgggagactatagtcaggaaaaagaaaataaacaaccacaccacgcttatacgtctgatcctattgtttaaaacaaaacaagcacacaacactctcaaaggaatatgacttctaaacgacgtctccaagaaggaaaacgacgccaaaagcgccgccgccgttcgtcctaggtaaccaggacaaggttttcacctgaagaacccactgggaaaatagaaaacacggcaacaccccaaggggaaaacggcgcccgcaggcgtcgccgttgccggcccgaaggctaggctttcgcccgttgttctactctcccgcgttaaaaagtgcatgccagttcagcagaaccaccatctaatccccttcgacgcgcagccaccgcgccgacgcctcgccgccggctagccatcgaagaagagtcctaaccttcaccgcgcttcacatccatccacgtggttgggttggagagggagagggtgagagagaagaatggatcccctctcccccgcactcgctcgtccactgtggccatctttcggcggcaagccgccaccgtaagagggcagacgcctggaaggaagcttgccacaggcttgaacacccaccctcacagcatgaccgtcgttgccgcctcgaccagaccgcccgtgtcaacgggtgcttggtcgcatcgccgtcgcctccatcttcctcaccgcagccatcgcctcaccgtcaccaccgccgacggccttcaccaccgccgatccgtcgcgccgtgcagccgtcccctgtcgggagctgtgccacgtcgccctccgccgttgtcggccgagccttcgctgcggtcgccaccgcggcctccacgcacgccggcctccgcagcctccagtcgcatcgccgttccgcggcctccgcacacgtcagcctccagccgcgtctccccgcgccatc

SEQ ID NO: 53674 - DNA, 13323 bp, Oryza sativa
taaattcactgaatcatgtgtctcatattttaccggtttatatttactgataggatgattctatttctcgttactggttttctcaacaaacaaaagttttacatgaagtattgttactttcacataaaatagtttattactgatgggagggttttattcttagtttctcgttttgagaagacagcaagttctcagcttttttttctgaagttctgacggatggcatagttagtactatggcattgcaatgggataattgaagcactgcaataagctggtaatagttttttttcccatctttgcaagaggaggcaacctatagggatggtgggatatttgtacttatcttttagccttaatatggacctgagttcttactgcagggagtgcaacaattccatgtaaccaaaagtatgaattggacacagtacagttcaagaacaggttcttctctacgaaaataaattggcaaggtaaggatacataggatgcaacagcacagtttgttgtagtcaatttgtaagcttcttgtagcaccacaaatgatattttagttgtttaaagaggataattgcaatcttttttatgcttaggctaccttagagttgaaaaaatctaggattgcaagagcattgcaagggagaacttctgaaaaggaactgtgagtacaaagaagagctcacaacaagtatagagttcttgcattgcattaacatatgattttttttaaaaaaatatttagtataatgtcattattgtttttcctagcaactaaagtctgcgattcagagaacaatactaatactattatgcacatacttctatcgtcttttggttggttgaaggatgaataataccaaatatcttcttttggttgaaggatgaattatatcaaatattgccgtaatgttagtacgggtatattactagtaggatgttgatgggtcgatttggatcccacctaacgattatgttcgtactcggttatggatattggatacgaatttgcattagaaactaggacgtgcacacttttagacattagtatggtattccgttggaatttctagaattttcatttgggaaaccatcccctctggacgtccgatgcagacacaggagctcctctacctttgggcacgacactccaatgtggttggcggacatgatgtgtaacgaggccagaatagacgtggggagcatctaaaaattttgccgtaagtttttttatgaaaaactttcaaatatagtgtagtataactgaaagagtaattacattgtaataacaatgcaattacactataactgcatcgtaactacactgtttttacgatataatttgtataaaacttctattcaactatggtttggttggatagcaccgagatcttaagcgtgatatgcgtgaaaatttatttctagcaatttttttcttcatgcgtaaatctagaggtgatccgatggtcacaaatgtgcaagtttttggagcaaaaaacttggagaagttatctagcaattctgtagacatggggtgacaagacaaaagcgagaggaggaccggaccgggatagagaggctagaggcttcgagtgcacccatgactgagggtgtttttgagacaagagaaaaatggaaattgagaatataagcaaaacgggtgtgcttgagagaatgaaaaatgaagattaaaaagttacgcaaaacgagataaaccgttagcatataattagtgaaaaaaaatgtaccatttagcaattcaaaaaatgtgtgcgcgaaggacgatgtattttttcttccaatgttttaggatagaatacaaccttagacatcagaatgggaagcctagttcccgtggatccgaccaattgagtagaggaaaaaagtgaatccggtcacaatagtagagtaagaaagtgaaccgtgggctattcacttgtgaacgcgtagaacattttattgttttgttctatctcgtggcactttatattatacaggtgtgttatcccgttgatcaaatggtacacatgataagttacatgtaccacggttcttttatcttgcatatagtggtttttgtatattataattatttgatatcgagtttcttccaattctctagcatttagttttatcatcggatttgttctcttcgcaccactacatgcattgtactcctgatgacggttgatgctgcgtatagtatagtttgtcgtaccgtaatttcttcgaactcgcgcctccctgagcagaaaaactgaaatcatgcacgcacatgttggaagtttgtcagcacctgtggcgtcggccacacgtataccgcacggcgtgacaatgccaaactgtggagacgatgcggtgcgatgtatggggggcatgtacactgaaatcggcgtttggccggtcgattagagcaggggagaggagaggagatggatggaggtgctccccgtcccagtcgacgccgacccgcaggggatcagagcgcgacgcgtgcatgccgttcgactgaacaaatatgcgaacgtatacgtacgtagcagtaggcaggcaggatcttagaggcaggggagccgggagcatgcagccggaaggtccctgtcacggacgctgtacgtccacttcacaccatgggaaattgggaatggctggacgtttgatcgttcagtttcgaagcataaacaggtcgtggatggctgggtgcagtgcagtgggaattgggaacagctgaatcgataggtctgtaactgggaaatctctgtcgcctggtggagtgactgtgggccttggcccatgcggagtgatgggcgaggccgtgcagggacaggtagcccgggcgaaatttggggccagttattagagcgagtacaataagcctagtcagctagcggcaaaatcatccacgtcattgaaatcttccgtggaagagagagaggaggggagagagagccaagcgggcgcttatttaagcgctaacgctaacacaataaacgatgctctatcacctgcttgcattgaaccaaaggtgcaagattatctgtggacccacgttacaaagactgaatgggttaggaattgagtaagctgatgacacgcatcattaaatcaaagtataaagaaagcataggcagtcgtgtagagaaaaatgatgaacaagctagtgtatacatctatctttgtggttaactctaatagtcgatgtgtatatttttacagccaactaccggctatattattagacctgctcttagatggacctcaagtacccaacaacttttttagtgagagttgagagtttgagaccacacctgcaagttgcagcttgcaggatcgagcgatcatcccttaattagggcctctttaacagcacctcaaaatccgacttttcattcttcaaataccaatttagacagcttgtcaaaaagttaaagatttaaatttatctttcactccaataacctctctattaccttctccaatctgatactagatcccacatgtcaatctctacccttcttcttcccctctctctaacaccacatctctttccttttcccacccacccgacagataaggaggtggtggtggttactgctcgtggcgagatggggagccagtgttcggcggcgccgtttggtgtgacaaatccgtgatggcagcggctcgcgcagtgaatcctcgaccgcgacagcggctactagcgcatccaacttcttcttcttcatccgggcagatatgacgttggcgacgacaactacaacatcggatggcgaccctgacgaggtctggcgatagacgacgatgacgatagccgtaacgattggcatatgggcccctccaatccgtccacggccatcatgctcaaggccactacttgctccgtcgttgctccttactcctccattagcaccgtcactgccactgtcggtgtcgctgcttgttggtgggcagcctgtgaagagagcaggaaggggaggaattggaaggagggatgggagaggtggtgggacccacctttagccagtggaggaggctagctacatttaggctgcgttcattatcctttgttcccaacacgaacaatgtgcacgaaaaacggagtggtccaacagctatttttttttcaaaaatggatcaatatgatttttaagtaacttttgtatagaaaattttttttttaaaaaaactacaccgtttaacagtttgggaagtgtgcgtgcagaaaacgaggcggagggagctggaaccagctagaacgaagctttaggctgcgttctttcaaaggagatttgggagagattgaggagattgtgacttgttttccgtgcgcacgcttcccaaactactagacggtgcgtttttttgtataaaatttctataggaaacttgctttaaaaaatcatattagtctatttttaaaatttaaaatagttaatactcaattaatcatgtgctaatggctcacctcgttttgcgtatcttaccaatcttctctatctcccctttctcaaactcagccttagtcatccaaaggagtggttttgctatccggatggagagtgtattgaagctatttctttttttttcgtgttagtcaaattttagcttagagagttaaatagacattttcgttggagatgctcttacctactcattgtgaaaataatacgaaaaagaaatgcacttatgcttgtaaaaataccttggtcaaatcatgcgcggttcacacttcacacgctcttgcaagtgatttgcaaatgctcgtgatcgtgcaggcatgtggtgcagcgaggtgactttggattccttcaaacgtacagccaacatctcttgcatatgtacaacaatcagctgccagcggggcaggaataggatctgtggtttatcccccatgagctatgatagctgcatgtccaacgagaagagagtcaaattaaatctcctagtctgccagacatattcacgacctatcttaattaatattccatctatttcaaaatcaaaatattgtaaactatttctgaattacacatagcttaatattatgaaatttaaacatatactggttcaaattcgtagtatttggttgtctaatccaaatagtaaattactactccagtgaaaatatagtactgcaacctagtaccggatcgagcacatcctagtattataaatatgaacaggatcaaacatatcctagtattacgaatatgaacaagagtaaccatgaacaaactcctatccaaattcaaagtagtaagatctatgtccagattcgtagcactagaatatgctcaattctattttgggatggagagaaagtagctacctatatcaattatattaattatttagcctcaacgaacatggcaccttgcacgtacgttcagctgtaaatgttctttgctgattgctaaccagaagagaagaaaccctggcagctcgatggcaataccttgattccttaaacaaagacgcatgcaactgccagtccctgctaacatgcccatggtaaaaacggacatttggaaacggaggcgcgccgaacatgcccagaacatgcatcatgtccctcatcctgttcgttgacttcaaccatgtgccgatcgaaccgtgtagttggtctatctctatataagctcacacaaatctgatctgtcaccacggataaagatcggacagagaggtgggaaggataaggatttccgggaaaatggacaagacggtgatcgtcgtctccgccgtcgtcgggtccctggggttgctgagcgccattctgggattcgccgccgagagcacaaagatcactgtaagcacattgccgatctctctcctggcccctgaagcgtacgttcttgcttcattggaatggatgcgccgtggcgcatatacgtggccaacaactgacagttgaacgatcgattttgcagatttcggacgtgcgggtttccggcgacgagtgcctgtacccgcagaacccctcgctaaggctggggctctgcgccgccgtattgctgcttctggcgcaggtcaccgtgtccgccatcggcggctgcggctgctgctgcggcaacggcaagccccgcggcatcccgtcctccaagaccaaccgggtcgtcggcatcgtcttcgccgttgcctcatggtgagcaaattaagcacgcagcgacgactgctttcatgcgcaacctcggtgtggtctcacgacaagtgtcgcgtgcgttcgtgcgtgcgtgcgtacaggatagcggcggtgatcgccgtagtgctgttcgtggagggggcggcgtggaacgccaacgtggcgagggacaccgcgccggtgtgctacttcctcaaggacggcgtcttcgcggccgcggccgtgctggccctcgccgccacggcgctcggtgtcgcctcctacgtcatgctccgcaggcagctgcccgacgacgacgacgacgcaccggcgggcgcggtcgcgtcctggaggcagccgctgctgcactccgggatcgcgatgggccacccgcagttcccgccgcatcctcaatggcattcgcaggtttagcacggtgtcaaccgcggatgaatcggaacagcctacgtgtgaagtcaaaccagagagttcaatctgaatcgagctggatgcggctagagaactactgattcatactcgactgcgggtccatcgacttagtcgagtcaaacataaacagtagtagtagaaatccagtagtcgatcattttccatcttgaactttgcttgatgtatcaattactctgcaatcacatgtccacaccctaagcaaacaagattgtgaataatatcgtagaaattaaagggatcctaatggagaggtttgataatttgaagtaaggcaggcgggtcagcccaacacacttttgggccaagctatagatggtgaaaatctatacttcatagactcatagtggacttctattctcaggcctcgggccatggccatggcttaggtggctcaaggcctcggtccgtctctgataggtcccaatttgcgaagcgttttaaaatttttttagtaggaacgaaatcattatgatgtaacctattcatccctccaagttagtaattgtgcatttttatattttggtgtgacaatataaaaacaatataaattgctcgaaatgataataattaatgacactcaaaagattgctgaatcgacggagctgcatggagacttacattgatcgtggaactccaactttgggggtctgaatttcactttgccgctaaacaaactaagtataatagccactagttcaaaaagaaaactttgacacatcgaccacctccaaattaccgcacaagctctgctactatgtgttaccatcagcatttttaataaaattataatgagaccatacctcaaaccaaataggtcaagggcccaaggtgtaggaccaaaaggccacttcactgcccctgtattctttgctgcgttcggcagcatgatattgtgagatagtttgtttcgtttttcacacgcacgctttccgaactactaaacggtgtattttttttacaaaagttttctatataaaagttgccttaaaaatcatattaattcatttttgaagtttaaaatagtttgtattgttaagatactagcccaactcaacaggctagctaagagctcactccaatcttgagttcacccctaattcgagtgcatgcgctattatattaagttgcgtacgtgccgcgggaaattcggactctgatccaaaaaaaaaaatgctctgagcttttaacttgtgcctcaaacttttatttcaaaatcacaaactttcatcttaaaatcacataaccttcaatccaaaaatttaaactttcatctaaaaatcacaaaacatctaattattcgagatctaaaactttattctcaaaatcacaaaactttcaattaaaacataaaacttttatcttaaaaatcacaaaacttcaaccaagaaaaatcaaataattgtcatctacatactcaaccttagacgtctccacgattcctccctcttttaagttggcctcagctatcactgcattcctggttgtggtacccagccaccaaccaaggctgtatccagtggcgaagctaagtagtgttatgggggttcctgggcacccggttgcaaaagaaaatttagtgcttaataccccttcgtaatcatatgtgcatccccctcagccaagtttggtgtacccccacgctagaaatcaggccattgaagcacgaacggcctacaaccacaacctcagtaggagcccaattcagtcctacttgccgcatcaccgtgaggacgtacgcacacgcacgcctcttctcgtttttttttctttctggcgactcgctcttcctctttttccctaccaacgccaacgcctcttgccgccaatgtcacaattaatcctggatgaataatcgatgccttagcaagatgaaaggatgtcaccgaggatgggcataggcaattcttttttttagaagagaaggttttttttacccaacctttatatgtcttatatccaaccggatatatagagcctaaattaggaatttagcctatcaaataaggaacttactctgaaataacccaatctgaaattcgctactacggagatttaaactcaggaccttggtgtgctactcacgtcactgcaaccactaggctatagggcacaggcaattccttgcctcctctatcttttgttcttttttactaattctttaccagtcaatcaattcattggaagagctccttcaccgtgagatataagttttcaattacgtgataatagctctctttttttttcggatcgaatggttatggttagtgcagtttttatctatgcttctttgttagtgcactccactgttatcgttgatgataacaacgcgaaaaaacattataatttactataatattgctttaaaatatatacattgtactatatagtggtgcacccccctccattcttctctagctccgcccttggctgtatcgcttcttcctgcatgcggaggtcacgtagtctgcgcctgcatcaccgcgttcatgcggaggtcgcggcgtcatccctgatcagcgtcgccctgtgtccttgcaacttcaccagtctttctcgatctctgcccagttgtttgcctccccttcttcggaaatggcgccatagctcgtcggctacttgccctttcttgtctggtgctgcttgtctcgtcatctatggagaagatgatgttgtagtttgccggctgcctatccttagcgctactctcactgccattaacccggggtgcggggatccggtgagggcaaggacgggaattgttttgcacccgatctatgctgagggggcagggacgggcacatgggtgctctttcccaacttagcccggacttgtcttgttgccacacctagataaggttgaggagctagggtgtggtggtgccacatggctagataaacacggtagatggacatggaggagctaagggttacaggaccacatcaagagtggagagggatggaaaatagtcggggatggagactgggacaatgaccgtggctaggcattcgtgatgaagctaatggatgggtgagggcgagcccctttatggctagatctgtcagctaacaatagaatcataagtgtgggggcacattgagaagtcaaataaaaatgagagacgagccatggaaactagaagataacgagaaccttcgatctctttggaccatatccataaaataaaattcatgcgtctaacgttgcgttgttcttatggaccgagtatgtgccccacacagctacaccaaatacaaatataattttgagtaagagtcatatgaagatttaaaattttaatagtgtgggaagttctgaaatttcttagttttagacattcacctattcattttttggtgataattcagcggtgtgccttcggcccaagactccaagaggacggaaggcggaactaccccagagaatccggagacagttttagcccaatcagacctcagaaggtgggcctcaatagtcagtaacgagttttcacaaacgaccagctgacgctcgcggtcgcgctgcgctggtgcggtggtgcctggtgcacctcctctttggcgcacggcacaatctcgattctcgagccctccccccgcgcgcgcgtatagctcgcggcgcacgggcggtcgggtcttcacgcggccacgggcgaaatgagccgcgcaaaatcgtggcactccgcgcgcttctctgaactgccgccggcgcggccactactacgcgcgcgggggtcagcctattccaaaatccaaagtcgtcgctaaaagagtagttttttttctccaaaccatgcgtggtgcaacagcgatatggactcgatctactgccccgatggaccttagcttaacacggctagttctggtcaatgccgaggtacaacgcaacggagaggctcgcagcctgcatgatctggctaccaatgggtttttttctcccaaaattagttggtggtggccattatagtggccgttgacacaacagagtatatcagaagcgcgccgtaacaagtagaatacgggggcattgtcaaatgtgtacacggtcttaaaattataaaggacaactagatagaagaagcagaagctatgtgcgccagctgcagcgcaactgtgtctaaagaaactcctttccctgtatatataaaacaagagcaaacagaatgtattaagcttgaaacagaaaactgggtcaactcgatcatatgcacaatcctgatattaattaacaatgcttgtgatcatggggagccatgtgagtgccgtgggtgactttggacttggtccatgtagtatatatttttaagtttgacaatgaggataagttataaatattactaagttgtacataccaggcgctacatagtttaacctaattatctaaaaaaacatagtttaacctaaagtctatgataacgtaagtgaattgttcgttttcctcgtcagtttaaactttggcaaatttcacccctaaaacatcgtggctatgtaattttagctattcaacacaagaaaaatcaagctttagaaaagacactcacattacgccgcctagaaccagttttttcttggggtgtgagggagggttaatttctccggtttgatgagttcgggtgtaaaatatctagtattagagttaagttagtaatttggattgttgcaaaactttaagtgtgtaatttagactattcttaatagataatagttaataagatagcgtatgtttttcttgtagtggactttataattaaactaaattatatagttaacgcattgttcagaagttttgcaattttcatttcatatcagatcatatattctatattttaccacctggtgatgttgctttttactccattgtttcgctttgacttttttcaatcaaactttttaggtttgaccaagtttataaaaaaattagcaacatttacaataccaaataagtttcgttaaatgtgatattgaatatattttgataatatgtttgttttgtattaaaagtattgctatattgctctataacttagccaaatttaaaaatcaaaatcaacttataatttgtgccccataagatgatgttttgtgctatggaattagtggaggaccaagagaaaccttgcttaatttgtttttcagttgtcctttcagtaagaggtgtgctgagagcgtttgggtatcaggtggaatactaattagaaatttgccaaatggtggtgttggctagaaaccatttaaggataaaaagtttcttggagattatgcgctttgcttgttggcacatttggaagcagtgaaatggccatgattttgacaacattcaaccatatttttaataggtggtttgttgcttttaagaatgaaattcttctacatgtttgaaaaatgagggatactcttagcacttccattcttagctagttacaaggtttgtaatttttgaggactttgtttttctttttttgttctttctctgtgcatatctttctgctcttaatatataactactgaataaagccctggtagtattttcaattaaaaaaaaggaacataatagtgaactaattgcatgcatggtttgatactttgatgcagtcagtgaacataattttgaaagcgaggctctgacctaaagaagccatcgaaccaaattttgtagaatagaaaaaaaattggtagaaattaaaagggggaacaaaatatgtgtggtggaattaaacaaactgtgaacccccgagaccttgcatatgtacagggaatagttaatgaaccagtcatggacacattaattacttacgccaacatggacacaaccacaacaacgtttatgcatcgtgcagcatggttgtgccattatattacgagctcctcccgtatattcccgttggtagtgtggcataaatatgtgccactcgaactgcgtcggagtctgtgatctagctcgcgagacctgtacataaatacacgcacgacgccaacattgtctcagccgggaagagaccaagagtccgatatggggaagaaagcgaaggcggccgccggctccggcgccggcaccagcgccgggcgtgaagaaccgatcgttgtcgcgattaaaatggacaagacgacgatcatcgtgtcgtcggtggttggttccctgggcgtgctcagcgccatcctggggttcgctgccgaggcggcaaagttcactgtaagcatgcatgcacgcactcatcttatcatctctctctctctctctctctctctctctctctctctcgcttcttgttgttcttttgttgaactgtgatgatgatcttgtttctgagtagatcttaatcatcaacgaacataatgacattttgttatgtgtctttgcaggattgtgcatcgtcgctcgggttggcgatcgcagcgaccatcttcctgatgatggcgcaggtcaccgttgcggccgtcggcggctgctgcgggtgctgcaagtcccgtgccgtcccgtccgagaccaagcggatcgtcggcgtcgtgtgcgcctcgatctcatggtgagttcatcaccattctcatcgatacgatatcatgagctcacggcattcatgcgcacgtacaacaaacgatagatcatcgcagactagcagattttctacacctagatatcatggcacccattatttacataagacacaaatagttatagaaaaaaattaaaaaaattagtaacatatcaattgtgatgatataagtatatagacaaacat

SEQ ID NO: 53675 - DNA, 13515 bp, Oryza sativa
acttgcatgtttgtatattgtcttatattatcaaagttcatcttatcgaattttataaattttttatataactgtttaaattacatgcatggcacctaggtgtagaaaatactttctcgttatttacaccctctcgctacgtcttccgtgcagggtggcggcggtgatcgcgtttgcgttgttcgtggacggatcaatcggcgcggcggtggcgtgcgtcggcctggtcggcgagttcgcgggcgcgggcgtgctggtcctcgtcgccacgggcctcgggatcacctcgtttatcatgctccgtatgcatccgcaggccggcgaggcggcggcagaccgggcggccccgcgggattacgacgacgacgaacccacgccgatcgggacgccgatagacatccacggattccggccgccgatgcctcctaaccctcaggtgcctgagccgttgccgaactatccaccgccaccgtactcccctgctcctgctcctgctccggctccggctgagggaaacggcaaccaattagcacccgaccagcagctcgcgcctcatccacaaggtcatgcgcaggtgtaggcgtgtagctgtaacatcgtgcacgcatttatcatcatctggtgttgaactgaatcgattaaggcctaacgcgacaaatgcaatgcccttgatcatacgtgctgccctgttttgcttatttttttattggtttgatttcaatgatttgtgtacgtgacatttatctatgcaccgaacgttactgttcaccattttttttccgaggactgttcaccctttcaagcaaggagattagtttgagttttattggagttccacgattttttcagattcatgccaggacgtacaacttattgatgtgaagtatatgtaaatgcaataaacttgttcactattattccctctgtttcatgttgtactctagatagtgtgatttttttttctagtcaaatctatttacgttttaccaaatgtttagacaaattagtaatatttataacagtaaatttgtttaattaaatataaacaaatatatttgacaatatatttgttttatattgaaaatatatttgttttaaaaaacttagtcaaacgtaaaaaagtttgactagaaaaaataaaagcgatttataacataaaacaaaacagagggagtaatttataaaagaaaatagcaacattatggtgaaaaaaaaatatctgcatgggctttcatccccatactgaggccatgatgacgagaacatcacttcatcagatacgaatgtaactctataagttccagttcggcctccgaaggcagtgctgattttcatgtcaactccgatttggatgatcttgggtttgttggaaagcttatctcgtcacctttcaaacgcatcatgtctcatatcaaaattcattccgagttaatagaaaacgtcaaaacaagacagtattgtatctgaaaccgaccttgagccttaggctttgtaatggagtaaactcatctaagaagtgactctctccacctctacgaactagcacctatctctaactttatttttctctataaatagatttgtacaacctaaaaaaacaattgggttttgtttagttgaattttttccaggtgtcattcaccttccctctaggcctcgctcaattattcggcgactatagattcagagcccccaatagttgatatgttgattggcgtgatcgattatatctatcacttcaatcgcaactatttttttatgccattgcatcctactttattcttgcaatgttctctcgtttgcattgcagagatcatcaaccgcacgtcatggttattggtatgccatcgtttgtggtttagcgattgcatgggtgtcctatacttattttggttagtagccacgtcgaaaacgtcatactcgatcaaagtaaaagttatctccttagaagatcaggtcaagagagagagagcacgccatcacatgacctagggtgtccggggtcagggttctctttgtgcccgtgcgctacatttctagttaataaaaagtcagaatgcagggtagatatataaaacgtagaataaaaaacgatccattgagttatgtagaaatcacgctgaccatgcccatatcacacatcgctgtttttacgagttgctcctgttggccgtagcataaaccgtgtgcccattgaactgtgtcagcgtgtaaccgagctctcgtgagacctctctatatataaacacgagacgccaatcttgtatcagccgcgaagagaaataagagtccgatatggttaagatcgaagcgcccgccgccgccggcctggaagaaccggccgccgtcctcgcgattaaaatggacaagacgacgatcatcgtgtccgcggtggttgggtcccttgggttgctcagcgccatcctgggattcgccgccgagggtgcgaagcgcaccaaggcaagttcttgctaacactagctacatattatctagactctagtggtatatatatgtttactgctttttttttttgaacttgatgactactgccttagtgattatatatgtgtttaatttccagcgttgcgaactcgacctgtacgacttgtactactcgtcgaactcatcgtcagcagcggtcgggctgggtgtctgcggggccatcttgctggtgataacacaggtcaccgtggctgccatcggcggctgctgcgggtgctgcaagtcccgcgccatcccgtccgagaccaagcggatcgtcggcgtcgtctgcgccgtcttctcctggtgagtcgtcgcgccccgcgcgcgtacgtgcatgctctgatcgacagattgcgcgcggtgttgtgatgccacgactcacgaacgtacgctggttgcgtacgtacgtacgtgcgtgcaggataacggcggtgatcgcgttcgtgttgttcctggacggcgcgatcgtggagtccaactgcgtcctcgtcaggggcggcttctttgcttccgcgggcgtgctgaccctcatcaccacggccctcgggatgacatcctacttcatgctccgcgcacagccggacgagcccgcggcgccggcggcgcggcgaccgccaggtccggcgggcggcgatgaacccacgccgatcgtcggggtcccgacggcggtcccggccgggttcccgccaccagtgtcgtcgcctaatcctctgctggtgcctgtacctgctgctcaagcgccgccgaaccagcagtttgctcatccggctaccagccaggcgctgccgcacgcgcggttcgctgatgcagctgttcctgatcctgctcctgctgctgctcaaggctatggatcgcaggcgtctaaccagcagcacttcccggctaatcctcgagggcgttcagaggtgtaacactgacttcacactgcgatcatcccgtgtgttggcttagaatcaagggactagccggctagtgtactgttcgtgaagtttgtatttgtgcttttctgtgtatgtgtgtgtgtgtgtgtgtgtgtgtgtgtgtgatgcatgcacgtgcttgctttctgatgtttggaaagtggcccttgattttaatttaaataatcaataattatgcattcaagaactacggacggttgtgattttctgaaggactacctaaaatggttcagcaagttttttatgggaatactttcacatttagctatagtgtatatagtgtaattgaattgtaattatttttttttaatgaaccagctagcacaagacaatactaatttcattgtatagagtaggagtaaaagtcacaaaggagtctggaaaagaaaaatgacttaaaagtgttttgaaggaattagggtaacatttttgagggtcttttcccttccactcgcgtctaagttttcccttcctcctttatcttagcaacaagaagccgttgggagctctctgtggtggagaacttgttagtttgtttcttttcaaatctcccaggacgttagtagcataaaagatcacgtcccaagtttgggtagcccttttcgtgtggcaattgccccccgccattttcgatcgtgttcatcgcctcccatgaccttggtattagttgtttcgcatgcaatttaagttgtaggcatgccctagattttttatatctataatccgctagtagatggaaagaagtttcaaacgcgtgacaacaaagtaggtagtatgtgttgtaaggtcattcccttgttgctaaatgtaattacattgtaactctatagtaattgtgttataactaatatgtaactaagtataaaatcaactagagaaaccacatctggttggttggctagcccccacgcgcccctcgcatgaagtggcaggttgcgcatggcgcaaaaaattcttccccaccccttgcatgaatctccatgcaatttgatggactacaaattgaaaattttgggaggaaaaaactgtcaaaggttatctagcaaatctgtttttgtttttaagttgcacagaagaaacacaccactatgcatgttgtactctagtgcctcctttagtaacacttactctctccgtaccaaaaaaaaatcaatataagagtggtcacatcccttcttaggttgattttttttagacggagggagtatatatttatatacatccaaactctcatgccacaccccttatcttgatgactttttttttccatatcccctattagagcaaggtgaataatatatacaatagttagctataaaaattgtaccatcatctatagtcgtcagtgatagtagttaaattatacattaggcaggttataatatataattctctcgtctctagacaaatatggtaaaatgtcgttggccagaaagtaattggcctcaatttttggtcttgggaggagtgttgcagtctggctacagtagtagcctacaattctctatcatccacccattagaaatttaacgttgcaattcttatagcatgttgatgtaggtttgttatatttgcccaaattagtctattagacaaatagacagatccaagtctacaccacagggtcaagcacaaaataccgaactgtaattgcaattattaatgtattaattgggccacttgatgacactttgttttgtctatgccttcctacacacagcatcaactaatataagcgagatagttatgacttaggaactgatcaaagtatccagaaaaatctgtaaagagtatactatagtgatatcacagttccattgccacgtgtaaggcacatagttctaattaaagaatcatgcttaattaataacattatggttgtccaagctaaccgatctacgtcctacagcttgcaaccatctacatgctcatcatatacataatcgcattatagaaagagatggcttaatttgtccaatgatttgactagctatgagtatttaacacatattatagttggctatatgtctccaataaaaggctagagagtgcgtccatatataatatttacgaatttcatgctaaaagagcacaagttgtgtcaatgtcttctgttggagtgatactatcgaatgtttaattaacgattgtgactgtgggtagcatagcgtggtgtgacttattcactactatagaaaaacacatagaggtcgacactttatataccgaaatagttaaaaccgctttcccgtccctgcgaggtgcaaaaaattatagaaccggcaccttttagaaactataggtgttggttttaaagaaaaatcgacaccaatactataaatgccgattttttaatgaagtttttaaaatattgacaaagaaaaccgacccgagctgagcgaccgatcgacacccatatatcacttgcgtccttatccattctcgtacccaccttccaatctctctctctctcgccgcccccttctcctctccctccgccccatctcgcctccctcgcggcgtactcactcacctcggcgtcccttggcggatccggcggccctcttccccctccctctccctccgtcccctcttgtctcccttcacaggtggcggctccctccaccacctctcacctccctcccgcggtggacccggtgatggcggcgtcggcagcaacggctctcccataggctgatccggcggcagtggctcctcccgtggtggatccagcagtggcgggagcagagaagtgcttggaagttcttctttcgtctgtttttagatgttgttgttgttgttctgtggtgtcggttccttttgtgattttgtgataatgactaatatgtgatggcaattttgactgttgagagttcgttgtggttgattttgggggcgaatcggggtcgattcgagccgatacatcgagcagatttttttttcatcccgagaatcttaaaggtaccggttcctaaaccggaacttttgagaattcacaaatgtgccgtctcctgctgctcccccctccctattgttgctttcaggttccatgatgaccagtttgcccaatctcagggctcaccactacttcagattagggcaagattttggattggtggaacctgcctaattgcactcctctgctctacagaagaaaaattgcacattactttcccctcatttgttctgctagcattggttcttcccctgccctctccgatgctgcggctggtgggcggcgggttgcggcaggcggcagcgggcagtgggtcgcgggctgcggcaccctcaactctgtgggatgtggtggccggcggcagcgcccgacgcagctgtcgcggagggcggcggccgaggctgcgggcgaaagcgtggccagggctggagagggcggtgaccgaggttgcggagggcggcggggcgtggctgtcacgaaggattttgtgttggaaatatatgtgttgattttgtgttgtaaatttggggatgatttttagatatttttgtgaatgattttgtgttgtaaatttgttgatgattttgtgatgtgaatgtggatgattttgtaaatgaggatgattttattctttagttcattttgaaatcaatattcaagcagaaagagaacaatggaaaaggaaaagaaaaaaaaatctttagtctcggttggtaccaatcgggactaaagatggcggagctgggcacgtggcttagccatctttagtcctgattgatattaccaaccgggactaaagattgacctttagtccccggtatttaaattgggactaaagatagcaatttttagttccagattcgtagcctcaatttgctacccgggactaaagggggttgcaaaccggggctacaaagggtttgtgcagcagttgtagggcgtttgtcatgaagaaagttccaattatagtattcatctataagaaattcagccaatatgagatactccctccgtcccataatataaggaattttaactttttgcttgcacagtttgaccattcgtcttattcaaaaaattttggaattattatttattttagagtgaattacgctttaggctacattttattacctaagttttactttggaccaccgttaaatatatcttttcactttgaaccggacaaatttgccatttttacgatttggatcaccacgaacgattatttttcagtacaatcaacggccttaaacacatcaactctagtatacgggccgggcgaacttctctatttatggttcatatgtttgtcttaagggaagttagacatgacaagaagagttgtttatggtagtccaaaccgcaacaattgtaaatttatccggtccaaattgaaaagatagatttaagggtggtccaaagtgaaacttgggtaataaaaggtggaccaaagtgtaatttactctttattttatttgtgacttactttattatctaaagtactttaagcacaacttttcgtcttttatatttgcacaaatcttttaaataagacgagtggtcaaagagtgcaagcaaaaagtcaaaatctcttatattatgggacggagggagtacaaaataaatatgtagctagagagagctaaataagaaatcttatacagctatatatatttttttaccttagacctgattaatagcactatgtacgttctatttatatttattgatacgggatacgccatgtgaaaagtgggggagtaaaagaaaatcctagctaactctaaaacccattctactaacctgacgagaggggatctagctcgttgggattgtcagccggtgacaaatttttgattctcttggatatcaactcgatgtgttttgtgttcgcttgagataccctttcatcccgacctaacatctccgtgcgtcagataggacataccgtggaggacaatggaaccaacttaagagaatgcaaccacagttttttagctagtccattttttttaaaaaaaaaattctccctgactaataaatgcaccctatgaataagtggatgatttgttggtcgacgcaatgaagtagtagctcagcaagtactagatttatccatggcaagtacgtgtatctccacacaatgggtaattcgcacattgacctccaggacgacaaaggcagccctttatgtatcaccgaagccaatggtaaattactcgatccgcgtaattaacagtcgtagtcgactagttgaccttatcatggtggactttcatcagctgatcattccggggtaatttcctactaccaagaggttgtgtttattgttgacctggtccttaggacaagttcaataattgagatcgatctgtgctatttcctagtttgtgtttattgttatgagatttttggatttagagattatctctgttggttttccgtatagaaattaaccttgtcaaattttgatgatgctaaattttaacataaccaaatctttacaagggaagatgctaaggtagtttttgtttgaagctttgccaaattttggatttaattttaaaagaagtttatggagttaccaaaatatgatagaggtaatgatagtggaggcatgctagtttattgcgtactcagtgtttaggctgaaattttcggccacacgtaaaatgagacaagtcattagcatgtaattaatagagtactaattatcataaatttgaaaatatatatttatttgtaggaaacatatcgtttagcggtttatgaacgttctaacagaaaacgtaaatagttgttccaaaaggctgaaatgaactcttgctaaggctaatttcttgctaaggctaatttcgactacaaactaaacatccttggatttattattgatttttgaaaaaaatatccattttactctcgcatactattccattggttcacttaattaactgtctaaactattttttactacttaatagcatttttttctttgtttctctttatatgagttgcattttaaactgaaatttagtagagccatagatggaaacattatcaaagttcaaaaataatttaaaaaaatttcatgagtatttgcttgaaatttaaaacctcgatatttaaatcagtctcaatacttaaacagtgataaaagaattcttaaaaatgctgataggtaagttataatgcatctatcaattctactaaatttcgttgcaaaattcaacttacatagagagaaaagaaaagagagaaacaccttttaggagtaacgtgttctattttcaatagttcagggtataaaatgaaaataagatgtttagggtaaaatgaacccatgaaatagttctagggaataaacaggacttttttcttgaatttttatgaagcaatacataacattattattattattattattattattattattattattattattattattattattattaaatgtataaccatttatatagcatgtagtaatagataaatgcatctacatctaagttgtaaattgactgttctcgatctaatgtactacatgaatccccaccaacttgcaagcatgttacagaatggaacatccacgaaggcattaattatggcgaacatggcctgttgcatcaaggccgttttattctaagctcctctcgttggcagtagcgtaaacctgcctatgccgtcatgccgatcattcgaactgcatcagcatgtgagtgtgtgaccgatgaccgatcgagctcgccagccctctatataaacagacgtaccatcgtacgggcacaacgccactgatccgtttctcaatatctgcctagaagacggatatctcgcgatcgatcgatcgacatggggcaaaatacggtagccgccggggcaggaacgaccgtagttgcgatcaaaatggacaagacgacgatcatcgtgtccgtcgtggtcggatccctggggttgctgagcgccatcctggggttcgccgccgagggctctaagctcactgtaagcgctagcaatgcacgcatgcatgcacactctgctcgtctttgaattaattctccctcttctttaatttgttctggatcttatcttactactccctccgtttcaaaatgtttgacgccgttgacattttaaaacatgtttgaccgttcgccttattcaaaaaatttaagtaattattaattcttttcctatcatttgattcattattaaatatatttttatgtaggcatataattttatatatttcacaaaagtttttgaataagacgaacgatcaaacatgtgctaaaaagtcaacggtgtcaaacattttgaaatagagggagtactatctaagtgatcagacaatgtcatgatgggaatgtgtcttgcagagttgcctatactcgtcgacgaacccatcggcgctcgggctgggcgtatgcgcggccatcttcctggtgatggcgcaggtcaccgtgacggccgtcggcggctgctgcggctgctgcaagtcccgcgccatcccgtccgagaccaagcggatcgtcggcgtcgtctgcgccgtcatctcatggtgagtagtactcgtcgtcgccgatctagccaaattaatcaaataatccacatatgtaattaaccacgcacactgcgcacacgacacgtgatcgcgtctcgtcaccatgatctcacatcacgtacgtcatgtacgttcgtttcttgcaccaggattgcggcggtgatcgcgttcgtgatgttcctggacgccgggatcgtggcgtcggagtgcttcatcgtcagggaaggcttcttcgccggcgccggggtgctggccctgatcgccacggcgctcgggctaacctcctacatcgtgctccgcccgcagcccgacgcggcggcggggagaggcgagcccacgccgatcgggatcccgatggacgctgttcccgggtacccgccgaggcctcctcatcctcctccgcagcaggtctaagcaatgcaccgtccgtcgacgacagtatcagcaatccggtttaattagtagcctaacgcggctacgcttgaagtttgtatttgtgtacccgttcttggttcaatattagtattatttctattgtgagatttatattcttccttagaaattgattaaaaccggccgggctctacaaccaaaaggatgtatacagacaaaatgacaaatgtatacgtgggatttatatctatccaaacaagatatatatgtaaccttaatttgaagtctagctacaattggaacttgaagattttttttcttttcagattcatgcaagcgcaattttttttgagtcaactgtgtgctagtagacttgatcttggactgaccgctgatcacgggctagctgatccaggactttaagttacttagattagattagcattatcagttagtattgagtattgaccacatataaagtatgcaccgtttaactcgaatccactagatatattaatatggcgctacattaatttattcacttctttactcagttaagagaaacttttaaaagaaatggctccattgcaacgtgcctcgtcatccaaaattgctaattagcgataaggcgcatatgctatgcgcaatcgcgttctggcccatcaaattttatacttttttacatactagcaaatatacccgtgcgttgcaacgggtgaaaaaacgtaatgataatatacgtttttcatgcataaccatatcgataacaatcagaaaattagaactacgaaactttattttctagcgcgttttcttttgtgcttttttctgacatttttccctcacgtgtttttttaaaccgtttttattttctcgcgcattttttccttttttaatataccgtagaaacttctctttttatagttagattagattagattagagataaagaagatatataaatggattaaaaaacgacgaatataaatttgacttttttcctccgcgcttttttccgtccttttaattttttttctcgtgcatttcttttacgaagggttttttttcaccactttcacatagtgtcaaacctttctagatataataggattcgattttttttaccgcatcacgtataattcctttttctttagaaacagacaattttttcgcccttttttatcgcgtcaacggagtcggaatcgttttgattttttcccctttttttggatcggacagatttttttttgcccggtttatttcgcccgatcgattttttttaccgcgtcacatataattccttttactttggatttttttcgccctttttttaccgcgtcgacggagtcggattcgttttgattttttttctccctttactttggaattttttcgccctgttttcaccacgtcgacggagtcggattcgttttgattttttcccctttttggctttttttggataggacagatttgtttttttttcgccccgtttttttatcggacttttatctttttttcgcctggtttttttattttttttaccgcgtcacatataattcctttttctttatcggaaagtttttttcgcctttttttaccgcgtcgatggagtcagattcttttcagctttttccttttcttttatcggacaaattttttttcgcccatttttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttccttttttttgctttcttttttgtcggacagatttgttttttttccacccggtttttttccgcccaggtttttttatcggacttttctttttttttttgctccacgatacatataattcatttttctttggaataggacagttttctttttatttttttaaactctttttaccgcgtcgatgtagtcggattcgtttcggtattttttccttttttttttgtcggacatatttgttttttttccgcccggttttttttcgccaggtttttttatcggacttttcttttttttttcgctcggtttttttctcccgttttt

SEQ ID NO: 53676 - DNA, 6985 bp, Oryza sativa
attcattaagcggtttgtctctcggacttttttttccctttttaagggatcgggtgtttttttgccagggacgggtgtttttttcgcccggttttttttttcacttttttttggatcggacttttttttcgtccggtttttttgatcggacaaacttggttttttctgcccggttttttttcacccggtttttttgacggacgatggaagcacctcttattttttaagtagtagtagatatgtgtacaagaagttggtatgtatacatatatatatacaaagttgatatgtatatgtattttttttacattcaaatcatatacacatgtttatacatatataaatatttttataagtgtatatacataatttatacatataaagtataaactttatatgtacaaagtttatacatatataaacaaatatacttgcatgtttatatacgtataggttgggaggcggttggtgcaggcgtgtggttagccacgtatcagaatcctgctagggatcgcctcctatatcatgtcttagccatcaaccgcagccagaataaccaacaatgcggtacctcaccaatcttcgaatgaccaaccttacacctctaccagcaccggaaaacggcgatcaaacaccgactgctctgccaccacatgcaagctggctaggaacgagtattgtacccataattcactgcacctcaaggctagcatgacacaactacataggcgcaaacgcttaggtatactccctctatattaaaataaacatcatatcccatactatatttgtttttttagatgaagggagcggcatcatgcatgaccacgaccatatcagccgcttgttgtcgttccatcatggcctatatgtaaagaccatttttttaataagatgccttttgaaaataaaaaaggactaaaatagaacgctcattattcttacacttccattcttatcctatatatctatacaattgatccttacttagtgtagttaataggattttgcagccttctcgtgtttccacgtcatcctaagtgttcttagacgttcgatctccatccggtggcaggtaagctgtctaggcaatactagaaactaggaacggcaggaagcccccacgtcttcatctaatgggccaaatcaagggcaggcctagcccaactcatccgattaatacagcctttagtaagtacaatcctctattctagatcgtttccacgctccctgggcagggacgccgcctcccgattgcgttcttgcgataaagatgatatatggcgtcatgaattcctcctgtagtgcctaatctgaaagctaatctgtccgtcctaaaagccgtctagcagtagtaatttctcacaagagtcaccattaaggtgaaggtgagaggccatggctaatccaactgatcctcttcgttatccttctacgattcgtctattaatattgctttctccatctaggggtaccatacgcaccacggcattgttatcacagctcacatctctgtcgtgatcgccacagttcaatccaccaacaaatcaacaatcacagatcaggtgagtatgcatcctccaaatcactgctatggctccttcaggcttcagttttccagtcaaatgtttagtttttatccattgtctgtagttgtgtataacattacagaccaatttttcatcatagtgttaattaaatcaacctccttccgttgcatcttgtattgttcttcctagctgattgcaagttttaggtacccattgttctagttctattaaatttgcttctacccctctcatttacacgtacaggaataagttagtggtgatagtcgacaatcaggccaagcaaggtgaacaaaaatactagagatatgattaagctcattcttaccttcggaatgtaacacccttagtattgttatattttcttatttgcactgcttcaatatagacttttttttttttgctatctttacaatgaagcaaggcactggtttctcatcaaataaatgactgacagtatcactgggagcttatttccatcttccctgctcaatttctcctaccattggccatcacatggatcacctacaacaagcaggttatctcttatcattgataaacaaatttatctttacatatctctttcgaatgacaacattttccattcttttttttttcacaacactatcatatcttccctactttacaatatggccaatatctaaaactgtttccttcaggacaagatgattttctttcttctattaatttcattacagagatctaaagtagatatatggctacaattaaacaactgtatctatcaacaccacatgaccgatcgaagacatcggcaatctaccattgagtcacatttgcagcatcgcatacataaaaaaggagtactccacgtcaagtggttatcactaattgaagacaaattaatagcagatcgctacgttacaacattagacagttttcatatgttctcttttgctgtgtgatagcatctataatttctcacagttcaatcaacattgatcgtctaaagcctttcttttttataatggatcgtctacaagttactatatgttatttaatatttttattgtgcttgctaatatgttttaggtcttacacaaattatagctacaaattcccgcagcaacgcgcggggtatcatctagtttcctttacacttacttccattctctcctttgctcgtgatgccaactgctttctcacactttgtaagaagaaagaaaattcaagtgcagtcattatcgttgatactaactctaatgtaaacttttatatatgttatttgagatttaaaagctaattgtaaaaataaattatgatgtaaaaatttcaaaatcaactccaaaattatgatttataattcaaaaaaaatgataacagcttataagctgaaagccaaacaatgaggatgtggatttttagtcctgcctctttgagtatttaagatctcactgccagggatgaatctaggcccagcccgaggcctagagcgaaatgcatagaaggatagttattttttcagtatgtaatcattatgtaatgtccaaatagtctttatgagttggcccgagccttgggccagtactgggtctattcctgttcaatgcaatttgagagggagcctaacgcgtgcacctctccccacttgacgcactcgccctgctttagtccactactgtttttttatacatatgtatatactttgtatacatatgtgtgtgtacaacatgatgagtgtggggtggtggtaacctgacccaaaacggtttgaggaaccttgctgcggatgcccttaggtggtactgcagtgataaaacgagagaaagtgtgaagccagtcattgctcattggcaaagggcgcgtgcattaggattatcaaacggatcatgtgtgcaaattttagcactattcatatactccctctgttcgtaaatataagggatacactattcccgtgtaacgtttgaccattcgttttattcaaaatatttgtgccaatataacaaagaaaagttgtgcttaaagtactttggataataaagtaaatcacaaataaaatggataataattttaaattttttttaataagacgaatagtcaaacggtgaaagtaaaatattaaaatctcttatattcacagatgggggggagtagtatacacaaatttagccgtgattggtgacctggagtatataataggtggtgaactagtaataggttaccaaatttccaaaccattagattctcccaaaaccaacggtctctctatagtgtgttgcctgctggtgtgccttgaaaggttccaacaaattgtgaatcctcggcacctgcctccatatatacagtgcataattaataaaccgatcgtggagacattaatatatacagtaataatgttaatttatgcatcatgcaacatgcaaggctgtgttaattactaggagctcctcctgttctcccgttgatatgtagcggcataaatcttcagcttcagacctccatataaacagacgttcgagaatagacaccaattattctcttcctggaagacagagggtccactattgggggaaaaaattggcggccgccggcgatcggtagaaccgaccggacacgtacgtacgtcgtcgcgattaaaatggacaagacgacggtcatcgtgtccgcggtggctgcttcccttggcgcgctcagcgccatcctggggttcgctgccgatgccgcaaagcacagtgtaagcttatatgcgtgcgcacactgctcatctctcaatctcaatctccttttatttttcttctccttctgtagagtgctcttgtagaacattgatatatacatcttgttgaactcaggtgaggtagcagatcttactatcatatatgtatcttgcaggattgcgcatcagcgcttgggatggcggtggccgcgtcaatcttcctgatgatggcgaaggtcaccgtggcggccggcggcggctgccgcgagtcccgcgccgtcgtcccgtccgcgaccaagcggaccgtcgccgtcgcttgcgccgccatctcgtggtgagtcaccaccgatcgatctgctcggtcaggtaattaaactgcacgtgcactacgcgtgatcgatcgatcgtcgccttgatctcacgcgcgtcacgtacgtgtgtgcactgtgcaccatatgctgcgtgatagtacaggattgcgacggtgatcgcgttcgtgatgttcctggacaccggcggcatcagcgttgtccacggctcgtcgtcgagatcagcagcggccgagctgggaatctgcgcggccatcttcctgatgataacacacgtcgccatggctgctgccggctgctgctgccgcagcttctgcatcccctccgagacggcgcgggtcgtctgcgccatcacctcatggtgagtgatccatcgatcgtcacacgcgcagtacgcggttgtcgctgctacggtcacatacaacggcaagcgcccggttgttgcgtcgttgcgtgcaggatagtgccggtgattgtgttcgtgttgctcctacacgccgcggtcgaggagtctgattgcgacaagatccacaagggcgtctacgctggcacgggcgtactggtcctcgtctccacggtgctcggaatcatctcctacctcatgctccgcacgcggccagagccaacgccgccgatcgtggtcccgatggtcatcgcgttccagccggtatatcctaatcctcttctggtgcctgtgccggttcaagcgccgccgccgaaccaggcgttcgctcatccggctactttgccgccacaaggaggatggtacgggcaagcaccgaaccagcaattcgcggcacctgctcctgctcaaggctatggatggcaagcgccgaaccagcaacatttcccatgcgcaggtgtagtaccgtgacctcagaatatcaccctgtgttgactcgaaccaagggcgtagttataaattcgtgtcgtacattctgtatatccgatacggataattttaccgtacaatatttgatacctcgagagtaccaaatgtactactacacatcaggactgtagcactacatgctaggctgctagctttcttaagtttggaaaatgtgattttacgtgttggtttgtaatgtcgtctttctcttccaacacatttggcatgtactttttccatcccaaaataattgctcttaagtacgatttaaattttatgatcgagatacatgcaccctacatctgtactttgtagtagtacatgctagctctcttaagtttggaaagtgacgattttacgagctggtttgtggtgtagcctttctcatacaatgcatttggcatgtactttctccatcccaaaatagttttctaaacgatttaaattttatgttaaaataattatcacgttggattactacttgccccatcaaccatcttccattcaaatttagtatgtaaataaattagaaaagatggaaccttatcaatctctaccaacaattgatagattcaaacccttccactcacctaacacgtaccattaaaatttgataagatcataattaaaacctatcgatgattattttttcaattacggttttgtgttttgagtaaatggggttgtgaatctataaacccctccttcactaagaagatgattacctgaattaaaagctaagacaaatcacatggaaatatcagtcctatttttactctcctactttatcaatatatacgaggcaaagctttttccttcttttaacaaaaaaattgtttcaggtgttccattactcagtgaaaaatgtttcattgtttagtaaaaaaatgtttcacacatatgtgacattgaaaaaatgtaattgcaacatcgagagcctattgtgtggaacatcaaagaaaaaatattgcacatcaacatctaaccaaaagataatgaaacatggaacaaacatacacactagactgcagcaaaccgagagttgagtcacgagcatgcagcaacaacacatgcctggaaggagacgctggcgaagctttcgagaggacatggtggccaagcttggagagctccttggtggatggggacgacgcctcctcccacagtctccatgctcattagagacgccgtcgttggtgaggtcatcgttgttgtacctccttccacagccttgacgctcgtcatgggggacaccgccggcgacgaggtcatcgtacctcctccatatcctcaaagcttgtcgttagggatgccgccatcgacgatatcatcttcgtcgtaccttcttccatagcctcaacgctcatcacgaggggcgtctctgccgccgaggtcgtccactagtacaggaatgatttttctggacgtgactcattttggattgcagacgcaccgtaagtggtcgcgtctgcaaaaatcgtgctccattttggcgtgc

SEQ ID NO: 53677 - DNA, 2157 bp, Oryza sativa
  unsure (1)..(2157): unsure at all n locations
aggcgtgtcagtgtacctaaatacacaataaacaaaactaagagaacatgtgctttattaatctcaaggatcataaatacaaattcccaatgtaatatatatgtgcgctccataatctgtcgttggacagatctgacttatgcgatgtggtctcctggttcctggggcttcgagaaactcccagttaattggagaacctccgattaagctgcttgtggtcatctcgtcatcttagtcccgcgttcttcatgcattgtgatgatggtgaggtgtagatagtggatatataagtatatgtgggcgtcggcaacgcatccacggcctcgtcggtccatgcgccagagttgttagcatagccttcgcatcggcttcgcccgccctcgttgtctagcctcgtcagtcttgaacgacgtgtcggtgtagattgttggtgaagacatatgcatggaattgtgtagcttggatagctcaacgtttttttttttgacaccagctaacccctttcattaaccaagggctccaggcaaatcaccagagactagatgtgatacaaactcggggacttggctgatgtacattgtcatgccagagttaacagaactcgccccatacttagctaggcaatcagccactttgttacaagacctcggacagtgttgaatgagacaacttgcaaaatgagaggaaacaaaagctttaatttggcggaataagcatccatcttggtgacgatcaaaatccgtcgatgtgagagcacgctgcagctctacggcgtcggtctccagtatgattcttgtcatcccgagttgtgcatctctctccaggctctgaagcgccgcagtagctttagcctacaacggactagatgcccgcaaaatatagccgtaacccccctctaggaattctccattgctgcctcgtgcgaggaaaccccagccgccagttttcgtactcacatcaaaagatgcatcactgttcatcttgtaaatatcggccggaggctgttcccatcttccattcaccttcatgcatggagttcgacactggtgcagcttttcaaggtccattatatggtaaaggacggcatcacagacctctaggctcgtgagcttcttgtctcccacattggccttattcctggcataccaccacttccacagcagaacaacagcttttaactgatctttggcagtcattgacaggatctcctttacggtttccttcccagactgatattgcactaggcgtagtcggacttcttcaagattcagactcctccagcactccttcactcccttacatttcagaaacaaatgcccacagtcctcatcaaatctattacacatcggacataaattgtccgactccatgccccttcgccgaatattgcatcgaactggcaggcttttgtgagctagtcttcaaacaaacatttataatcttatttggcacctccatgttccagattttctcccactgaagagtgtcagcatgacttgtattcagtgaagatcctgatgcatctctgcatttttccttctccctgatttgcactgccagtttataggcagatttgaccgtagtaaaagtcccttcgaatcaaaatgccatgtcggccagtcctccaaattctcatcaacatgcgtggcaagaatcgtagcagcatcctccggccaaaacagatcattgactaattgctcatcccaccatcccgtgcctggatcgatcagttcaacaacctttgttaggattgagttgcctctgggagtgatcggccggcgtgtaaatccaacgggcatccatggatcattccaaatattaacattttcaccggttcctactcgccacactagaccttccttgatgagatcgactcctttcaagatactgcgccaagtatatgatatcccgtcccgcggcgcacactgcagaatgcttccatctaggaaatatttagctttcaagactgttaacagtgaaatttggtaatcggcaaaaacatcatcggcttagaatcattatcggctgcagcatctcggaatcagccgatgggagttataaagtcgccaatagtcagattcctactatattcggttaaggatatcaatctactataggnnnnnnnnnnnnnnnnnnnnnnnnnnnnnnnnnnnnnnn

SEQ ID NO: 53678 - DNA, 1142 bp, Oryza sativa
tatgtcgaaatctttgtctttgtactcatccactttagatctcatatgctaccctttttctcggtgtcgatttctagaatcgacaataactattgttgttttgaataagattaaggttaaaagatccatttttataaaattgttttttttggaatattcactttcaaactaagaccacttgtcttcttcttctaatatttacaaaaactagatataaagccatgttattaccctaaatataaaaatattttttgctcatttcgttgttaaattgtatctagtggtccaagtttaaatggaaacaaattatagctatcaattattaaaaatggagggagtacaaccttgactattaataatgtttaaaatatttagtttgaagaaatatttataaaattaaatatttaactgcagagattctgaagctggttcaactgccgtaaatgttcttttggtgatggctaacaaacaagtgaacatcacttagtatacataggactgctttaggtcccaagacaaaaacttttcaaccatcacatcgaatgtgtaaattgtgagacgaatcgtttaagtctaattgcaccatgatttgacaatgtggtgctaccgtaaatatttgctaatgacatattaattaggcttaataaattcgtttcgtagtttcctggtggaatctataatttgttttgttattacactatgtttaatacttcaaatgtgtgtccgtatatccgatatgataatcaaagccaaaaattttctccaactaaacaaggccatactacgagttgcatctgcttggagtaatttcatgaaattaatgatatgtcatctagtatgataatggtaacaaattgtcttaaatctgatggaacactgcacctggacctggaccaggacaagaggcaagaatgcaagatggcatcctttttttctctcttcttctgtcacactcacagggggtacgaggagtttgtaaatgcatgcattgaacttgtgcatagtggagtatgcagctgccatggccgtatgctatgctgctctgcaaactcaacttactcaagctcacattcatcatcatcatcatcacaaatctgcaaatctgcaaactgcaaatctccacaaggttgtcaccgattcat

SEQ ID NO: 53679 - DNA, 12239 bp, Oryza sativa
  unsure (1)..(12239): unsure at all n locations
nnnnnnnnnnnnnnnnnnnnnnnnnnnnnnnnnnnnnnnnnatgcaaacggcggcgtctgtcgggtcgcatgggctcgagtttgctcgcccaaggagtatggtggtttggggattcctgatctagagaggttgggaatcgccttgaggtcgcgatggctctggcagcagagaacttcaccggaaaagccgtggcaagggcttagtattctggtctcgcagaaggagcgcaatctagtatcgatttctatggtatgcttggtaggggatgggaattcggtgctgttctgggaggattgctggctgcagggttcctccattcggttgctagcgccggctgtctatgctgcaatccctgcccatctccggaatcgacgcacggtggccgaggcaatgactaacagaagatggatccaggacatcagttcggcgttgggtattcaagcgatcctggagtatttcaagctttgggattgccttcggtcagtgcggctttccgaagagccggactctctatcttggcggtgggagacctcaggagaatactcttcccgctcggcttctcgtgttctcttttttggaagaactcgtctccagcacaagctaatttggcaatctttggcaccccctcgctgtcgctacttcctttggttggtactccctccgtttcacgatgtaagtcattctagcattttccacattcatattgatgttaatgaatctagacatatatatatatatatatatattcattaacatcaatatgaatgtgagaaatgctagaatgacttacattatgaaacggaggaagtagctcttaaccgttgctggacagcagaccgtctccggagtcgtggtttgtcgcacccggatcgatgtgttttgtgtgatcaatgcgaagagacaattgatcatctcttggtcgcatgcccggagtcgtggcaactgtggtgggttgcgctcagagctatcgggcattcagagtgcttaccgctcaatgaacactctttcctctcatggttgtgcgactgtcgcaagaagatggtcaaggaacattgccggggtttcgacaccatcgtgacgttggttgcatggacgatctggaaggaaagaaacaatcgagtcttcaaccagaagagcagaacttgggcggaggttgcaagggttatgacgggtgaagcggagctgtggcggctagctagagctgcaatccccgttttggtagctcatgttagtggagaagggtcgcaaaatttagttggagattaggcttttatttcttggttctcctcctgtaccctgtccccttcgctttgttttttttcccgctttgtacatatatttattccttcttaatacaaagatgcgctccttgcgtattaaaaaaaaaagccaacaaaggcattgatcgtcgatgccgctgctagtaatctacttctactaatatgccaagaattgagaaactgtgcaggatcagctcccctccgatgcagactgaacatatccctgaagatcttgcgagaaattccatctgcattcaattcattggtagtacacagtttcttgagcggccaaaaggccatcttaattgattgccaatctatctgaaatggcatctactgcaggtaggagtagtgattctgaagctggttcaactgccgtaaatgttgttggagatggctgacgaacaagtgaacatcacttggtatacatactagtagtctagtactagttgcatctgcttggagtaatttcatgaaaacaatggtatggcatctagtatgataatggtaacaaaatgtcttaaatctgatggatcactgcacctggacctggacctggacaaggacaagaagcaagaatgcaagattgcatccttgttttttccctcttcttctgtcacactcacagggggtacgaggagtttgtaaatgcatgcattgaacttgtgcatagtggagtatgcagctgccatggccgtatgctatgctgctctgcaaactcaacttactcaagctcacattcatcatcatcatcatcacaaatctgcaaatctgcaaactgcaaatctccacaaggttgtcaccgattcatcatcatcaaggatcgccacctgcgccagatacgactggagaaggcagggtccaagtggccttggattggaacagttcagttcttgctctcatcttctcttctcctttcttctcccggctagtaccagtcatagtcaaagcatgtataattaaaaactgtcacatttgtgcagatgcaggagagaagatttcgaaagttcagactttggctttggccctgtttatatcccacccaaaattttttaccctgacacatcgaacattttaatacctgcatgaagtattaaatataggctaaaaaaataactaattgcatagattgcgattaatttgcgagacgaatattttaagcctaattgcttcatgatttgacaatgtggtgctacagtaaacatatgctaatgacggattaattaggcttaataaattcgtctcgcggtttactaatggattctgtaattagtttttttattagtgtccgagcaccccatacgacaccctatataatacccgatgtgacacgccaaaactttacacccctggatctaaacacccccgatatggcgtgccagtgcattgatggagtatttggagtaccgaaagtcgttggaaaattaatcggcacatcatcaaagccaagaacaacacttgtttggttctgggattagatggggtgggatgaaaccatccctgatttttaggatgggatgattctactcgcatgtttggttcataggatgagaccatcccagttctttgtttggtagaaaggatgagggaggtatgggatggacgccatttgtggctaccgtcaacccacgttcgatcccggcggcaagctggtgggagcggtgcggccagcaactcggcgagcgagcaagcggaggagggacggcgtggccgatgactcgacgagcgcacgagcgagcaggcggaaggaggagtggtggcgaccaacaggcagacgggcggacgagcgagaaggcagatgaccagtcgtggaggagaggcgaggcggccgctcgcggaggagaggcggcggagacaaggtgacgacgggtcgcggaggatcgtcggcctctcgcagaggagaagcggcaacaggtcgcggagggtcggcagcagtgggtcgcggagggtcgtcgaccgctcgtggaggagaggtggcggagggtcgtggaggagaggtggcggccgcttgcagagaggcgtcggcagttgcggaggtggcagacagcacggatgagcgccagcggatgtagagacaagctgacgtcgtgtactccgtctaggtaggacgagctcgtccggttgattttaccggatggcttggtcctagattttgagaggaatattcctctttagggaccaacccaacccactaacccataaaccaaatactcctcaaagtgggttcgtcccatcccatccttgcaaccaaacaccacctagatgacgagacaacacacgcagctgtatgctagttctccctcgggttacatagctgtggagattttgggtaatatatatctacacggacagcttatccgactgaaggtaggaggtggaccagatttgtatattactacatccgtcccagaatataagaagttttagagttagacatgatttttaagaaagtaggtagaattaaatagggagaggtcgtgattggttaagaaatggaggtaggtggaaaaagcgaatgatggatagtggtgattggttggaacagaatgttggtggagaagttattatattttaggataagtcttgagtgttaaaagttgttttaaggcatagtccgtagtattagtcttatgcaattgaataactgaataagaaaatccatatcatgtctgactaggttttcccctttgtaaccttgcccccgaacctagggagggagtcccctgagggcataggaacaccaagattatcagaccaatacaacatccggtggatacaatccccaaaataaaaataatgtattatttctcatcgagaaggtctgaatatgtcgaaatctttgtctttgtactcatccactttagatctcatatgctaccctttttctcggtgtcgatttctagaatcgacaataactattgttgttttgaataagattaaggttaaaagatccatttttataaaattgttttttttggaatattcactttcaaactaagaccacttgtcttcttcttctaatatttacaaaaactagatataaagccatgttattaccctaaatataaaaatattttttgctcatttcgttgttaaattgtatctagtggtccaagtttaaatggaaacaaattatagctatcaattattaaaaatggagggagtacaaccttgactattaataatgtttaaaatatttagtttgaagaaatatttataaaattaaatatttaactgcagagattctgaagctggttcaactgccgtaaatgttcttttggtgatggctgacaaacaagtgaacatcacttggtatacataggcctgctttagttcccaagacaaaaacttttcaaccatcacatcgaatgtgtaaattgtgagacgaatcgtttaagtctaattgcaccatgatttgacaatgtggtgctaccgtaaatatttgctaatgacatattaattaggcttaataaattcgtttcgtagtgatggaaaagttaaaagtttatgtgtgtagaaaagttttgatgtgatggaaaagttggaagtttgaagaaaaaatttagaactaaacaaggccaccttcgggttacatatatacccacagaaagcttatccgactgaagtatgtaaatagattagaatttagacattgtatatatacccacggaaagcttatccgactgaagtatgtaaatagattagaatttagacattgtattaccttatattcgaaggcatagcccgtagtattagtcttatacggttgaataacttaataagaaaatccatccctttgtaactttgccctcgaacctacataaaaagtatagagcataggaacaccaatatcatcatatcaatataatattcggcggatacaatcccgaaatcgggagtaaggtattatttctcaacctgtttaaatccgtctctttactcatccattttagatgtcgtgcgctactcacttttctcattaccgatttatagaatcgacaataactattattgtgttgaataagattgaggttaaaagatccgtttttatataattttttttggaatattcactttcaaactaagaccgcttgtcttcttcttctaatatttaagccatgttattaccctaaaaataaacattttatttgctcacttcgttcttaaattgtaactagtggtccaagtttaaatgggaacaaattatagctatcaattattaaaaatggagggagtaataccttgactattaataatgtttaaaatatttagtttgaagaaaacttttataaaattaaatatttacttattttctaaaaattataaagaattgtgttttggagatcatgttgttgttgcaagaaccccttcttactgtaaagttatgacccactaactgcaattaagattctaaagttcaaacctcgatgtgctacattatcgttaattctcagccgttggatcagtagatttgatcatctctgaaccgttggatgaaaaaacacatcctaatccacctcacacagtcaccatgggaggcccatctaatttgatcgtcgcccaattcaataatgagggatttttttcatcccaatcaccaatcttaacaaaatatcccactgcaatacacggggtttcaactagtaatagttgactataagccaattatgagcttatgtgagtgagaagataaagaaaaatatgaaatgttggctcttatgcaaaaattaactttacacatgcttcaaatagatgcattgttaagttcatagtgaaagagagaaaaaattgaagctaccctaagtattatactactttttagctttaatacgggcttagagcaatactccctccatctacttttgatagttatattttatcttggcacacagacaaaggataagtaattttacttatcatctatttaaacatgctactagtcattccttgtaaataaacaattcattaatatttacatttctcgatgcccatgtaaccaattttgtgtgaaagaacggagagtcgcacattaaatctgagaaagtcattaagatgatatgttgttggattgaaatatgcctatcaaaaataaaattttcagatttagaaatatgcctatcaaaagtagatggaaggagtactgaggtagagaggagaagagaggagaaagaggagaagcgggctataaatttacagccagcttggcacaagaaacaataaactctgtgagagagataagtgagtcctacattaatggtaaagagctaactataatttaagtggcctgagagaaggctgcaaagaaccttacatgcaataagtcgactgtattattagccttcctcttatagctacttgttagctccaagcgcattaatgttgagttcaggtcagctcgtgggatgagattttttggcgacatgtgaaacaagatgagccattattagtacataattaatcaaatactaattattacaaacttaaaaaaatatttatttgattatttaaataagcttttaaatagaaagcaatgcagttagaaaaactgtttatgataattgtggagagagctaagtcgaaatgtagaaacggacgaattggctgtgttcttaactggttccaacctccgcttcctccttcctagcacacacgtttcccaaactattaaacgacggggttttttacaaaaaaaaatctatagaaaagtttctataaaaatcatattgatgatatattttttaaattttttagctaatacttaattaatcataattcatcgttccgttttatgtgtggagggtaggggttttccaatcccttcaaaagaatacagagtataacggttaatactccatccgtcccaatataagtgtacctagaatcggatgcgatatttcataataaaatgaatatgaataggtagttgtccagatttgttgtactacgaaatgccatattcgttagtactatactctctcattccaaaagtctaagtcatatttcattctttagtttttccaaaagtctaagtcatatttatagttactatgtgctatgttaaatattttatcgaaacccaaaaaaccattttagtagttataggttgcatgttcattggttttatagttaactagatcttggttaaaaagaaaaagggcttccaaaatacttttggaaggatggagtactacaaaatgtggcacctgatccgttattatactatactaggtgtaggaacgaatggagtacttcagtactccctccattacataatataagaaacaactactttttaaagttgtttcataatataagacgtctatgcatgcatattattaattattacctctttttcactaaaatattactccgtattatttaaatcctctaccattaagatctttaattatattgggtgcatgcattctattattagggtaatccaaactatgagatgataataattatttttttttgtcttaaccaggttaagggtgactgtgcctttttgaaatggaggcagtagtcaactaaaattaagcgtgggtgcataggaagagtaaaattaacaagtggttaaaaatggcgcgccgatttgtaggtcgcagcctcgatcgcctcttgtagattactccaagcagatggtgccatgtgttgtggttcaggatacgagggagggatcaatgccaaaaggagaattgatggtcattatcttgagaaaagagcaatcatatgcttgcttaaaatatcctcacaaacagattacgtactactccagagtactcagtacaagcaaaagatctaaaactccattcgtcggcatatttagttgaattttaaacgcttccaaaatttaaattttaaaacttaattttgatatttttatcgaaatgagaaacgcatatgagtctttcgactagcttcacaaggtagtgggctagacgatctagatttgaaacctcatctcttttaattatttgatattaggtaattccataatattcacatcttttataatttttatcaaaattatttttcagcattggtttttaaattgctaaatacagacatataaaaataaggcttttctgcatttatatgtgttcttttctgcatagattggtttttaaattatatttttatccataaattatttttattttgctaataagccaaccgatggcagcattcaatatttgcatgaaaaatactgtacatatgactttgcctacctgaaatgaacattaaaaccaaattctaaaattaaaatcaagctagaccgagcacgtacagccagtgcgtccattttacttgacatttgatctcagttccgttcgttttcactcgtcctttcatgctccagttccttctactccgttctatcgtctcacgagaattttaccgcgattttttttactccttgtgttgtacagataatcaattcagacacttctttcgcagataaannnnnnnnnnnnnnnnnnnnnnnnnnnnnnntggattgatgaataggtagtacaattttcataaaacctttctatatattgtttcaaatccaattcttaaactttatgataagttaattcattcatatgtactcccttcatccttaaaaaaaccaacctatcatagtacgagattgagttttttttttttacagaaacagtagtactcttaaacaattatcacaaatcattcatatgttcagtcattcaataaaaaggaaccgtagaacacacggctaatgttttgtttaaaaacggactgttgtacaaattattgctaaaggtatatacttaattataaggataaattaaatattttgctaaaaataagttcaaaacaaatggtctaaccaagtttttttcttaagaaaagagttatttttttctaaatgtgaagcaaataatctatttcgatactccaattaacaattcgaagacaactaaaaccaacttttctttcttggtttgtttcttccatcttccatttatatgtgttgtgtgggagaggggtgcttaaaattgatgaagataaagttaaggcacgtaaaacaagaaaatcattagcacacgattaattgacttataattattacaaatttgaaaattatgtttatttgatattttaaagtaacttatatatagaaaaaagttttagcacgaaatacactgtttagtcgtttaaggctcttttgaatcaaatgattttatgtagaaatttcataggattcatatcctataggaattttcctatgttgccatttgattcaaatgattgaagttttttaaatcctatgaaattcccatgaaatggctcattgcatatagattttggaggaaacttagcaagagctccaatctatgagaaaatttccttttgtgtctatttttctcatttgattcctgtgtttttcctgcgatccaattaaacagtcattcctatgttttgcaattctctattttacacttgcattcctgtcaaaattctgtattttttcctatttctctttttttttcaatcatgcgattcaaaggggcttaaggtttagggttgttttgaattgcatgattgaaaaaaagaagcaataggaaaagcacatgattcagacagaaatacaagtgagaatagaggattgcaaaacatatttgattagaccactttgaattgacgttttggacaaggttgaaatcaagtttttataaatttgaccatcaataactttaaaaatatttagtttaaagaaactggaacaatatatatagatttgtctttcaaaacactataataaaattaaacatgcatttatttattgtgtatattataatagaaaaataaggtcaaagatatattttgtagaccgtgtcattatccaaaacgtcaattaaaatgaaaccggggggagtaggaatcagtagagaaatatactcaaaggaaattttgtaagaggttgaaactcttgctaagttttcttcaaaatctatatgcaatgagttattgcataggaatttcatatgatttgtataaattctttgattcaaacgagcccttgctctgattgatctctgtatctactgtatctagctagcattggggtattgctttggctatggtggctatccatccccatcgttgtgcctgcatcgtctctcatgactctcaatctctctctagtgtggtgatgagcaacaacaactagtgtggtgatggggggaggggagatggaggaggaagacagtgcccactgaatgggcacaggccgccattaaagcatgcctgcctgccatctctctcccccctctccgtgccggcctcccccctctgaacccccatttattgtctgcgctacgcccattaatgtcaagacatgtcctctctctctctcttctcctcctcatcggattgattcttgaatcttgattctttgctgccgttgcatctgcatcagcatctctgtgttcttgcaacatttgcttgctttcttggtttggagtagcatggatgagggtgtgttcacgttaaaattgaaagtttgattaaaattggaacgacgtgatgaaaaagttagaagtttttgtgtataagaaagtctcgatgtgatggaaaaattgaaggtttaaaaaaaagtagagaactaaactagacctgagtgtatctactgctgtaataacaactctggttgttggttgaagaagagaggagagaataattaattagggcttttgtgagatcgattaatttgggtttagggatggatgggttgatgatttggacgtgttgtgcgtttgattgcggggggttggcatgtgcaggttcgctcagcagtcaagatcgccataaaacgcagcgtatgagatgcgtacccttcttcttccttgattggttgtctcctcgccaacctcctcttcatgagatgatagtaataattcgttcgtttttaccctgctcacagttgatctctgatctcgccgtaccggattatatatacatgtaattactactgcatcgatcgtcagcagcatggttacatctgattggatttgtgttagtgatgcgattttaatcgattataaagtagtaaataaaagaggaataatgagcagattaagaacaagggaaagaaatgtaatgtgcattctcatgagcttaaaatttttcatgcgacaaagcatggatggatggcttctaatgaagccctaggagatcgatcgatcgagctatattcaactatcttcaatccttcatggtctgcttcttttctgaagatttcagcagcaaagagatgagaagaagaagaaatgctgatcactttgcaacgatttagatatacagggagacttgtgatcaaaattcccctgcaagaagcagagttcatggctacccatcgatctctcatcgtcttcctcgtcgtcgtcttcagatcggagcaggctgcgcgattgattggatactagtttttactactactacgccctcttggatgaggtcgctggatcgtcctccttgcgcggcggcggccgcggcgacggtggcgcggcgcagaccgggatcactgaacggacgctcaccgccggcggcgcgtggaacccggcggcgccggcgaagggcctcgtcggggcgacgccgccgccgtggtggtagtacggcgcgtagtagcacggcatcggcggcggcattgcgtcggccgccctgtcgcgcagcatgacggcgtgcagcatgtgcaccagctcggcggccttcctccgctcttgctccagctcggcggcggcggctcgggagccggacgccgccgcttgctgctgctgcagcaggtgcaggggaggcagtatcttgggtccggccgccggcggcggcggcgacggacgcccccattgatgtctgtacagcgacgtggcggacgaacaagacgcgccggcgagatgctccttcggtagagacgccgccgccgccttcccttc

SEQ ID NO: 53680 - DNA, 4766 bp, Oryza sativa
gcgtggtgcagttggatggcccgtcgaaggtctcgccattgaaggtgacggtggccttgaaccgcggcgcgtggtcgggcccttccctcgtgcacacgtacgacggcaggctgaagcagctcctctgcgccagctcctgcagctggttcttgtacatcgatcctcctccttcgtctctctctcctccccaccccctccctctctactcctcttcttctctcatcatttgatcatggcatcatcatctccattgatggacaatagagagagaggagggagagagattagattaggtgttcttggggagattgggagatggaggaaggagaagaagatgaaggtgagagtgtgtttactagtggtagtggtactactactactctagtaggaggagtaccaaatggtgcattgctttgctctcccctcttctttatttcttcttcttgttgctcatctccctctctttctcactctagcttcactctctcactactggccattgttgtttgtttctctctctagacaatactatggttgtggtatgggtgtagagagagaaagtagggcagagtggggagggtgagatggggggcagagacaccttctggtattaattggggggagagcatttatggtgttttgtaagcatgctgcatcctcacacacacaacacacttacctagagtcgtcttcatcatctcgcagtgcaatgcatgtgttgtgcagacatggatcgagatctctctctcttctctctagcgaaccgaatcgacggtcgtgatgatcagaagggttttcgttttctaccgctgttgttttttcatcgagatgtgatcatcgtcgtcttcactctcgccaccacgtgatcccaacgacccaacggtttgttgaatgtgtataggagtataggtcaaaagatcattttatctcggttggtaaaatgaaaattttacctttgggctttgtttagttccacgtaaaaaatgaaaatttgaagaaattagaacgatatgacggaaaaattgaaagtttatgtgtgtaggaaagtttgatgtaacggaaagttgaaagtttgaagaaaaaaagttgggaactaaataaagcctagggtgtgtttagttcataccaaaattagaaatttgattgaaattggaacgatgtgacggaaaagttaaaagtttgtgtgtagcaaagtttcgatgtgatggaaaagttgaaagctttttaagataaaattggaaactaaatcaagccttggtctaattttacaggctcgcaagatcaaatcattctttgatcttgagaaaataatctctttgttttttaataaatggtgctgatgacttctgaatatatgatcattcgttttattcaaaatttttatataaatgtataagatataaaacatgtttaaaatattttaagtgataaaataactaacaacaaaataaatttcaattaaataataataataataataataataataataataataataataataataataataagacgacgaatggttaattgtgtaaccaagttaacgacatcatctattaaaaaacggaggtagtataccagtaccgctcgtgtataggtggtggccggtggtggctaaacaaccaacaatgaccatgatttaacgaaacaaggttgtgacttgtcccattgaggtgaagttgtaaccatacaccgatacacattcgcatgcctacttacaagagaaagtatataagtttaagagttaaacacaatggtcagatgaaagtttattacacatacatcttatcagatccaaaaattgaggtatatgtgccataacatatttattagtatcatgacttattaattatatttaaaccatagtattatcctctacgttttgctaaaagctatcggaatcgtcttacccgatcagcctagatccaccttgagcccttgatgcttatggtgtcttcaaatgtataaatttgttcctcaattagcactcatggtttgactgctagatataaggcgtatttgaaagaaatggattatagagtttaatttaattagcttagtcccttaacgatgttttggaaaagaaaaaagcaatgctagtgcgtaactgccatgacgtttttttccccatttacaataatactacataccttgacatttggcattggattaaataatcgttccaatagtctacatctatcaaatattcctcctttagttccacttgatctttcttaatttctacgtattttttcctaatcctatgagcctgtttagttggtgaaatgaaaatttttggatgttacatcggatgtttgaccggatgtcggaagggattttcggacacgaatgaaaaaaactaatttcataactcgcctgaaaaccgcgagacgaatcttttgagcctaattaagccgtcattagcacacgtgggctactgtagcacttaatggctaatcattgactaattaggctcaaaagatcgtctcgcgatttacatgcaaaatgtgtaattagtttttctttttatatatatttaatgcttcatacatgtgtacaaagattcgatgtgatgtttttacgaaaagttttggggaactaaacagggccaatgtagaggatttcgttttacattacccatattcataaactagaaatttccctggttagattttagagggggtttttttaagagaagggtatccactcttttagttccacttgatatttcttaacgatctcgctttacattacccctattcataaactagaaatttcctaggttagacttttgagttttttttaagagaatggtatccaaccggatgtatgcagcctttttaaattgaaaacatagtcctcaaataactcaatctgaaattcgatcacattgagatttgaatttaggatattgaagtgctactaaggttactgcaaccactaagctacatatcctttcgcaggctttagaggtatctagctgattttgtttctcattatgcatttgtgcggttatttaaaaaagagaatataagttagagtgaaacacactaatgggatgaacaatgaatggtcctttaatcactattgcaacaaaaagtttaattagttgatattgctactttgcctaatgcatatcattgtgccgacttgccccatgagacctaagtatgctctaccatgtcaaactcgaccatcccatatggccattatttggaagtggcaacaagggttgaattgcatagaagcattcttcgaatgtgtaaacttatgttgaaaaaggctaaatattggtttcttattagcacccacaatttgactggtagatattaatgtatatatgtttgaaagaaatggattattggttgaatttagctcagttcctcttgagattttgggaagaaattaaagaaacgaaatctagctgtaactagcatgatagttttatttccatttagagtatttacctggacttctggcattggattgaatggacatcctatggtcttacatctcgctagtgtaaacttaaaatattcaaagggaaataaccaagaaagaaattaaagccgcctcttttagttccacttgatcttccttactaattttttagtattttttagaaagctcatgtagaagatcatattttatactacccatgaacttgacaatttctttggttagactttaagaggtaaaaggcagaatcatttggaagaaaacaaatgtgcatagaaacatgagattgagctaatcagtactatcatttatacttattttatattgtatttggatgacactatcttatttttggctgtgttctttgatgtgagttgacaactaatctatgttcacagaaaacagagtgacatattatcacatgattaattaagtataaactaaaaacttaacaaatggattaatacgatttttaaaacaacctttatatagaattttttaaatattgtttaacatttttaagtgtgcgtgtggaaaacgagagattgaaggttgagaaccatcacaaacgaacttaacattagtctgtcttagaatatttatagtaaaatcgtaacggatttacttagcaaattgcaaaggatagacaaatgtcaaacaacttgcaattttttttaccacaatttaaaacacatcgattgatagctacctgacgagactaccctatcaccagccagtccagcccctttggctgctaacccggtcaaaaaaacgatcaaaatcatcaagtacaggggacgatcgttcagccgttctcaccaaccaaacaatgaaaagaaaaaaaaaagccacaaatgtcaacgtgtcactaggaaaagtcaaaataattccctcacttttacaacccaatcttgtcgcttataattatgcatatcagccaaaatttaaacttttaactttaaatttggagttaattctaagaatttttaccgaaatttatttttcagtctttatttttagatcgctaaaaatacgcatataaaatttatattcacaaacaattttcagtttgtgaatatatgtcctatggcttattcaacgacagggataatcctcccacgattttatttcattttcaaaaaccgcgccggcttaccgggcggcgactcgacccgccaacccgcctccacgcctacggagactgccacgcgggccccacccccgcacaccgccgcgaaaaagcttctcccccgggcccaccaccacccccccgggctaccgccgctgccgctgccgttgct

SEQ ID NO: 53681 - DNA, 8022 bp, Oryza sativa
ggtttaccaagtttggcggggaagcaacgtaagcgctctctagctctctgtctctttctgtctagcttcatggagcaattcgattttgtttgcctgtgaacggtggatctggatctgggcgcgcgcgcgcgagattagctgcagcttttagggaggatttttagccgttttattatgtgactgggcgcaggcgtgggaggaaatgagatgttttcggtttcacgtgttcgcgatttgtgtgatgcttatgttcgaaatgcgagtttaggggcttggtgtgacagaaatttgagccgtatttgatgcttactgtagactgttcgtgttctagttgtttatggttgggaaatatagctctggatgggtggaaatcagttcatattcgaatcatgaaatgttgatacagctaggggaaagtgtgtgctttctattgttacgagaatacacagcagaaaatgttttatatttatgttcagtgcttcagtttatttatcaggttgggtggggactggggaatgctagttcattagtttgttggggaagctacttcaattttcagaatatgaacttttaatgactcttacatgattatgaggatcatggaatggggactgcagcttttggtagtacaatatgttgggaatgtttgatacagaaagtaaaatgttttatatctgttgtgcagtgattagttttggcgagaaacacattatatattggaccgtaaaatgctttggttggaaatgtgttatgctctatatttctcgtagaactgaaacataccgagacaatggtaattttggtctaattgtctaaatgatccttttgattcctttgatggggtacttggatgcatttttaagtagaagaatttattcaatgatagcttctttgatcctttttattcctttgatgggatacttggaggcatttttttaagtagaagaatttattccaggatagtgtcatgctttagctcatctacagagtggtctatgcacagcgacctttgtacatgattcaatcacattctggcaggtgtaccgtcaataaattagtgcacgcttcgtctgttgaacaagaggtgaatgaggcatttgtgtatggagattacctcatattaccatctcgttcctggcatctccgtttcactagattctccaattgggacagcgtgcaactagaacaaacaatccattcaaacatctgtcatctgcatagtagtgtgcttaaggttgtgattagccaacgatgtgggatgatgaataatcttgtggccttataaagaagcaaggattaggaaatctttctgggagtttggatgtactttatttttttggcaagagtgaggctgttttcttattaaaaaatttcttagcttgtggatataattgtccatccacctaattttaacaagctagagaagttcttgatatggtacacattccgtgcttgggagaaacagctaggaatgtttcatattacaaagccgctgagttacatttttagatatcatttcctgtttctgattatttggttgttttcatgagattttagttttcttttgcccttctcactattagtgttagcagcttttaaccttgctatattgagacatcactatttaatgccataaagtgccacttttttggctaatcgactctgttttaaaaaatagcatgctgaccgttttttttataaattcacttatatatttgcaattatttcttctagtttcacgcattggattcattgataacaattatggatctttttttcaggagtttttcttgcaaggccggttcatttttggaccagatgtgagatctttgtttctcactatattcctcattcttgcaccagtattagtcttctgtatatttgtggctagacatctgatcaatgacttccctgatcactggggagtttcagttatggtcgtagtggtcgtcttcacaatatatgtaagtattgctaatttgctgcttctcatttttttttcttgttccctctaaattgattgaaggctgtcttagttctgctactctgaatttggttcatatgacagttcaaccatgttctctttatctcctagcgcttgcatgatcagtaaaatttctggccatgaataaaactattatgccaagggtttttattttagttagatgattatcaaaatcggataaatctgtcaaaagtgatgcacattcatgtgtaaagagtaacatagtataatgtgtatgggaaacacataaaaatgtgattggctactcaaacattgttatccatatgaaagggagttatgtgccgagtgaataaattactttgacagtgtaatttattatgtttggttgtttgctgcatttatttcccgagtgaatatgcactgctgcagtgtgtgcaattaactgaagcttcatttaattttccaggatttgacattgctgcttcttacctctggtagagatcctggtatagtaccacgtaatactcacccacctgagcctgaatcgattgatggaggcagtgatatgggaaatggacagactccacaacaactacgtttaccacgcacgaaggatgttttcgttaatggagtaattgtgaaggtcaaatactgtgatacctgcatgctgtaccggccacctcgatgctctcactgttctatatgtaataactgtgtggagcgttttgatcatcactgcccttgggttgggcaatgcattggaagggtaagtatcttgatgtgttggaaggtttaagatatccttattgcaattagcttgaagatttgatatcatgtgcggggttgtggtctgtatacctcttgttggattttctatattagatattagtagattgttagttactactttaaagttttaacaagtcagcgctaattatcaacttatctgctgcagcgaaattaccgattcttctacatgtttgtattctcaaccacattgctgtgcctctatgtctttggcttctgttgggtgtacattgttaaaataagagatgctgaaattcaacgatatggaaagcaatgttaaagacaccggcatcaattgtcctgatcatctactgctttatttgcgtgtggttcgttggtggtctgtctgtctttcatttctacctgatgagcaccaatcaggttggtatcctttcggtttttttttaagtttttacaaataaatctttcaagcatagcttaatgacttgttaaccgtccttttctttacttgtgtgtatcagacaacctatgagaactttaggtatcggtacgatcggcgggctaacccatataacagaggtatggtgaacaactttctggagatcttctgcactgcaattcctccttccaagaacaattttcgagctagggtcccagtggatcaaggtttacaacaaacacgcacgcctgctaggggtttcatgagcccgaacatgggtaaaccagttggagatcttgaattgggtaggaaacccgtatcatgggatgagcctcggtcagcagcagatatcagagatttggaagttggccttgggggtcttttggatgagaaagagggtagaatagcccatgcatccccagatctttctcttccgggtgagcttgtggaaggtagggctggtatgcattcgagacgatcaagttggggtcacagaagcggaacctcagagtcgatggacagcatcgctgtgcaaatgggaaccgaagctaactggggttcaatcagcagcggccatggtaccaccagttcaactcactagcacacatcactgcatttctgacgctgcatctgcatctattggatccatctcatgaatgaagaaccatgtgtgtactctcttctcctgtgctgcttttcaccttaggatatatacacagtgctttcttcctcccgtcctctgttgttgttccatcctggaatgggcatctattgatgcacatcctgttctagtgtctttaagcaaaaataacagaagatctttaactcaatgcgtggcttggattatctatctgtatatatcgagtctgtaagcaaggttgtcgtgtttggtttggtttggttttcgacgttctgtaactgtaccatgctgctcgactcttactcaagaaatactactacccaaatcatcctctttttctaatgcaattctttttcttcaagtctctaattggattgttttttttttctttttgggacatggtataccatctgcttcgcattcttctgcatgctgagctgctccttatttgattcttgtgttatctgctcaaccttttgtattcctttgcatactgagctgctcattggtactatgaattcggtgtaaaaattaacttcaaattcaatttgctcgaaaactttcattagcatatactccatgtaatttatccagaaaaacaaaagcccagttgcaattgcaacgggggtgttctgctgggttattttaatacagatgccactgaagcgtgtgcagcatctggctcgcgccgaccaatcactcaacctgcaacagttgcaacagtgggcttgtgtgtttggcatgctttccaacgcaaaaagggcacatgctgagctgcactctcctgctctcgcagcaatgcaatgcagaagcagcgtcgcttttggtgctcccatgaaaattctgtggcatcgccagtgccaagcattcaagtatattttgtaccaccattttcttgctcataccagagaaaaatcatcataagaaactttgtattttgagtgttcttctgtgtgtcatgatcatatgttcagtgaggcatgttcttacatgtttcacagagcttcagttccgctaaaaaagagagcagagtgggctaaagtgatcttaaaaaattaaactagaagggtgaagcgagtctcgggccactccacagctacactttagactccgctcctaaagttaggtttataagttagagtcctataaaacaaactcgggtttatgacgattattcaaggacaaaaacaattaattatatattagaaagtcgaaaagttgttttataaaagttttctaagaaatgttgaagtttttttttggcaaaaaaaatgtaatatttaggaggctggaaagcgtgcccacgataatccataagccattgtgttaggtcaagttggatcgttgtgacacatcagtcaccaaatcaaaaccgttccaaccacagttaagtacagaaaatctgaatggattcatgtgagagtgaataaataatcatcactaagaatcaagcagaatcaagcaggaaaatgcatgtttgattcccctgccaggagttcctgatgcaagcagatgaagccagtaagtacgtagtagtagtggcctccagctcgagcagcagtgcagcactagaactgatccagaaacatcaaattttccaacaaatcaaagttcagaaactggcatgtcatacatggaaaattcatactcctaagtgcctgcacctgaagatcctgtggatacaagcaatggtgtatatttggcacacaatccaaataattaactagagcagattccattgagtggcaaaaggagatgatatgatcaggttagtggcttgtaggcaagtggagatcaatgaggaggtgaggaggagatgaatcgtatctttggtctcctcttatcttcttctttttgaatttaatcttcctttccaataattgaaatgttcataattcatcagaacattataaatgattaagagttaactatctagttcttcaattagctcaagggaagcttctgtcttctcattgatacacatggtaccggcagggtttcccaaaccaccggggccggggttaccacgccccggcggtaggtaaccgtgaaaaaccatgcaaaatttatcaaaaatttaaattattttttaaatttatttgaatttaaggaggttaccgtggtatttatattaccgtaccccgcggtaagtccggtaaccgcgcagttaccgacggtaagggaaaccctgggtaggtataggtaggtaaccatgtaccgaatagctggataagactgtgacaaactctgcattttgccctcctttttcttgtgctgatctgagaaaagaacacatttatgcatctgcttaactagacccaagaaacgtgcacgaatacacatcagctcagtactctccgcagaaaagattttctcaggcttgtcttcagccacagcaggaactccacttgatcagtaataatgcatgcatgcatgccaagcacttactagcaacactacttcttcttgttcatcttcttcgtcgccatctcgataaaacttgccgttcttggagaaagtaaaggcacagttgggcagctgcattattgaatggttcagctattcaccagcatgctgaaaattattcagctgttcagtagctagtagaagcagagaaggtgccagtgaaacaagcactgaaacatttccgtttcatcgcctcctcattgccgcgatgcagaaaaggcctcgtcgctgcatgcacataatgtattaccaccaagctttgatccgacaagtggcaggcaaatgtgatttgcagctgtaaagcaagtaaaaaaaaggtataattgtccatggtttgatggtgaaatgtaacttactgatcaaccagatgcaaagctagtttcagctggtaattaactttggccatctctgatagatgcaactagcttaattgtgttgtgtttctgtgactcttgtgtgtggtgcatcatgtatccacatacttacatttactctttgtgttcatgagaattggcatgcagctagctagcagcattgctgaacctgaatgctgatcagttcagaaaaaatcagatatgagcgccgatcaatggatggaaagagaaaaggcctaaccttgactgaaccggccacattgctatagtgctgtactgttgtctgcatgcatgcatctctcttgtcagtgctggtcatggatgtgtattaacagtagtagtacattatgtaatgcgtctttgcaattaaaatgcacagtatagtagtaacaaaaacatgcccttttcttcccatagttttggggtccatgcaggtaattcatgtgcagattctgatactgatgatctgacagactgacaacacatgaaacctcagatgcaactggagaagacataatttgattacactctacaatatctaaatatgtctctcctatgtactaactttttgaatacattcctgaatttagttaatggaaggattattatctgacaaatgttcaattattcagtaagacttcaggttatagcaaacagtaggagtataatatctctggaccacttaggcacttaggcaccatgtagatacgtacatatgtaacatatgagaagaagagaagctctactactatatatacaaggcttctacccccaatgccaagcacacaaacattgggtgcagtagtgaatcctcttcagaagttcagaaaactatagcttgcttttagcatatataaattaggtgtttttatcttcttttgagaaggagatcaagaacaggcagtaggaggcctcttcctcttctccatggatcacctttgggcctctgtctttgggattcttggtaagcatctcatgcatgctagttcaccatctatacatgcatccatatggtagcatatggcatggcatggtctcccaaatcatgattttgtttaattatatgtatgacctcaagatatattattcttactgacatgcatgaaaaatgcacttttcttctccacaggaaacatcgtctcattcctggttttcctcgcaccgatgtgagttttgctcatttacgccctgattttttcttttccaaatcattcattcacctaaacttaattacgcgttctgacaagtgcacaattaaattttattttttactaaaaaacttaactacgcgcacgtcctgactcctgacacgcgtgtagttaagctttgtcttgttcttaaaaaaaacaaaagaagaaaaaaatctcaa

SEQ ID NO: 53682 - DNA, 12585 bp, Oryza sativa
ttcctgcagccccaccgaaattttggtaatttcggattttttttgaattttcaacatattttgattaaatctgaataaatttacaaatatttgacaaaaaccgaaaatttcggggagactttgtgcttgccggtggggcccgaaattttcgaaccgaaatttcaaaccaatggatggtgcaggccgacttcctgagggtgtacaggaagaagtcgacggaggggttcagctcggtgccgtacgtggtggcgctcttcagctgcacgctgtggatactgtacgccatggtgaagaccaactccagccccctcctcaccatcaacgccttcggctgcgtcgtcgaggccgcctacatcgccgtctacctcgtctacgcccccaggccggccaggctcagggcgctcacctccttcctcctcctcaacgtcgccgccttctccctcgtcgtcgtcgtcaccgtcgccgccgtcgcccagccccaccgcgtcagggtgctcggctccatctgcctcgccttctccatggccgtcttcgtcgcccccatgagcgtcatcgtaagaagctctcacctcatcgatcagctcttttcttttaaagatatataatgaaagtttttattgaactcagccaattacatcatatgatattataactgtagtaagaacattccccaacttgaactcaactcatcagttttttttaatataatgaaagcttttattgaactcagccaatattacgtcagatgatacaaccgtgctaagaacactttcaacatgaactcatttcatcagtttttttttaagatgatggaagctttattgaactcagccgattacatcagatgatacgatcattagcttgaactcagctcattagctttatcttttttaagataatggaagttttattggactgagccgattacatcagatgatacgatcgtactactgagaacactttcaacatgaactcagatcatcagctagtgatgatcttgcatcgtacttgttgagacatgtttgctgatcaatcgatcgatggatggatggttttgcagatggtggtgatcaagacgaaaagcgcggagttcatgccgttctcgctctccttcttcctcacgctcagcgccgtcgcctggttcttctacggcctcttcaccaacgacctctacgtcacggtaattaaacatctcgatcgatatcacatcaaatcttgatcaattctctcgaccaattcatgaatttcaatcaaagtttgaattgtttaatttgcgtgtagcttccgaacgtgggaggcttcttcttcggctgcgtccagatggcgctctacttcaaataccggaagcccaatacggctgccggcggcgtgatgatcctgccgacgacggcggctgcggcggcggtcgacggcgccgtggctgagcctgcggcggcggcgcagcagctggcggaggagctggaaatggagctcgcggccgcaggcgcgcacgcggtggccgtgctgccggcgagcgcgctgcccgtgctggccgagctgcacaagatggagcaggagatcgggacgccgcgcaagggcgccaccaagaccgtctgacacgtggctcgcctccattggttgtcgagtgccatgtcatcatcgtgattattatatatatgggcaaaatgcatcatacccagtagtaaatttcttaatttcagctgtttgtttgcgttccatttgtgtgtttgaattgagtttgtattgtgcaattatcccaagaaaaaagaaatgtgcatgtattggttatgattaattaaattaattcgtatcctatcaagcatagttgcaagtcgagactatcttttttcttcctagccattgggtctccaatccaaaggtgagacagcccatctgaacttcgcggtccagtcagcccaagctcattaggcccagtatctctctgcaacatttttgcatttttttttctttctttgataaactcctctagtgaatatgtgcataactgaaatggacgctggcctgacaagatcaaattaaaaccaactcttatgtttgagccatagctcacaagtcacaaaacaacaagtgattcaaacaaatcagaaacaataagtactccagtgatcttgcagggggaggcagtattctatccaagcagactgtttgctaataatcttatgaccatgaggccccagaaaaaaaaaatcacatgcactattttagacttcccaatttatttctacacataaaattttaaaagggaaaaaaaaagagaaagaaagacgagaccacacagcagcagctagtgcttgaccagcctctctcccatgtctccactccagtccaagccgattcacatgcatttgttctgttgcatgtatgcttcctcttcctcctctcctctcctctcctctcctccccatttctcatcttctctctctttctctcttactccaatctgatctccattgctcaccttcctagtagcttagctgatctcaatggcgacaatggcgagctcaggagcagcagcagcagccatggccgtgttcttggcaatggcgctggtgttgagtggcactgaggccaggttcctgtccaacaacatcactgtggttggctctgtctactgtgatgcctgctccaacaacactttctccaagcacagcttcttcttgaagggtgagtagaaatggtagtatacctgttacacagtagctcagctgcattagagttagttttgatcaatgtgtcattctgcattgtggtcaatcaatggtttgttctgaaatatggtggataaacatggagtgtttttacagcaggttattctttgtttctgagatagatttacaagatgctgtaaatctcttgctcattgcacagtacaaccacatgtaggatgtcttagaagtattaggttttttttttctgttctaggaagatgtcactgaaaagtgaaaactaataggcaagcgtgacaagacttctttttgagtacattgattccctatgaatctaaaggagacagagaaaagttgacatatgcacaattgcacataaatgtgtctgtggcttgttctggatttataattggtctggtcaattttcttggtccaattgtaattgttgtttagttttagttaatgctaccatgaaagacaagatgcctcacacaatataactcaagtttcttaggcccacttaaagcttggcatacactaactgaagttgaaatacaactgacaattactacattgtgccttcaattgcataaatgcagtatcatccagcttctactacccatctgggctctggcattgcaaacagaagttttaactggctctgagatgtgcttgttacacagtttcaattcagagttttgatcttttttttaaatggaaaaaaaatgtttctgtcggttattttgagcgggatatacctctaaatctcataatgctatgcaaattacaatgctgcctcaagctagaaatttccatgtttttggctttgttctaaaaataacgatttcattatcctaatagaacatagtgtctatgagttgccaaagtatgacattgcactatattaccaatgcctcattctacattgccactaaaactaaagctaagatcattcacaagagcagctggtttcatagatttcatcattgcattcaatctgaaatctgaacaagtaaaaatcagtaacttaccagatatgaaattgtcttcatctttggcaagaactgagatgctgaagccacaccactaatggccaccatggtgatggatgctgtgcaggggccagggtgctgatccagtgcagcttcaaggtgaactccaccatggccgaggagctgtccctggaggcggagcgcaccacggaccagaacggcgtgtacaagctcgacgtgccggccgccggcggcttcgactgccgggagggccacgacctccggtcggcgtgccgcgccacgctcgtccggagctcctccgccgcctgcaacgtcccgggcctccggggatccacgcagcacatcgccctccgctcccgcgccaccaacgcctgcttcctcaacctcaacgcgctcaacttccgccccgccaagcgcgacgccgcgctctgccacggcggcgatggcgccggcgccggcggcggcgctgcgttcggctcgtcgctcttcttctggccgttcttgccgctcttctggccgccgtaccggctcccgggcggcggcggcgggacggtgtcgttcccgtggccgttccccgtgccggactggctggtgccattcctgcggccgccgttcttgccattcacgctgtaccagccggcgccggcgggctccgcgccgccgccgttctaccgcttcccgccttcccaagaagcatcaccatctcagccttagacctgaaaaagtacaaaaaaaaaacttgccaagattaatcctagattcttcatgtttagcagcaagagaggttgtgtgattgtgacattgttgtaggtgatgattctccctgcatcacacgtgtagctggagctagttcaggaattgccaccgtgttcatcgggctgatgaatatgtggaagtgataattataatgtagtgatggcaacttgttagtagtattcggtatattgtcttaaaatatttcctcgctgcagctaatttttcaatcatatttatatactgatgaatgatattgcagccgctaacactatcttggtactctttttttttacgaaccggcacttagaatgtgccaatttcattgaatagagggagaaatcctgataccgtttttctcacaatttaaacttcattcctaaaggaaataaactggacaactattttgaaaccgagagagtaattgacagatacaaaatagtaaaacttgtcagttgggtgaactcatgaaggtatatgcctgattcagtccagacatgaaccaaggaaaagtttcttcgtctgcgtgtaccagcagagtaactacccaatttgcatatggcacgaggaacaggtacacatatgtctctaaccgactgctgaaagtagagttcatcagaattgattgcttcgtcttgtctcgcggattttactggcatggaacatggtatgttttttgccaagcccaatggttttttgatttcttccagtggaactgacagtgcagtttgacaaggaaaaggggaagcagacacaagataggacacggtctgtttcatcatgtaaaaatgcatggttcagaagtaatttggctcctggaaacacttcgcagtgatgacatttcaaagttcagtttgattcaactattcagcaatcggttccaacatacacaaatctagctctgttaatctgaataaatattctcaaccaataacaaatggttaaacttatacggagtatattcttagacccaggagcagatgtgtcaaattgaggagagttgacaaggactaggcgaccaagactgaatccataacaaaacaaccgaccatttggagcgttgcattgggtgagaaaaagaacaaagaatcctgtttaggctaaacaacccttgtggctggggagttggacacctccattctaagtacaatcatgcacacaggtcaagaggtgtttatagctaaatctaatgcattattgacatgacgccactggcctctccaagtcggccatggcgtcactctttgcacacttgcaactcctgctccagttattaaccttccggtgctgccgtacctcatgtatactactaaatcactgcatccatggaccaagtacttaaatgctatatatgcaatcttcagttgtacttaaattctatatatatgcaatcttcaattgtacttcaattcaatatatctactctttaattgtaattaaattctatatatgaaatcattaattgtgcaagaaccatggatatctgcccccaatccaaaagatggcctttggaccaagaaccttgcttggtccatctatatatatcattcaccacctctcctttcaccttcccacatgttcttgcttaatcctttcactaaatgtgtaaacaagttgtcgatgtgccaccattagaaggagcatttgcaactttgtaatcactagctaactaaaaagaggaagctgttgtatacgtacgtgagcgtgggcatggccgagaagaagctggcaatggcggagagagggcggaggggcctgatcatgaagacgctggaccggtgccggccgccggcgtggaggaggccggcggaggggtgcctctcggtgtacgtcggcgcggcgcggcagcggttcgtcgtccggacggcgagcgtgaaccacccgctgttccggccgctgctggaggaggccgaggaggcgttcgggtacgcggcggcggggccgctgcagctgccgtgcgacgccgccgtgttcgccagggtgctggagcagatcgaggaggaggaggaggagacggcggccgccggcgacgtggcggcgaggaggtgcggcctcgccgccagagggcactccgcctaccggctgctcgtccccggcggccggcctgccctcgccggccggtcgtaggacggtgcagacatgcagtggagtgtttcttgtccatcgacttatcttgagcttgtggctctgatgataaatccacctaaatcaattaatgtatctgcaaatcatgaatattgcaacaagaggttagtgcttagtactagtagttgatcagatcttgggcttgagtttttcttttgttgagctcatattcacagaagatatgtgtatctcttaggtcgcagtaactgttgatcagttgatgcaaatgttatatattcaaattccctagctttggatatttatgatacagatttcccaagctttgaatgtttatgatacaaatctccctaacttggaatgttttatggtggaatgatgcttagaattataaataggttgcatatttgaatgcatctcacattgataagtttgtagtttttggcctcctgcagttcacttgtcaattgtcatgcatgtattcattatttttttataccaagcttctttaagtctactattcaatacatataatattaaaaagactcaatgcttcaaaaaccaaataataagtcaagatagcaattagcaagcaacacagcagaaacacggtgacgagtggaaaaatgggtcaacaatggacaaagaaccagtactaaccagcatgtacagaagattgaattcaaaaaaaggaaaaaaaatctagtgaatcactgcacatacctcctggtgctttgcttggcttgctagaaggttgaatcaacataagggactacaagtattcagcaattaacatctactgaggcagcacctatgctgttattttcagcagcacttgagggacattttgtcaaaaaatccaaatctgaaaatttcaatgtaatatgatatgcagttaatgattaacttttcttttttgctgggtcggccgaaaatcaaccaaccgaattgtattaagaagaaaagagagagttcaggttacaaaacgacattaaactgttgaaaagggcaaacagccaaccacgaaagcagcaaactgatgtccctaaaaggaaaaaagcctgggcacaactaatgtttcagtgttaacttggataacgaaaacaacagcatagaatttaaaatggctaggttccctgtacttttgacatctgtagagtcaaatgacaggggccacattgtttcgctagccctagtatcatccgaaaagctacaactcagtctaagactcggtaaataaaatcaagcagcaagaagaaaatgtcttgttacatgaaacgggctgacctttcaaagaacaagtgttggaggcgagaagtttttttcttatactcgattggaggcgaaaatggttgtgaaaattatacaatctggcataacaaaatctggcaaatcaaacaggctgctggttgtgtcatgtatgtgatcttaagcaaggtgtgggtaaaatattcactctttagatgagttttttggatctttacctcaaattcatagagtcctggttttcaatacttgcctcaccactagaatgtcttcagaatatggattctgaagccgtcaatttgtaaccaaattacaagaagaatgcagttacatggtcgcatacttttaaagcatgtgcagtaattcagattaggcataccaagactgcggttgcgtggtttctgctctacaaagatatcgcaattacagaagttctggtgaagaaacacaaagtacacacccttgcaactcctgaaactgagttcacttattcaatactcattgagaaacagtgactctcaacctccttcaggcggcctcctctgttgcctctgaccactgtgctctccttcttcattcctgcgttgactcgccaagggcgcagcgctttcgctttgaggccttttggcctaagtttgagggattcctccaagttgtgcaggacgcctggcaacctcctgctaaccttccccccctccccgcgcttgcctggtgtttctctaacacggctaagcgccttcagagctggagtgatcgtcacgtcggtagcgtccgcctccagctgcagatggcgaaggagctcatcttccgtctcgatgtcgcgcaggagaaccggtctctctcccccctggagacctggttgcaacgagacctaaagttgaagtcccttgggcttgcctctcttgagcgcaccatcgcccgtcagcgttcgcgtctgctttggctcaaggagggtgacgccaacaccaagtttttccaccttcacgccagagcccgaagacggaagaacttcatctcacgtcttagagacggggactagcttgccgtcacccatgatgagcttcaagagctcgcctcttctcactttggcgccatcatggggacgtgcgttgagcgcgagctcgctcttgatctccactccctcggcctctgtccggcgcagcttggggagctggacggccccttcaggaggtgtgggcggtggttaagtctttgccttctgacaaggcgcttggtcccgatgggttcacgggtcggttctacaagacttgctagccagtgatcaagtcagtggttttggcggctctcaactccctcttcttggcttacggccagggtttctcctccctcaatgatgccctcatctctctccttcctaagaaagatgaggccgttgacgttcaagatttccgtccgattagcctcattcacagctttgggaagttgttctctaagattttggcctcccgtctttctcctctcctcgacgggcttgtggaggccaatcagagtgccttcgtcaaaggccgatctcttcatgacaactttcgctatgtccagctcgcggcaagggctctccatgccagacgcactccccgccttcttctcaaggtggacattgcgaaggcttttgacacggtcagctggccgttcttgcttgaggtgcttgcccatctagggttcagtcaatgctggcgtgattggatctccctcattattagcgcctcctcttcccgggtgctgatcaatggggtgccgggtccgcgcttccttcaccggaggggtcttcggcaaggagaccctctttctcctatgcttttcattctagtcatggaagtgctcaatgcgatgcttcgtaaagcctctgattcgggcgggttccttccgcttaatgatcgcgctttgcgacaccgcgcctccctctacgctgatgacttggtcctcttcctctccccggttcggcaggatctcgagttcatccagggcattctctcggtctttggtgcggcatccgggttgcgcaccaattttgccaaatgctcgattactccgatccgctcctcggatgaggacctggagctggttcactcttgcttcccctgctcgatttctgattttccttgcacctacctcggcattccgctgtccgttcgcaagttgccgaaggcggctcttcagccactggtggacagggtcgctcatcgcctaccaccttggaaggggcgtctcactactcttgctggtcgctccatgttggtccagtctgttctctcctccattccagtccatgtgtctatggcaatcggccttcctgcctgggttgttaaggccattgacaagaagcgacgcgccttcttgtggacaggtacagattcggttcatgggggatagtgccgggtgtcctggacgaatgtctgtcgtcctaaggccttcggtgggttaggaattcctaacctcaggttggcagggttcgccttgcgcgttcgctggctttggcttcagcgttccgggcatccctattgggatggcttgaaggccccggtcgagcagtctgtctccgacatgttcgaggcgtccaccttcttcgtgccggaggatggtgaatctatgctcttctggactgaccattggattgatggaggccactcagtggcctccttggctcctgacctcctcttcgctgtgccacagcgcctccgttcgcgcacggttgcttctggtctggcgaacaactcctgggtttcggacatccgcggggccctcactgtccctgtcatctcccagtttcttcttatctgggatgctgcgctccgaattcagctcttgccgggtgtcagagaccgtcttgtttggcgttggacgagcgaccagcgctactctgcgcgttcagcgtaccaggccttcttttttggccagcactcctttgcctgtgccgatcttctctggcacgcgaagggccctgctaaatgcaagttcttcctctggtttgcattttagcggcgctgctggatggccgacctcctcctaaagcgcagcttggatagtcattcggcctgccccttctgcggtcaagagcttgagacagcgaaccacatcctcctcgattgcgtgttcgctctgcaagtttggctccgtgtgctgtcgcctcttggttggactgcctctctgctctctggggtagctgtctccaagattggtggccttcttctagggtttgcttgccggggcatctccgggccagtttcgattctatggtcctcctagtctcttggcaactgtggaaagagcggaactccagagttttcgactctgcattgtcatcggtctcggaggtccttgagtccatcctctctgagggccacctttggtctttagctggtatcgctaattttggggttctcctgggaaggtagtggctctgccccctccaagctatttggagttgtgtgtagccgtcacagtagtcttttgtctcttctttattttagtcttttttctcccctttcttggtataagtcggtctgactgattgcgtcatgtaacaaacattctattcttctgatatattgacgtgcaattcttttgcgcgttcgagaaaaaagaaacagtgactcagtgaggcccataggaagatatttgatcaagctctaaattcaatagtccctgacaggttcccaggcatagaactttattcagaattttggacgattgcctcaacaaactttgaaaataggtaaaaataccaatatttactggaacctccattcccaaagtcccaatctacaacttgcaataaaaaccaggcgattacagtttctccccgaaaccaagtaatcctactgaccaccaggggagatgcaatgcatcgcaagacataactgtcggaatccccaagcaaaccgcacaaaaatcgcatcgcatgaatactagcgcgctatgatcctaccagtacacagagcacgagtatggaaggctagttgttgatgacttgagatctgcgaagagaacgaacagagcgagggagattcacctgggaatccccgcgcggtggaagactgcgaatcgctctccccggcggctcgccgtcgccgcctcgctccgccgccgtcgccattgggtttaccggaagggcaaacacgcaatatcaaagtacacgaggggtctacgtggaaaagtaccaaacaaatgggctggactcacaatcaattacggcccggcccagtagataccaccacctcacactccattcgcgaggcccacggcccaagtgacgcctcctaaaccctaatcctggcaacggacggcggatacagcccacctcctccccccacgccgcatccgacgctcacgaagcgtccacgtctccccgacgattgctttataaaaccaccacctcctcctcgcaccaccagtcgccgccttcttcctcctcctcctccgccgcccgcctcgccgcctcccgagagctccaccctcgcctccggcgaaatggtaagctcccgtctccggtgccagttgccccccgcggttctcttcccgtggatcttgcgatccgccggcttagattttttttttcttcagttgcagcgtcgatttgtagctttgtattttgtgtgtgaatattgggatgctctaagtaagattttggatggcgaatcttgcaggcaccgaagcgaggcggcagggcgccggtgccggcgaaaaaaaagacggtaatgctcgccgtctctctgctcgaaatctacgttgtttcgttgttgggg

SEQ ID NO: 53683 - DNA, 3052 bp, Oryza sativa
agttcacccgcaccctcgacaagaacctcggtatatatctacatctcagttcgttcatcatgtcggattgcacctggaacgctaattggccgaactggttaggtgttacaaatgtcatttccttgttaggtttgtaattgtagtgactagctgatgaatgtgtcttcagtttatgatgaccttttgggtgttctagtcgaacatagttatctcaaattaatgctggctgtgtcggtattcttgttggcatggtagctctctgtccaaattttattctaggatagaatgttaaccctgtgtcaaaagtggtgcttttaagaatggaaaattgctaaagcagactattgaagttttgctgcagtatatggtggttgtcagtttttatcatgtttctgtttgtttatcactatgattagactcaacgctgtctcttcaacaccattgttatgtaggatcgtgttatcaatttcttagttgttaccatttcaaaaatgaagcaaggaaactcatctgttaaattgttaatttgtgttgaggaattaatggcataaaaaatatctgatgtaaatctttatttgcagcaaccaacctgtttaagatgcttctcaagtaccgccctgaggacaaggctgccaagaaggagaggcttttgaagagggcccaggctgaggctgaagggaaaaccgttgaggccaagaagccaattgttgtgaagtatggtcttaaccacgtgacttacctcattgagcaggtacaggagcttgttaatgtgttcatttctttgttagtcactcatcaaggagacttattcatgggaacatataatcaagcactttactgataatttgaatgcttctcgcgcagagcaaggcccagctggttgtcatcgctcatgatgttgatccaattgagctggttgtgtggcttccagccctgtgtaggaagatggaggtcccttactgcatcgttaagggcaaagctcgccttggatcggtatatttcctgactctccatactcaaattgaatgtacttattgaaagtatagatgctagtagaaagcggagctcaaccttcgcaaatgatcatatgcagattgttcacaagaagactgcatctgttctgtgcttgaccactgtcaagaacgaggacaagcttgagttcagcaagatcttggaggccatcaaggtaagaaaccacggcatcccttgttctctcattcatgatcatcatgttatccagtgctctgctctttagcctcattgctaactcggtgaaccataactttgtaggcgaacttcaacgacaagttcgacgaggtcaggaagaagtggggaggcggcgtcatgggctccaagtcgcaggcgaagaccaaggccagggaaaagcttctcgctaaggaggccgcccagcggatgacctaaattatattcgccccccgccgttgagctcgccctgtagtttcatttttcagtgtaatgattttgacgaggaactcagttagcaccatgcgacagtgctgtggttttctgaagtctagtttcatatattttctgttcaccggaccatgttgggaaactatgcaagatatcagagctttacaatgtttggtttctacgcagtttatgctgtgtgttttgctactcgtttgtttgccttggctgaacctgaacatagggcttgatcactttgatgccattttcagccttatcaaattttggtaaagttacctaaaaaaaagtggatatatttagtttgctgcctaattttggtaatgttaaattttggtaaggttttttttcatcaaagtaaatagccccataaagttcatttcacagccttacagccatttaatttaagcaaaattatgaaagctaacatgttatttttttaattttttgtaatgtcgaaagttcttggtagttttgcattagttgaaagtcaaagtcatacgaaaaatgtcaattttgatggatatacataaatctaagatgcgagctcgcaaaaaattccgaaaccgtaagtttatattgggctagtagtaactctagattaggcctagcccaatttggacagttggcccaagattttacttggagctcaattatggaataagttcaccggagatccctcaacttaacagcgagattttttgagatctcttaaccacaaaaccagaaatcttcacctctaaactatacaaaaccgttcactcaaggtccctaggcagtatatatgagtggtttcgctgacgtggcatcctagttagccaaaaaaatttttttcttctcttttcttctccttctcttttctctcttctctatttctcttctttagtgagagaggccagcggcaggcgcgcttctccttctcttctcttttctctcttctctatttctcttcttcagtgagggaggccggtggcaggcggagcaacgcacgcagatgcgggtggcgcagcagagggcaagcgccagcggagcggcggcgggcgcaagcgcggcaggccgagcagtggagcgcgagcacgaccgcgggcagagaagcggagggcgagcgcggcggcgggtggagcggtggagggcgagcatggcagcggagcggaggtgggcgagcacggaggcgcatccagcccaccccaaccgaccaaagcacaccctttgccctcggccataagccccgccgccaagtcgccgtcgccgtcctcctcgtcgtcgtcgagcggcagcgatgacttcgcggtgctcctcgacgcggagctcaagctcacctccgccgctgactcgacctccgccggagacacctccgccgcaaacgacgactacgaggaagacccctcccagccttccctccttcctcctcgagctccctcacgccggcgcccacgctgcagggatgggaagctaacagtgctggtcgtcgtggtcagctcgcttgccgcggcaacgctggtcccagcgctaaccggctaatgcgtctgcggatcgatgccctggctcatgggcttgcgcttgatgtgcgtgttccacctgcagaaccaatcaatcagcacca

SEQ ID NO: 53684 - DNA, 11013 bp, Oryza sativa
  unsure (1)..(11013): unsure at all n locations
gtgagacccacaccattgtctcacttacatgtgggccacacatattaattttaatttttttttgctggctaggatgccacgtcagtaaaaccacccgtatatactgcctagggaccttgagtgaacggttttgtatagtttaggggtggagatttctggttttgtggttaagggactttaaaaaatctcggtgtaaagttgagggacggccgatgaacttattccctcaattatttcccggcccattatacgcatcagcttgtcaccggcaggtgggcctgggtcccgtgtccccacgtgctcctcactcgcttctcgccacaaagtccaaaaagcccacgagatcaagccgttaatccaacgtaaagacaagttcccgtgctctctaatttcctcttcttctgatctcgcaaacaagaaatccccgggaaaagagaagcggcgggacaagatcgccagagattccacggacggacccaaggtgagcaagctcgatccatccccatcaatgcctgctcggttcgatctcgctacttctggattgcgccgggcgcgtgtcgctggtcgaatcagccggttttttgggtggaaagattacgacttactagtttggtttcttgtttaagatttgtgttcttgggaggaggcggagctactcaggcttgctgggagattgctcgttgtttgtttctgttactgcggttcgatgcgccgtttgtgattcgcgtgttcgttactggattttgcttccgtggatggcggacaaagggcatatcgcgccgattcttggagagttctctagatctggcgggaatgctcggctccttgatttgccactgctcttatgccccaattagatgggaggttttagctcttaccctaggaggatttgtgcatctgttgcctgctacagttaggtcatgggaagtgcgtacttcttcagtgatgtgggaattttacttgtgcgtctaatagtgagaatgagacaaataatttgtgtgtatgtgctaattcacgtgatttttagtaattctacctttgtattttgtctctgcattgtcgtagggagtgagtcagtgagctatttcttgaataccgcactatctacctgctgcttgaatttgaaccctttaataactactccctctatcccataatataaggcgcatacacatttcaagattcaacatttaaaacatttaaccaacacttagtataatattaaatgaattttatttgttaaaaaatatatcattagattgaaatttaaattactttcatatggttataattttgttgctacacttagtataatattaaatgaattttatttgttaaaaaatatatcattagattgagatttaaattactttcatatggttataattttgttgctacaaaccttctaggatatgagaaattataagttaactttgaccatgccttatattatgggatagagggagtatatagtatgtgaatttgggagactgcagttgtgtgttcttatttctcttaagctaataacctcactcgtctttttttgggtagaatgttacagctatttgatagtagttctgtaatcctatgttgatactgtctaaattctatggctttgtgtttcttgcagtaggacaatggaggggagtttgagattggggtttctgttggttctatgtatcttggccttcttgcgccctgctgcagctattcgcttcgtgatcgatagggaagagtgcttctctcataatgttgattatgaaggagatacagttcatgtatcctttgttgtgatcaaggcagagacgccatggcattataccgaggatggcgtggatcttgtggtatgatcttgtttttctttttcttacgtccaatcttcatccatgtaaatactccacaattgtagagtgtggtgagattcttgctttcattttttaataaggaacaatagctggctagatatttccgttcttgtagtctgataatgggcatggaggattgcatatggactccatgttttgtttgatgcttgcatgagcccttgagaactttccagttatgccgcatccaaaactgattcaactttgatatatggcaggttagagatcccaatggtaatcaaatccatgattcccgtgacaagatcagcgataagtttgaattcatagttcataggagaggcgttcaccgcttctgcttcaccaataaatccccataccatgaaactgtagattttgatgtacttgttagtcacttttcgtattatgaccagcatgccaaagatggtaagcatttttctggttttgttaaatttgtctagcaaggagcatgtggttgattcctttactctggaaatatgtagaacatttcagcgccttgtttgagcaaattgcaaagttggatgaagccctctacaacattcagtttgaacagcactggttggaggcccaaacagaccggcaagcaatatgtatgttcctcgtgtcttactctctcctttaaatactagtactttttcgaaattgtaatatgtgaagatctcttgttttcttttatcttgtaataaatagaacttatgagttgtagcaaatgctcaacttttctgtttctgtactaccgacaaactgtcctgccttaggagctccagccttttatgtcaacctttggaccagaccgccacacatgccacattaccaaacatcttgaaattgataaatatttgttacattgatgaacaacatgagaacacacaccatcttcttttctttttcttttttttccctttttttttgtaaatatcatgttctgtcaaaagcaaaatttacagtatctcataaacgtgttttgatgctaaaactgtaatactatatttgtctatctgatgcagtaaacgagaacatgagtaggagggcagttcacaaggcattctttgaatcagctgctctcattgcagccagtgttgtgcaggtctacctactgcatcgcctctttgagcgaaagctgggaacatcgagggtctaattctctgatagtaggtctccttagactcaccaacccaactgtatttcaatgctgcaaaatgtgtttacaatatctgttacatcctgctcagatatttagcatttttgttcagaattttgtaattcagttatttacagtactgtgctgcagtaacttgccgcctcatcagattcatttcagcgcattatatctatcgtcacatgtatattaggtcctaagtatttccacggtacgcactgctttaaaaccttttttgcgatcaaggtacaggagtgctagtattgagaaagaaaatgaagaaagaattccttttctgacaaagactcctaaacttcagctcatcagcattctactttagtttcacaatttcagaatccatatttcgatgataaccatttagtatgaagtattcaacgtttattgagcctgtattatttctgtatttagctgtctggaggtagaaaagctcagacgataccaaatccaaggagatgacaccaaattggtttcttgctaacatcacaccatctgattaggatacagttggaagccatgtgcagtctggttggtcctaaattcttttgctgactggattttttcgtgttatggataatgatttcacaaataatgattggcactactgcttgagccgataagcataacaactctggtattcgcatttcaatgtccagtttggttggtacatggagtcactgacaatcgagtttggaatctctgaccaaacataacagccgcccgtgacacgtatcaacatcaaggatgataaccaataatcttgaatttttcagtaaattctgcctgaagcactgtactttgtaaagttgcatttcagatatcagcacttgttctctgaatcagttgtaactttgtcagtaatttagtagcctgaagccctgtactttgtaaagttgcatttcagatacacgaaatcaggcatcagcatttgttctttgaatcagttctaaacctgtgaaaccttttcatgagtgtgtgagctccaccagaacactacctcactgttcatccacagttcatgctgctgttattaagctcaacaaaaaccttgatgcagtgatgattgcatagtttcaagggacaaggccatcagtctctggatgaatctgaggctgaaaaccgggtcaagttttgtcatggttcaagagaaacgaatgccattgtttgttcagtttaaatcttagcttttacagaacaaatcctaccaaaatgtacacaaattcataaatattacaaacttgttattagattttataaacttattctgatataaaattgatggttggaattataaatatttcgattgaatcatatcctaaacaatcatatcataaacatcaaatatttaggcctgtttagattctaatttttttcttcaaacttttaacttttctgtcacatcgaactttattacgcacacaaacttttaacttttccatcacatcgttctaatttcttcaaacttccaattttaacgtggaactaaacacagccttatatcggaggaagtagttagctaacaccaccttgcaatttaattaatactatacaattatcatcaacaaaaagctcttccacctttcactcttccccactgcccaccactgtactgtacccccaccattcctgtctcttctcttcttcactccactccactccactccactcctctcccccatttggccactagcttaatccctcctcccccattggaaggaaggacaagctcgaggagctcctcctccatggagcgacgtggtagcctgtacggcgtcgcggcggcggcggcggtggtggtggtggtggcaatggcggcggcggccggcggcgaggcggcgaggctgtcgccggagcactaccggtcgacgtgccccggcgtggagtccgtcgtgcggtcggtggtggcgaggaaggtgaaggagaccttcgtcaccgtcccggccacgctccgcctcttcttccacgactgcttcgtcgaggtgagcagcggcggctggcactgacccaaccaaccctcgtgttcttgattcagatttcaaaccggaattggaggcgtcagagtttcagagtcgcacttgcaccctcagattttctggttctaggtttcttgatttctttcgtaattgatagcctcggtttgatttcggcgagtagttagctttgcatttggcatttgaaaatccttgcaaaattttcgcagcttttgcagcttcagagctgcttgtgatgcactgaatttttcagcattactctgcattaggcatttgcatacttgcaaagcttacaaacttttcagctgctttcctgatgcattcaggattcagcttagcagcatgagcagcatgagggtctctgaattttcagcattaatctacatttaattgcatcagagatcatgtcaaaatttggtttgttagtctcagggaaaggagagaaaagctacttcctccgtttcacaatataagtcattttaactttcctcatattcatattcatgttaatgaatctagataaatatatatatgtctagattcattaatatcaatataaatgtaggaaatgatagaatgacttgcattatgaaacggagggagtagtagtacgagataatgagagattaacagtagattaatggtacgaaatggcaactggattagctccaaatcacgcactcgtcgcttctgccatgtgactgcacgacccttttctgtcaactgggctgcgtaatcaaatgctcacgacagatgcttctctgaatccctgctggaataccaggcgccacgttgtcgtatccgatgtggcggacacggaattccgtgccgtccacgtcatcattcctcccatttcatgatgatttcatactccgggttatttagatcgatgtcatttcaaaccatatttttttataaagttgttaaatatatacttccatttatttctttatcaaactccagtaaatacataagaaatcatacaaaaatttgataatattgttaaaatttggtaaggtttattttggcttcagtttaaacagacctttaaatttttgataggtgtgcaaatgctttgatcactttgaaaattgaagttacgtacgttttcaattggcactgaaattattttgggggaattttaaccttttctgacaggggtgtgacgcgtcggtcatgatcgcgtcgcggggcaacgacgccgagaaggactcgccggacaacctgtcgctcgccggcgacggcttcgacacggtggtgcgcgccaaggcggcggtcgagaagaagtgccccggcgtggtctcctgcgccgacatcctcgccatcgccgccagggacgtcgtcgccatggtaaaccatcccatcaatcctcctcctcctgccatggcgaaagctttgctgcctctaacaaggtcgatcaatcaatcaatcaatggcgttgcagtcgtccggcccacgctggaccgtcgagcttggccggctagacggcctcgtctccaagtccggcggcgtcgccggcaagctgccaggcccggacatgcgcgtcaaggacctcgccgccatattcgccaagaacaacctcaccgtgctcgacatggtggcgctctccggcgcgcacaccgtcggcttcgcgcactgcacgcgcttcgccggccggctgtacggccgcgtcggcggcggcgtggacccgtcctacgacccggcgtacgcgcggcagctgatggcggcgtgcccgcgcgacgtcgcgccgaccatcgccgtcaacatggaccccatcaccccggccgccttcgacaacgcctactacgccaacctcgccggcggcctcggcctgttcacctccgaccaggagctctacaccgacgccgcgtcgcggccggcggtgaccggcttcgccaagaaccagacgctcttcttcgaggcgttcaaggaggccatggtcaagcttggcagggtcggagtcaagtccgggaagcatggagagatcagaagagactgcacagctttcaactgaacatagttgcatagctgcactgcgacatttgtaagttgtagcaattggggatttgatcgtatattaaaaatgaaatcatttcaaggtaagaatttcatactttctgttttcggtccagaagtcatggctgagtgatgaaagcgacaaaatgcctcttaagttaactctacaattaaattaaaattcaaaatagccacagctgaaaacaaccgaaaataatttttgatcgtttaagccacggatgataagctactcttgttgtttcaaattatttgtcgttttaggtttgttctaaaccaaacatatctatatttgactacaaatttttagaaaaccgtataagttaacaatacatgaattatatattatgaaaatatttctcatggtgaatctaaaaatataaatattgagatgttaaactatacgagtttatagaaattaatgattaaatataaaaattcttgacttagaacaaaccaagcaatttaaaacggatggtaaaaacaatttatggataaaaccttttattaccattcttaatagtttgaaaagccaatacccaaagataaacttcgatgcaaatatctgaatcaacactaaaatattttagttttaaaatttaaatgttagctacggttaataagttaacaacagtctctctctctctctttctgtctgcgcaacggcatgcgcaaatctgacgttcgcagccgcttgcctgacgttgatacgtgtagcttcagaaaacaaaactggcagagctttcttgtggtggtagggcaatggccactgcttgcttcctggggttgctctcctcttgctttcaagacccatacttttgacctaatcacccaaacctttccttgctgttgtctgaacacgggccatcttgggacctactcaacgcttccagcatgcatggacagttgccagtagcaatcagatgctactaaccattttcaggttcagatatcagaagatatacagagctttcagatcttgctgtcttaacaaggatccaggtgttaggtcatgtccagaatgcctgaattcataccgaaatactatcccgttctaaaatataagagatcttgaaagtgcaaatacattgccaaaatccctttatattaccgaatagttcaattatggcatgaatcaagaaaaatcctggttcccaaaacagagcccttgagacagagtaaccatcctaaccaaaacagaggcaacagagcagctccataagattggagacaatcagtctgacagtgccagttgagcaaaaacaagatacaaaccttgaaggaaaagaactctccaattctgaaacaattataggatagatgtaataaataataaaaccaaaccgttctttttccatatgtacaaagttttctgttaaagcttgccatcctaattataatatataaaaccatctaagcttgttgcggcgttacatggtaaaaatgttgtccgggaaggaaaagataggatggcaacaacgtaatgccgcccaaactcttctgcttgtatacacctccatgagaacctacttctcattcaacttcacatgtaggacatgaatggaggcttggaaaatatataccctgccagaagatacaatccaaagctcttgttatacgataacgttggaaataggtatgaatgcaataaagacaacaactcttaaaagcatgatagtgatgataatagtgatataggcatgatactgtttacagtcagtaggaccaagaaaggaattgcactgatatcatatttgaacttatttgggttgtaatagctgatcttgatggtgaacttaatacatccgcattaatttaccacagaaaattgatgtagaatactgttcgtttgtgaggaacaagcacatcaaggttggcagggaaattgaggttcagcttcacctgtattacacccatataaagtattttctaatttcaacaattaactagctatatcaatttttctagatgcattgacagtgaaatcttgaaaggtgaaaggaatacactaggtcaagcttaactaggctattctattcttcctgggaatctaagaaagctcttcttctcgattgtcactagttgcatttagttcctctcaagctcctttgttcctaagaaactcagcttgtatcccgtcgaaacgaacaaagttataaacttaagctttctggtctcctacttagcaagcacgaaagcgctcaggcatccatttcattgttatatggccctttttgactctatatgtttacagctcctttccccctttcagttcatatggtcggtgctcaccgacgcaatttagtcccttacgccctttcaatatcgaatttcatcaacctgaagctatagccagcctctctacatcaaattagagatccaaaacatttgagaatcatctggattgcatcgacaaccaccaattctgaccctttccacttcttaccatcgcgtcaattttattttaactacgacaacaagctgctcacattatttggaatgatgtcctcccgaactaaatcaacgcaacaatcctaataaaaccacaatttaaatacagaagctacacatatctcaattttcagagaagcacccaaagtatgacagatgcttcacaattgggcataatttaagcaaaggcgctcaatttagcgcattttgaactctgataaagccaagaaacaccaccaatcatcatatttaccccccaaattacgcatgaatccacagtgaattccccaatcctgactaacccaaacatgtaaaaagaggagcctcttcccttttgtccccaaacatgtaggagccctactcctaaacggccaagatcacgtacatgtggaggccaccttgggcgaggaggagcacgagccgggccagaggatggccctccagatcacggacaggttggtgacgaacccgacgaggaggaagacgcaggcgaggccgatgacccagggcatgaggaagaaccccagcatgaaggtcaccgacccgcacagcatcagcgccaccgacgcccccagcagcatcgacgccacccccgccgccgtcacctgccgcggccacgccgccgcccnccgcccgcccccttcctccggccacgcccggagcaccgtcagcagcagcgcgcacagctcgtacatcgccctcgactggtcagcctccgccgcctccgccgccgccgtcgccgacgacctcataccacccccaagaattcttcaagaatcgaattcaagaaatcaagaaccgatcgcctcctcggcggtggcgcaagaatcttggaggaggcgaattgggtcggagaaattggttgtcgggtcgggtttgcttctcgatcgctctctctctcgcgttggtggaattgaaatggcgagatgggggaggagagacatggggggagatgttgaaatagaggggggaatgggaaattgggaatgggcggagacgtctacgctacgagaggataatggtaggctggatttgtttattcggcagttatttccggtgttggcgtggataactgtgcaactgattggttgcgttggcggtcaaatttgcactagcacttgttgaatcacaacgtttcaagtttatggaaaacacctcaaaatttgtactccatgctcgtaaaggaagtcgtttagaacagcaatacggtcttcaaaacacaactttaactttttgtttctataaaaatatttattcaaaaagtgatatatttatacttttataaaagtatttttcaagaaaaatctatacatataatttttacattttcaaattcaacaacttgagagttattcatgatttatatttctaaggtttgatttaaacattgtcctaaacgacttcctttatgagtaggaaggaagtacttctttctctgtcccaaaactacttcaaagtttattgtaatattttaaga

SEQ ID NO: 53685 - DNA, 5930 bp, Oryza sativa
tgacgttttgaggcttaaaaatattataatagtactatagatttattgaacatgtgaataccactctcctatatatagtgctccctccgattttaaaattattgatgttttgggacagaaatctcacatatcaaggaatgattaattgtgacgcttctctccggtgtcaaattagttaacgtttggacttgggaggcttgaaatatattataatagtactatagatttattgaacctgtgaataccactctcctatatatggtgtccccctccgattttaaaattattgatgttctgggacaaaaatctcacgtattaagaaatgattaattgtgacgctactccctccggtgtcaaattagttaaaggcttgaaatatatttcaatagtactatatatatttattggacatccaaatttattataatgaaattgaatctcaaggttcataaatctaaccacctctcttatatatggtactccctaattattgatgttttggataaaatctcacaatgccaaggaatgattaattgtgatcctactcactcggtgtcaaattagttgaagtttggaggcttgaaaaatattataatagtattgtggatttattggacctgcgaataccactctcctatatatggtgctcacctccagttttaaaattattgagatttttggacaaaaatctcacgtatcaagaaatgattaattgtgacgctactccctccggtgccaaattagttgatgtttggaggcttgaaatatattataatagtactatagatttattggacatgcgaatttattataatatgaaattgaatgtcaaggtttcataaatttaatcacctctcttatatatgtactccctccagtttcaaaactatttgatattttggacagaatctcatataccaaggaatgattaattgtaatgctacacctccgatgtcaatttagttgaagttggaggcttgaaaaaaacattctaatagtactatagatttattggacttgcgaatttattaaaatatgaaattgaatgtcagaaattcaaccacctctcttatggtactccctccggttttaaagttattgatgttttcgacagaatctcacgtaccaaggaatgatttgtgatatgctactctctccggtgtcaaattaattgatattttgaggcttgcaagatattacagcagtataatatagatttatttggacctgcaaaattattatgatatgaaattgaatgtcaaggcatcataaatttaaccacctctcttatgtatggtactacctcctgtttaaaattattgatttttttttgacataatctcactatcaaggatattatatttgttttttatgggacggaagaagtagatcgcggtttacaaggaaaatgctggcacaggtcttaattaattagtggtatctcctgttctctgcaccctttggtaattttgacgacgcagtgttatgcacaaaacacgtggtgatatggtgcatgtgcattattatcaatcgtctctattcttcatttcagagatggcttgctcattcgtgtttcggacagtacgcaactccctccaattttttttttaaatctagcattataacggatgaagtaacaggaattataagctaatacacagcaaagatctgccgaagtgcattgtttttttttacaaaaaatacttatatattctaagagttaagtgtacgaacgggctataaacttgtgtgcagatatattatctagatctctaaattcttaaaatatattttcaaattatcaaacttgttttggatataatatatgatcaaatgagctttatcctactccatacggtgatgtagcatgtcatggtgacttttacagatcattagtattttttaaaaaaaaaacatgtttttctccttttaggtagagaggacaaaagataaaataaaaaaatattgaaaaaaattaaggtggagaggagaaagctaaggcgagaaaagataaaattaagaaaatactattaacgcatagctaggcatcactttgatatgtcacgtttagtatatcacgtcagctcatgaagtagagtgggttggaattcgtttgaatctatatcgacgtcgcaccgaagacaagttcagaaactcggaaatgtattctgaaggtttaagcatctagctagatgatatacttagggaccgtccttgtctaatataatctaattaatatatgatctaaacgtgcaacgcgagggttggagttgttaccatctcgatctatggtagtgttacagaatgcaagctggagcactgattgcgatcgaggtacgttgtttataatataatgtaccccgatctagcttgattctcttgtccttgttgcaacgtgttacacgcgaggaagtcccattcggtttgagacaacgatgatgagaggagacagtagcagcaggtacgcgaggaaatcgtgggcgacgacgtacgtacgggtgccgccgtgcattaatggctgcgacatattgtactacctccgtcaaaaaaaaaaaaaccgggtttccgtgtccaacgtttcaccgtctgtttaattttaaaaaattatgaaaaaaaaataaaaagacaaatcacgcataaagtattaatcatgttttatcatctaacaacaataaaaatactaattataaaaaaaatttcatataagacggacaatcaaacattggacaccgaaacctaaggtttgtctttttttggacagagggagtagtagtagtatcgttctagatagtgctatatattgagcaagtttaatagtatagccaactattagctctagttcatctatagccaatttaatagcttatttatacaatagttatatactacactattaatatatggtcccacatctcatacacacacaatgtattagagtctgtgctgcagctggctacaaatctgaagctcgctttccttctttctctactgcacatgtgcttacaggtgacttgtagcttgctactgtactcgctcttaggttgtacaaatagtcaccacaggattagtttccgggcaatccggggcaacgcaaactgtgaaccgcgctggatgtgtacgtcgttgttgcttgcacatggtgataacatgggcatactttgaactcgggttgcacgtactgagagcatataagtgggtcgatccgtgaatctacttatagcctcaacgtaccgatttggtacaactcgtcaggaacgctacgttcacgccaaccccgcatttcgatcagcttgtagccttgtatcctcgacgtaccgatttggtacaactcgtcaggaacgctactttcatgccaaccctgcatttcgatcagcttgtagccttgtagcctcaacgtaccgatttggtacaactcatcaggaacactacgttcgcggcaaccctgcattttgatcagcttggtgacgaaagcgtgcgtttacgacggttgtgttcggtagtttgagttgggaactaattaattcctctcacatgtaaaagggaataactcattagtttatgattaattaagtattagataattgtttttaaacatagattaatataattttttaaaacatatttttaaaaaaaatacaaggttggcaatttgaaaagcgtgtgtgcataaacgagagaatagagttgagaacttagtgcctcttagatttgcatgaataatgtaggatttttggaaaattctaatcctatggaaaaaaattcttatgaaaggcatttaaataaaggattgtatcctatcatatcatttaaaattccttttgagtctttgtctcttattcaattcctataattttttatgtagttcaatcaaacggttattcttattttttttataatactctattttacaattacatttctactagaatcatattcttttattcctattttttttataattcttatgattcaaggggactttagggggtgtttgggaactagggactaaatttagtctctcgacttatatttttgtgagagggactaaagtttagtcccaatttagcccctccaaccaaacaccaccttagactcccagacacagccgaacttgccaatttgggaaggctgccgtctgtaggaattaactgccgtccaaaaccgcagatcgatgtcagtgtttggtgatggtctcgttgtctgaactctgaactctgaagccgcggccgccggtctcggtctccagacatgtgggttcccgccggagaaagtgcaaactgattctagtgcttgtcgcgaagcgtgccatggcgagcgagctcgtcggagacgacgaggcagccgtcgtcgtcgtcggccgccgcacgcacgcaatcccgttccggcccaactaatgattagccggctgccggcccaatcgacatgggccgtatggcccgagttactgtttgctccatcggcccggcccaagctagcaatcccatatgggcccgagttgcgtccgatctatatatcgtgcggcgaagatcaaagggggttaactgcaaaaatacgcacgggctggccctacgttttgatggcagttttagtgcagatgaagtggatgattcttggattcagatttgtttcatcgagccacctgaagcgatgcacaatccagcttggagatgaagtctatctgttggagttttgcctcgaaatcgcacggggagtaacatcctgattgcactctgttttcaccataaacattggggaaatttgaagcagtgtcttatattttcgaaagatcaatgagaatgcttacggttttaattttttcgcttatgcttatacttatcagtcatgattttttttggcaagaatattaaacaaacggaagatcccttattcttagggcataatatgtagtgtttggttcgaccagtccgatcaaccagccaaacaaaacttcagtttagtaactgcagtattacaatcgatttgtgggaccagcaaaaaagaatcggccaatcactagtctgtccttcatgcatgcatacacaacaaataattttttactcgttccattcgattctaattcgaagttcaatttgtcctctgataaatacgattcgacagctacaaatatacattgttcaatatacattaaaattgatttaatgttcacactgaagatgctcttattcaatattaaaacaattgaccaatgtggtcactatgtttacaaaattaatgaaaacaaacttcccaaatcccaacccttatagtaatgttttgacacatgatgactaagctgttggacgttcgtcaccatgaagtataagaacaacaagtttttagtagttttttttttttggataacacaagtttttagtagtgatggcccttggtgcggccgcaccccatgatggacgccggcagccgcggcagcacgtcgacgccctcctcgaacaccacgcccatgcccatgtacacgtgggcctccaggtggcagtggaacagccacacgcccgggttgctcgccctgaacctcaccgccgtccaccccatcgggtgcagcgccaccgtgttcttcatcacggcgccgcccctcgcgctcgccgcgttcagacccggcccgtccacctccggcacgaacttgccctcgccgtagccgagcacccagaagtcgtgcccgtggaggtgccacgggtgcgtctcgctccgcccgttcggcggcgggatcgccgtgttctgcagcaccacgtcgaccaccgagcccagggcgaggcggtacgcggcgtggcgcacggcgaggctcgccggcggggagggaggttgaggctcccgtggtcgtagctgtccggcggcggccgctggtcgaactcgccgcggaggccgtgcttcatggcgacgaggtacggcgtcgccgggaagctgagggagacgcc

SEQ ID NO: 53686 - DNA, 13595 bp, Oryza sativa
gcggcggaggcgtacctgacgacggccctgcccggcgccgtcttggtggggtcgcggctgacgacgtgcgacgccgcccagtagctccgggacgggtcctggtcggcggtgacgagcacggagtaggtctcgccggagtagatgaagaggttcttgaccaccaccggcgtgacgtagtacccgtcggcctccaccaccgtcatcgtgtgcccctcgatctcgaagctcagcgacgccagcgacgtcaggctgccgatgcggaggcggtacgtcttccccggcgaggcggtgaacagcgtcggccacccgcactcgccgccaaacgcattgcacgccgcgccaccgccattgctggccgccggcggcgagcagttgaacacgcctctgccgttgatcagaagcgactggggctcgccgacgaacaccatggggacggaggcgaggccgacggcttgctcgtacacgctctggtgccaccagtccatgaggaggacggtgtgctcgccgtcgtaggcgaagggctcggcgacgccgtcgggcaccgacacgacgagcatgccgtccagccccgccacgcgctgcatgccgtagtgcgcgtggtacatgtacgttccaggctgaaaccatcacaaaaacacccagaaaatcaatcaaaatttgctcatccaaccatccaagcaaagaactaagcatcgatcgatcattgcacgtactccctccgttttagattataagacgtttgaccaagtttattaaaaaaatagtaataattttaaaccaagataaatttattataaaatataattaattattaatttcataaaactaatttggtaatgtaaatattactatatttacttataaaattagttaaatttgaagcagttaaaacatcttgtaatctgaaactgagggagtagctgcttaccctgtcaacgacgaatctgtaggtgaaggtctcgccggggaggatggggcactgcgtgacgccggcggtgccgtcagcccacgggctgccaatctgcgacgacacattgccgttagaacaatacccacacggacgaacacatgatcgccggcgagccggcgacggcgagggggatggaacgaagatgaagaatgacctggcggatgccgtgccagtggatggcggtgttctcggtgtcgagcatgttgtggacggtgacgacgagggtgtcgccctgggcggcgcggatggtcggcccgggggactcgccgttgatggtcacggcgagcttcctgaagcagtccggcgacttgtactggtacgtgatgttccacgtgtggtggtgcgtcttcgcctccgccggcgccgccgccgcggcggcgcacaggcacgccagcacggcgagccgccacgtcctcatcaccgcgcacaaagctgacgatcgagctcaaggattgggattttgcgacggatcagaggcttggaaatgatcggtttcgtgagcaatcggcgaggtgtgtgtgtgtgcgcgctttgtgctttgcactgctctgcctcgaggcatcgagtggatttatatagtttacgcgcgtcaaagtgggtgtgattttgcgcgcgcgttcataactgggggctggggctttactaccaggtcaagcatgaagcagctacagagctcaggttgaagcgttcgacggtgggccgggccgtggctcgtgtgcgcgtgtgggggcatggtacttcgtcagatcataagcgtgtgcgtggctgtgttcgctagtttcgtttcagttgggaacatctcccatgaaaacggagcggtacataagcgcgtgactaattaagtattggtaatttttttaaaaaaatggattaatttgtttttaaaaataactttcatatataatttttttaaaagaaaaacacactatttagcattttgaaaagcgtgcgcgcgaaaaacgggagagggggagttgggaacatgagggaaagaacacagtcaagtgggagtatctgatatttagcataagattttatcaagatcttgaaacattgactatcaatagtttgtcaattaatagtttgtcaataaacgttggcatacgtttaaaattaaacagaatattaagtactagtagttttataaactttaggctccacttgaatcactggaatgaaaaaaacggagaaataaaaaaaacacatgtttctaataagaatataagtgcaaaacaaaggactaccgaacgtagaaaaaacacagaaataaccatttgattagaccgcaggaaatacaagaatcgaatgagagagatataatcgaagaaagttttcaagaggttggagctcttgctaaatttcctccaaaatcattatttactccataggatttttgaaggataggatataattcaatcatttgtttcaaagaaattttcctacaagattaattttttaaaaaatttctctgttttatatctaaattaaatgggcccttattctattagacagatgaagttagagtgagtatatcgtgtcctaatgaacattaattagtagtaatcctatatatttctttatacttatatacgttgctcacttagtgcaattcataaatactatttctcttttttcttataaagccacattactttaatactagtttctaatacttatatgattaattaatgatcttaattgtgttcctctttttacaaaagatacatcgtctcaattatttgtagacttagcatggtcaacctatggatcatattgtctcttgtctcttataaacaacatcatctggatcaactattctaccgttcttaataatagatcaaagatgcatattccgtaacaacgcgtagtatctagcatttccatatactaattcgcggtgatgatttccatgacaaaatatcatgtttatttcgaggagtgtggtcaacgaagcgtagctctactagggtttcataaatgctacttcccctccgtcaaaatatattaactttacaatttatcttaaatagagcgtttacctactcacttatctcaatcaaatatagccatttctcatttaaatctacgtatagaagctcaaaagtgctttatattttttggacaggaagaaaagatagtactacttagggcacccacaatggttatctataaactctctacaagagatccatgtcagcatattttcctacttggaagagatgaaaaaagagagcaaagctatctactaatgtgaagatagtctatagagaaaaacgaggcaatatattagagagctatagatacccaagtagacatactattaaggtggtttactattaatctagtctattgctgagatgtacatgttttacagagagcaccttactttactattgcgggtgctcttatgttttatattataaatcgttttgacttttttcctagtcaaactttttttttacgtttgactagatttgtagaaaaatataatagtatttttaccacaaaacaaacatattatcaaaatatattcaaatgctagatttaatgaaactaatttgacgtttaaaatgttacttttcttctataaaacctagtcaaatttaacaatgtttgacttagaaaaagtcgaagcgaattataatatgaaatgaagggactagtactttgtatgttttaaattacttgtcgttctaccatttaaaagttatgccaaaacacttgtcattctcatattccaaatcactttttaaatgcttttttcttcttacctttctctaacacaaccatgctagtagtagtctcttataaggaattctaattcttactttgaaaacatgattaatatgtaattaagaagaattgcaatgtaatttgctatgacttcgtacgattttctggaacgacaagtccaaattaaaacataaaacggaggaagtataaatatatatacacgcttcgttatgcaaactagtactaataagcaaactaccattaatgcatttggcgtttgaattaatactacgagttgtacccgttgtctatcagtggagattgtctacagtagcagccactgacatgtaggatcgggttcacctatcagccactgctactgcaaatgtagtactgcgaagatccatgtccgttgtctatgcgtgtcgtgcctgctctgctctttaattggtaaaaagtattggttagggctgaatgcaaaatgcatgtactcctggtcctggacgcatgcttaacgaagacgagatccagtcgaagccatctttaaaaaaaatgaaccatatatatgaataaaaagcaaatcactcaagttgaaatgcctgcatctacattttcgctcgtacgttcgcaatcacagtttcgggtcaactaactatctgcgactcggacaagtacgactgcttgacagcccaactacctgggctacttgcatgtttcttttccttaattttcatgcagaccagcatgctcaatttatgtacaacgacagctatttttttagacaatgatgtacaacaactaatcagttaacctaatactcctatatataaagaacctagaatgcacatgagcatggtaattaaacctcgacattttattatatttgacacactggatatatagtcaataaactttaccgcaaattatgaaatgtacaggcactgcactgtaccatacgtagtttttgtgcagcatataaccataggctgtcacgtacggccttttataccacatactagtccttgaacgcttaataataattaaaagtgcgtgcatcacatcagaaaagtttcaacacgctagcacacaaacacggaattactagtctcactcttgtaggagaagatcaatctaatggtgcgacttgatctgtgtcgtcacatccgtttttattggttgtcgcatcggccttcaggagttcagggtagccatgtcggcatgaaggcagtcacgcatgagttgttcatctgctctggagtaaacctacgaagagaatcaaattgtgttaagggtgtgtttagttcacgccaaaattagaagtttggttgaaattggaacgatgtgacagaaaagttgaaagtttatatgtgtagaaaagttttaatgtgatagaaaagttgaaagtttgaagaaaaattttggaactaaactcggcccaagttcatgtgtagagagcattccatacctttttttagcacagaataaaatagatacgcacgattgagtggacctccttagtaatctagtaaggctagaaaaacaccattcatatctcttaagcatgtgttaaaaaagcttactcacggatgtatgcgtgagtgggtgtacgcgcgtgtgtagtggtatatatgtgtacgtgcaagcttttcccgtaataatgaaaaaattaaactggatacacaattggtttcaagaactaatgagatcagagaaacgatcatgaagctgaaatgagtaacatgcattttatacccgatctgcaaggtgggctcggcggcagcttccagggaatggaagaatccgttgccaccgtgcggtggcacctgctggacggcatgaggcgactgccgctcgtagccgagtagggtggcgccgtgctcccacacttgtccatgcaactggttgctctcctccagcttttcctcgcaaacgaatcaaacattagtagtgctcgttattcttttctcacttgtgtttttttttttcatttcacagcatcattttggttatttcacagagctacgtaagcaggcgttagccaggagatatatatatatccgaggaagagatgccaggaaaacggacctaaatgcctaaatcgcaaccgaaaacagtgtgacctcgtcttgatcaattgttaatatgcattgcttacgtgtgagagatccttatgttaattaatatgcgcagttgaagtaatatgctgtctacgaagcttcatgtacgtattcgttatgtagaaataaccaataccaaatgttcttttgtaatatatacaattcatcctacaaactaatatgcatcaacgtacacaaacttgtccagtttctgttatacgcccttacaaaccatattttatatgttcacatgtttgtaagtttatgtggaaggaatatataaagtgctaactaaacactgatgttaacatctacacattgaattcctgatcagattaaatttagtactacatggatgcggggctttgattttgaacaagcacacataaaagtgaagtgtataaattacttttaaaaccacatacttagttcatgcagaatcttaagatcaagtaaatgcatgaaacttaaacgggacaaggaattaaacttacttttcttctgaggcacttatttgcttcacacaacatttgttcctgaaaatgatttaggtatataaagttagttttggaaataataaattttcttgcctgaaatacatagttggtaagttttatgtcaagcttgtaccctcctctggagatcagtgagctgatcaagcatatgctgtgtctgcaacaagattagagttaaatttttttcaacatttctgaaacatatgtgagaaacagttaacaaattacccttgtggatctaatgtgcctcaaggatgaatcaagttgtttctcaagctgctctagctcttttatgccaagtgtcccaagatcttcaccaagaagattcctgtaattgtcaacagaaagatctactaagttaggctgtatttagttccacactaaaattgaaagtttgaagaaattggaacgatgtgaacaaaaaagttggaagtttgtgtgtgtaggaaaattcgatgtgacgaaaaagttaaaagtttgaaaaaaaagttggaatctaaacggggccttagttctgtatattttacactgtgattgatgcatgcatctaattctctaagcaacttcagtatatactactgcacgcatctaattctctaagctagttctccctgagattactgttttaccacttgtaaaccctatataatagagacggcggtaggaccttcattggttcacatatattacttcactcttgttaacactagtcatatgtgttttttccatgcaatatagttttttttttcacccaaatggccaaaaagtatctagtgtacacataattgttcttgccccaatacacaataatttatctactttgcatatatatgaatgaaaccaattaactgtgctccatttcgtctttgataaaattgaactcataagtggaagcctgatattacctttgggtcctctgtaaattttccacccgtgccttcagtttgaggtactcattgcggctgctttgcactaactgaaaaataaatttaacttcagtacaaagaaataggaaacaatttagagattctatgtgaaaacaaaataatataatttcacatgcaaaattaggcttatgaatgaacaatttattagaaaacagtgatattaattcatgaatccatctatcatatcatggtcaataaccagtgactaggagcttttctgttttatattcagatctacatactagacatttcagctagcacaaattagagttgtaaatcagtgttattacatgtggaaacacaacaacaatactcattctagttatagcactctttcatatgcaaccttttgcagtgctctcatttttcattaaattttgagtcttgtagcaacatcacatacattaagaagcacagcgaatatattaaattaagacttcatttttaattgtactattcaacacgtgtatatagttggtaattaatgataatactaaaagcagcatatctaggatcaatcaattaaactgcatgaatcgaattgttgaagtattatccagtgagacacagatcgattaatcagaacacaaagctagtctatgcatcaacttaaatccataaaagcttgtcataactcactaaaaattaaaatatattaatagaatctagtaacctcattttccttgttctgtattgcagtatctggcccaccataactgaatttttggtatctttccaaagttctggtcatgctgcaagtttcaaaaacacaaatggctatgtttatggaaaaacgaaataaaggaacatatatagttcgcccataactaaatactaacaatctagggcacattcttttccggggaccacatcgattaattagtagatgaaaaatcttgtttctcacaaaacatgaacattagctccatgacacggatgaaggtgcttgcataattggagacaatttctaagaaacaataacgttttatcttaattcttgcatcggtagtttcaagttgatttataattttatatatgtccatgatatcaacctagaggccactttttgtaaagaaaatggagtacactctttaaagagagatatcaagttcagacgacacacaatgaaatggcataacttcacgcagactactactacagctataatgctcacccccccccctctaccgcgtcaatttagtgaccttttggctgtgtttagttcaacgcaaagtttagattttggttgaaattggagatgatatgactaaaatgttgtgtgtatatgacaggttgatgtaatggaaaaggactgaagtttggatccaaacacagcctttgtttaaacaagtcgtgaattcagatttctgaaaaggatctacagtacacgttgagtatcaatttgtcggcataaaatactccactgaactagctctagctagaactagaagagacatctgatgaagaccaatcttctgtactgacagctcagctacgagagctgaggagaccaatcgaatgacaatcgaaagctgtcactaactgtaccctgcagatactcaagtgagtcctaggaatattgtgtactcccttgcaggatttcttccgaggagcagaggagggatgtttcactcaccccatatccaaattgaattccctggtcaatgaaatcatgtactcttatttgtgaatatatttaatgttagaattttataggcgtattaattttaatttagtaacttaggtataatggaaaccatttaaacataactataaaaattggcaagcatgtactccctccataaaaaaagaaaaagaatgctaaagtccccatatacttacggctgattataagccataacggcttattagcaaccaaaatataatttgtgagtaaaattgtatatgtgtctttagcgaattaaaagttaatgctgaaaaacaatctacattgacaaaacattaaaaatcaacttctaaatcaagtttcgaaattcaaaatttgatattggcttataattcatagggtaaaagatgaggccctaacttctagctataaatctggacatagcctatatatgtccaggtttggcaaaaaagttggttttttctgcaacggagcatataataatgtaatcattatctaaaatatataatgatgtaatattcactatagaagatattattaaaatgatcagtgcaatacaatgagcaagaaaatttaaccttctaaagtttggaaaatgtatgattcaaatatgaaatgaagctcatgaatgcctgacttatctaccctaactaattgtttatctctaaacacaataccaaatgttttcttccccccgaaaaaaaatgttttctaattcaaaatcaattcaactagcttatatgcggcttgtgaattatgcctagccaatcagacgctctgtgtttctgaaagacaattatatatatagtagtatatgatttttcatatacttatctcaggagaaacagactttatatttattgatgttgcctttaatgatgcaaccataactcacttgaaaaacaatactcccccgcggccatcccttaaaaaaacaaagagacaaaatcttaagtgaaacccccaaatcttgtaaggtatgctgcctccaaaccgtggaattcatgcagtgaacgtttgtttagacacacatccggtacatggctaatgatatgcatgatcccttcacacaccccccccccccaaaaaaaaaaaatcatatataccctaaaaaaaattgcccctcaaaaaactaaaaattgaggaaaaaaacagatcccaagggaattcgaaactcgcataccctccattaggagatcgataaaattaagattcgaagcttccaacgattaattttctccgtaaaaatcgacttgctgatccaggcttaaatcctgaatgtcccatcccatgcatgcacataaattaatcgcaattaaaccaaactcaaaaccattaagcgcgccatctcaaaaccactactaccacgggatcagaaaccctcagatctacgtatttcaccactccctattacgctagctagcacccgatcgaacgaacaaaaaccctaattattcccacagaattccaccaacttccttctcccaaaccctcccaaaactcaccaaaacacgagcacactcgcagatccaccatgtgcagccccagatccccgcaaaatcgccaccaagaagttcacaaaaccatcgtgcgctccagatctggaggcgcaggcgcgcgcaagaaaccctagctagctacgttgcaagcagctaccgatctagctatagcagatcgaggcgcgcgcccagtgcgtccatgtatatatacctttggccgctgcagaactcgtagagcttgccgcggttggagaagatgatgagggcgacctcggcgtcgcagagcacggagagctcgtacgccttcttgagcagcccattcctccgcttcgcgaacgtcacctgcctgttgatcttgttctcgatcctcttcagctccaccctccctctccccatcccgatctcctcctcctcctcctcctccacctcacctcaccgccgctcgagctcgatcaatcgcgagatgaatcaaccaatctcgcgaagcgaaagagaggggaaagctaaggcgaggaggaggaggaggagggggaaggggatgaggggtttaaaaagggaagggggagagggtgggcagcggcggtgggggctacccggcattgccatttccggcaaggtggtggaacgacgcggaaccctaggcggcctcgatcgatccatcgtacgcaaaggcaaagctatctaggttaatttcgcactaatctccgacccaattcaatgcgtctctcactgattgctttggattttctctctctctctctctctctctctctctcctcgtcgacgcagcggtggcgactgaggattcgacaggtcgagaaattaagcgcggaaaagctggggaaaagtgagtagagttgggcgcttttgcacttgaaacctcggagttttcgggtttcgggaaaaatacccttcttgtgtccactaggagccggtgggtgatctgttgggagagcttaaggctttgttagtttccaaaataaacaattttcacccatcacatcgaatatttaaatacatgcatggagtattaaatgtggaaaaaaaaccagttacacaatttgcgtgtaaattacgagacgaatcttttaagtctaattgcgcctgatttgacaatgtggtgctgcagtaaacatttgctaatgacggattaattgagctcaataaatttgtcttgcagttttttgacggaatctgtaatttgttttgttattgtaccacatttaatactaatgtgtgtccgtatatccaatgtgacaaacaaacccaaaaattttccccaactaaataaggcctaagattttgggaaatagctagttagtatcaagcttctgagaatatggagaatgtggatttctcagcttctgttttctagttaattttttagattctataattagagcttttgagaatttggatgaaaaactagactatgtagagaggattaatatgattttgagagaagatacagcggtcagaaaatccccatacagacccttacaacttttctcttgggttgcagttgcaaatcaaagcagcaaaatgaaccaaggtagcatagtatatatctagctagctagcgatgtggttgccaagttgccatagttcgtgtagacaaaatggagctgtttgggtttggatagagagaggcttcttcgatcggtatatctctttgcctgcagagaactttgccgttgcagtgcttgcagtagtagatatatatgtgtgtgtaaggtttgaagtcttggctaggcaggagtgtatgttctttcattttacctaattggtcgtgattctgaagagatcgatatatattctacctgggatatataggaactgatcaaaggattaatcattaatgtgtatgtaactttggtgtggtaacgtatcacagatgttaagtgcaaactagctagctagagatggacaaattaggctgcaggctaactaattttggttaagttaattagtatccatgcatgctgggaactcaaattagcaagagggggagatatatgaaaagcaaaataactagtatatgttataaaattaatgatgtattcatgttgtggttaatttaattaggggttgactgttggcacggggtgtccagtttataaaaagaaaagttaacatatgaatttgacatgtgctatgtatatgtgaaatgtcaatgaattaaaccgtccctgtaaactttttaaattgtggcttattcagcattataattttttttacctttttttctagtccaacatttcaaaggctgaccaagtttataaaaaaaacatactaacatttttaagataaaacaaacgtagtatctaaatatattcaatgttagattaaatgaaactaatttgatattttagatgttgctaattttttttataaacttgaaaaaaaaagtcaaatcaacttataatatgaaatgtagggagtagcgtgcaaagattacattaattttgaagtgcattgcaaattttgtgcttgtggatatatccggttcaatttatcaatacaataaagttgaatgttcaatatgtagtatcatttgcactttaaagcttagattaataagtatataatggtgcatgctaggtatatctatattatacatgcatgtttttcctcttaattacaactaatccgtacgtatacgcatgcagaaataaccccaacaaaattatgtacgatacagtagccaacccaatgtgttatataccacaattaacacggttcgtttgaaaactacaagctcaggtcagcttaggcatgccaggatttggcatttcgcaaaaaatggttggtcatcggtttgtgaaaaccgatcaatattagttggttttcgtacggtgttaaccaaaattcatcagtatttaacggttctcaatggatcggtttgcagtaaacgagtggaaggtggttctttatttcaaaaaaaaaaaggtaattaaacatgggtatgcaagactatcacatacggaataatagctcagcaaattgagccgttcttttcttcaaattcctcaatttcattagcacttttttcaaactatttaatggtgtgtttttttttaaaaaaaataaaaattctatatagatgttgttgaaaaatcatttttaagttataattattaatattaattaattatatgctaatgaa

SEQ ID NO: 53687 - DNA, 19741 bp, Oryza sativa
agaaagagagagagtaaagctttctactaacatggagatagtctatagagaaaaacgatgtaatggatgagagatctatagatacccatgtagacataatattgaggtggtttactattaatctagtctattactgagatgtacatgttttgttttatagaaagcaacttactttaccattgcgggtgttaaaaagctacaccacccacacccatcccccgcacgcaacaacatggttggtgcgcttgactagaccctgaagcccccgtcatcgcgtcgtcggcaggcacacctgcgagcccaacggtccggaccgggtgctcacgagatatctgcaggcaattttaatctgggctatatatatatatatatcgtcccatctcgcgcgcgacttgatcgatcggtgatcgcgaccggccggcgtgacggagtacgtacgacggacggacacgtaccgggtcgatcgatcggatgccatcatgccgcgatcgtcgatacgtaccgggcccatggtattcgtccgttcgatgtatcgtcgtacccaatgccatggacgcgcgacgaacgatcccggccgccggctgatccatggatggatcgatcgacgtgaggacgcggacccagagcagggagagagccgtgtgtgcgtgaaaaaatcccggtagattttggacggcaaaagccacgaaatggcttggctagcttgctagtactactccctccgtctcataatgatttatcctagaattacgaatctggacatatatagttcccatatagtccatatattaggttacaacgttatggaacggagggagtagtaggcagcttgaatgcttgatctatcggcgcgtcccgtccggcccggtgcctgcccacaaactactcgcgcttgcttgttgctgccttgcaatcaatccatcaatcaaacgtctcaacgatcaatcagttcaatcagtattatgtgtgtgtatgcgacgcagcgaccgtgtcgtgttgtgcttgtgcagttgtgcgccatttccattggcgtcatgtgactcatgtcacatgggcccaagacgacgacctaacgtgggctgcagatgggccgagttaattaccactggccgagaaaaagcccagacggaacagagctcctcctcctgctgcagtgctgccagtgaagtttctgtacaggaatttccatggaattctctgccgctatactcttttaatgaattaaatttgaaaatatagtgttcattcaattattttttgttagaaatatttaggatacagcacaaatataccatcggtctcgtacaaccattgtgcgaaaatgacgcataaatgatttcacgaccggtatcgtgcagtgaaagtgcgagaccgtgcggtctcgctcaagcaaacaacgataccgctcaaacaatcaacgctatcgctcaagcaaagagagatatcgtgccttgcctatttaattagcggttaattatactgattattaattaatcactaatcatgataattaatcactaattattattagttaattgttaattaagtacttgatcactaatcaaatggatcccattggacaatgtcacagatggcttctgcagtctcactcttccattccgcgagagaccgtgcggtctcgcgctttcgccgcgcgataccatccgtgatgttattcccgcgtcattttcgcgcaacggaagtgcgacaccgatgatatatttctgcataattttttgcatcccaaatattccttagaaaaaattgaatgaacggtacattttcaaatttaatttctcttttaatcaccggtgaatgtccacccgtttattgcatgtcatctaaattattattatttttttaaaaaataattgacaagatatgtaatatatcactacacaaacatgtaaattaaaatttaatttctacaaattgtaacataaacaacaaataaaactcaaagtagtgtatatatatttgcagttaaatttctcaattttgttacagcttgtaaaagttaaatttaatattacatgtttgtatagtgatatattacatattaatctatctagttaattttttaaaaataaatttataactatttagttgatatagttgatatgcaactaatggatggacgttcacccgatgattagaatcaatctccattctctgccaatttctgtgaaactttgctgctgctcagagaggtaaggtaactaaaacggaagcaccacaagaagagatcgaataacactgcacatcacaggtagtagtagtagttactaattacgggaggaacagctactgatactcttaactcttaatgataattactggggaaggctactaattaagctactgccacgagaatgggagcgacggcgacgtgccgtcggaggagccctcgccgccgacgtgaaacatgccgtggtagttcatctcgttctcgttggagcccggcaccagcacggcgttcagctgctgctgctgctgctgctcgctgtccatgctcgggcaggcgaacccgccgccggcgacggccgcggcggcgggcgagctggcgaaccacggcgagctgccgccgaactgctgctgcaggttggggaccaacggctgcgccatggggatttggtggtggtggtggtgctcggctcccgccgccgccgccggtgacggctggaccatccggctgacgtcgacgctggaggagttggccggggatgacagaagagagagagcacaatcggagtcgagcacttggtggtggtggtggtggtggtgggcggtggtcgtcgtcgtcgtcgccgtcgtcagcccgtcggaggagaacatcttgttgctgctgctgctctccggtggcggcggcgcgacgacggtggtctggcacaccgagatctccagcgtcgccgccgccgccgcgccaccgccgccgccgaagcttatctgatcgccctcatggaggaacgggaaccgccggccttccttgggggagaacgccgccgtcgtcgccgacgacggcgagccgacgaaatgcggctgccggctggtcatcaccggatgagggtggtgatgatggctgtaatatggggtctcctcggatttgatgatcccaggccagcttggctctggtcttggaggagtgaaggacgcgaaccttgtccctacatttgaatacagaactaaaatggccgtcattaaaacaaatccgacgaaatgaaatctccattatgtaaaataaataaatgaatgaatgaaacaagccctagaacagctactaaattgttcggtgtggaagaagaaattcagtccgttgatttaactttaaagctccagttaatgtgggtatctggaatttcatctcagattccaattcttgaattaagtttgagtgattaactcaccatgcccactaaacacaataacccattcatatatgataataataataataaatctgacaatagtatcagaaaggtaaatatcaattgaaacataatactatgcacaacaagatataattttttttgctgttttaactgaaacataagggttgcattgtgctctctaagctccatgtaatatataggcaaacctatcatcgatttacacaggaggaaactagtagaacttgcggaatacgtaagtatcaggtagattactgaacctcggttctacatgctacattttatgagcaattggggtataatttgcagtggcatattggtggagtctagatatacattactttttgtttgctttacagctcagatttctggtttaagcaagagaggacattacataatttattttcaactatgtcattagcattcaacatactcttcaaaacaacagtttttaaacaagaataccttgttgacttgtcataaagctgccagaactcatgctatctgcctgtggcttcctgcggcgtcgattgtgcccatccaagcgttttctacaactacgcttagcctcatcaaactccccaagcaagtgaaacctacagaaatgaaaagctatgatgagaattccaaacatcaaaatccttttttagtacttaataaatctttataaaacaaagcttgattgttatactaggaagtgaaagggaaaataaaatagagctgctttaatgctgaaaaggtagtgtgagttctaattgaagcaaaaacatattcagatgtacttgttttatctcagagataaataatacagtacatacgaatacttcaaaattaatggggctcagatgctatttaaaagaagaggaatgatacgtgtatttatttgctgaatattcaataatagcacccagcttcaattaaataaaatggtacacggctggaccaatcgtatttcaatgtgtcagctaataatttcaatgcatggggattcagttatataaaagttttgtactggcctgtcaagcacaagagaaaaaaaaacagtacaactttggcctctgggacatttggaccacggtataatggttccagcaggtatatggcagtatgcatcccaccagcctgttgcttcatgaggatcaccttttttttttgcaatgagcactgaggaatacttgataaagactggcaagcaatatggcattttaattttgctccactgggcatctgggagagggcaattaatcgttgcaaaggagtccccacaggatataaatttttcaggaggtggcgaatgattggctgataatatttgtactgtgttaaaggtaacatgatgcagaggtaatttgctcattatagctcaacaacgtaaaaggacatcacaaaaagtccacaactgaactagagatgaacctaatacaagatctcggcttgcgtagtatttttataaaataaaaaattgacaaattggaggcgcgcattagctccagagagtaggattcatatcggcagaaagtggaccacattatactcagttggtaagagtaagcattatgcttggaactaatttagaaaagcagctacagtagttgttatgtcctgaaggaaaaggattttcttttttttttttgtttgtggaagcaaatgattcagctggaaaaggacgaccatgctttaacaactgttttatttcagttcagtagtcaaataacaaggatgatgttcatattcctggaacaagatatactcttgaaaattaaatatagcttttactgtacagccaaatcggtcaaaatttcactgatatcttacccaaaaaatactgatcgaatttgaaaaggtgcacacaaaccaaccccaaaacacacaaaaaggggtaaggcaacctattgggtgtatttatctgatttgtaattagttaaccattgagtagacattggtatttgtaagggttatctggttgaatgcactatacagactgtagttagctttcaaacagcaaccttgttggtcccaacaacttaaataaagagcatagctaataacctgaagcaaagcaagccataatataaagcaggttgcatgttcaatatcatctttacaaatcaacagtccctcataataaatactgttgcacaaggatccacggaaaaaagtgaaataacttgtatggatctggtcactgattcagaaaggaaagatctaagcagaaaagggagctaggcaaacatgtcagaaatggggcctaatcaaccagggtattacttaactaagagacattctgattcttaaactcctcaaagcaaaaaaaaaaaaaaagaaatcacatagatcctaaactacctacctaatgtgttggaactccatttttactcttaaattttgcagctgaccacaaaagaattgctacctgatgtcaatgacactacccgtgaaacataataaatttcttcggcgatacaacgtaaaattcacgaatttccagttcattcatcactttcaaacaaaaaccatgaagaaagtggccccagggataatgtgcacatgtagcaggtatcataacaaaagacccaactccatctgatctttggcacatgaaatgcatcagtggctttttagggataataattaccactgatgggtcagaaagttactagtgcagaaataggaaaagaggaggttataattcaggtataccggttgccaaggtaaagtgcaacaggggaaaaacttgtggtacatcttatgaaaaggctgaaaagttggcgccggaaaaggtaaagctgtgcatccttggaacaagacagccagaaaaatgttcatctcatctcatctcatctaatctctagtgataaatttcttggaacaattgtgccagggaaagggaaagccgaggccaaagaaagaactgatttggcctattcactttgaataaagggaataatcagcagtgaaaagaaaaggatgtagaagagataaactgaaccccaatcagtcagtgtgtgttcttggttgcggccaatttttattatttttttccatcgcacaattcaggcaatgatcttttgcaaatcacaatccgacgtgacacgattgcgggcagtcatcgattcgggaatttaatcaatgtgctgaatttagcatggctagaattggatatgaactgaaaatttgccaaattttacccgattttcttgtgcttttttttctttttttggttcgtcagattggtttacctgctgcactgctggcagaagcgcatctcgcggccggagacgacgacgacgggagtcttggagtgcggctcgcacaccttgtgccgccggtggtagtcgcggtgcttgctcaggtcggccttgcagccgtccacggcgcacgacgggcactgcccgccgccgccgccgcccccgccgcgcggccgcttcagcgtgctcgtggacggcggcaccttcgccaccgaggcggcggcggcggcgctcgacaccggcgccttcgccgcggcggcgggctccttgagcgcgtccgcggcgccgaactcgccgagcccgccgagcttgaggtcgacagagcactccggccggcccggcgccccgcgcgacgccgccaccgcggcaatgcccggctccgccgcgctcgccgccgccgccatgttcggcacggcgttgtgctccagctcggccaggtcccaagaaacaggcatcttgagatcccaatccatggcacgacacggctccactccacgccacttgttggcaacttggacacctcgtcgtctacctctcgctttcacggtgaggccaccaccaccaccggaggaggaggacgaggaatggccggtttgtcgccaccgcccgtcgctctcatcccacggacatgccgcggcgaaggtggcaactagcggcgaacgaacgaaccaacgaattattgatcgcaaacaccgagataccaacaaatcgagcgccaagaacagggcaaatgcaacagatcagcagcagaagcagaagcttatcctgatagggatgagagacacactgaaacacacacacaaaaacacactctcttcacacagcagaggagaagagagatgaccagcagctgcagctgcagctgatgctgatgctgatgctgctgctgctgctgctgaatgagcaagtgaaattgatggtggttgtgcttggctttgctacttgtagctgctgctgctacacaacacagcacactgcacagatgcagcacaagtgcacaacacaacaagaatactctaccaccaaggaggagactagtagtggtaggcagtgagtcagtactactcctacttggtttttgcagaggaggcaagtgcagactgcagagttgtgtagtgttgtataggcagtgagtgagtgatcttcatcagtgatgaggggaggaagaggaggaggagaggtggtcatatatatatatatatatatatatatatatatatatatatatgtgtgtgtgtgtgtgtgtgtgtgtgtgtgtgtgtgtgtgtgtgtgtgtgtgtgtgtgtgtgtgtgtgtggcattataatactccttctgtttacagataaccatcggttttgactttgagctgttttgcttccatcaatagtggctttagaaataattttggctattaccatcaaacctgtatcattcaattgaggagtcaaatgtattttttaggaattacttacattcaaatctatctgcttgtacatcgcttaaatcgtacattaaaaaaatatcatgctgatgtgtttaatgaggctagtcctaatattacgactgtcatttaaacagtagcaaataaatgtggtttttggtgtattgccagggcctttcagctcgatgacgaattccttagaaagtcgtttacctcaattgaataaggtctggtcgaatgagttgtgtttatacaacagacgggtaattgtttgtggtgagggtgttttaccctctccactgtggtttcctacttcttaataaagtgataggcatactcatgtatattaaacaaaaataacagccagagtttatctacctctaatcaaaacaaacatatatttgtgaccgaaaggagtataacatacattattttacatggaaaaaattcttatattttgggtagaggtattagtaatatacttgtagtaatatgttttctagcttggcttgttttttgtttgctgcatggatggtctgatgcagtgtttgcattgcattgcagccattcatctcatcaaatccctgacagggattctaaagggagcaaacaatgaatgggggtgggatgggggcccccaagcaccacagggccatgttcatcctttaacaccagcatggagccattgtgccgcaataattggggaggggttggtttggttgaggggaggccctggcctcttggaggccaagtgcaattacttttcttggcttcttgttagcagaggtttggtggtgtgtgttgggatttattatttaggtgccacaaattaaaacaaatcaaatggctttactgtcctgctacagtagcaggggttgtgatgtgtgcagctcagtgttgctatcttctgtcttggggtcattgtttgatagtttgctctctaccttactgaaattcgagaaatggggtatataggtatatttggttcggtaggagaattgtatttacgtgagatcaaattatgatttttttataataaattgaaaacgtagaatattttttattgtgactctttcaccgaattgtatacggaactttcgctgttataaatagtgcgtgtgatttagatagttgaaggttacagttaagaaaaaagtttctttcatggaagaaaagtcaaatattcatagaaaactctaactggtctatgttttctgatttcataagtacattatatatatattatggttctttatatgctatatgctgttggttcttgtgtgttcctagctagctactgtgtgttgaaatctgattctttcttttcttgaaaatatgcaagctgatttctcactgggattgtagtaacaaatggcgcaaatgtcacccaaacttcgtatacatctcattgtcaaaaacaaataagcttcacaattaacacatgtcaacttttagcccggtgattcaagctagcgtgaaaattatcacgcgccacgtcactgttgtttaatgtatggttgttgggttgaactcttaacaaacattcatgctaatcattttgtgtcaaaaactccatcttatagaaaataataaatttaataattaactagctctacatgaaggatgttttaaattgtcttgacacttatccccttgacagagaaaaggacatcaaccttaaaactaagagcctatttgcagctgctttgtaaggtgagtaggagcaatttttaattccagaagtgtgtagaccacacattctgactccaaaaaaaatctatctgagcaaacttgcacttgcacacattagtttaaccctaaaattcaagatgttccaactgcacctctcctgcaggtcactggtccatttgatctaaaaaaaacagtatatcatggtccatttctccatcacaagtacatattattaattttatatatcactagtttatatcttgtcgccacatgtagcaccagaccaattcagaatttggtgttttttatatacacagaaaatacttttaaaatgctttgggggttcttgtttgggagggagcctgtcctttgcctattgccaaggacatggggctgatttgtttgtttgttacttttgggtgtccttgacttcttgtgtataagggataaagggcttctaggtaaaaaagaaaagaataaattggatgataggtgaaggattgctctatcatgataggccactctctctcacaccatgtagcctttattttgcaaaaattgtggaggagatagaatgattggttacataatgtttctcctttgtaccttgtgcttcttcttctattttttaccgcgtttccatctgccagttaatatggcaaaattttccccaatatatacactccttacataacgatgtatttccattgcgccttataaatcttctgacaaatattaaataaacaatggaatctcagaaataagtaagtagccattacttgggttgttgataaccatgggaattatttccccacaaacaatagtttgctatacatgttttgcacaatttttttacccacaagcaacatcacttccaaatagcagtatcctcaatatgcacctttttttccctttaggaatacgcaaaaggcattcatataattgcattatgggaattatttcccaccaacaataatttgctatgcatgtttgtacaattctttttactcgcaagcaatgtcacttacgaaggagcagtattctcggcatgcatatcttttttcatgaatacgcgaaaggcgcacatatctcattacattaagagttttgatgtgtacatttaacttccagaatttttacacgatttgaatttttggggtgtggattgatttgccgaatgatatttctccttttgtacatgttcttttttaaaattttactgtatttgcctccttccaacttgtataagaaattaagaataacaatagcttgtgccacataacctactgactaataatagtataaaatacaaatgggattttagtaacaaagtacgtatagtcagtattatgataattgataaccatgataattactatcatttccctagcaagaaaaatacacttgatatgcatactttaatttgcataattctttatacacacaaatagcgtcgcttccaaatgaacagtatcctcgacatgaacattttcgcattacgaatctcgactctcgacgtgtacctttagcctttaatttggattgtttttccacatttttttgcacgcgttcgctaaattttacttctaacaattaattaaattggcatccttgtgtccaaaacaaacaggtagcagtaatagtaaaaacaaaactactccgtgtgtcgtaacaaaatttaaatttccccataattaaatgttggtcgctcgattggcagattggcaagatgggatgcatgtgtccggggagcaaatgcgtttgcagaaacggccaagctgcgtacgagtgaagttgacgccaattgtcaaggcatgaatgtcactgtaagctccaggggtatccaacgaactttgtctttctttctccctctcttttcttttgggttagttgatgtataacaaacttgcatctcaaaagtcagaactactataatggcatccaagaagccaaaaaaaaaggaaaaaagtcggattaaatgactcaaaaaaaagtactattccctccatcccctaatataagatattttgacatttttgcttatgttgtttgaccattcgacttatttaaaaaaatttaaaattattatttattttatttgtgacttattttattatccaaaatattttaagcaaaactttttgttttttatatttacatataaactttttaaataagacgagtggtcaaaccgtaaaagtaaaatattaaaatccctactactacggcgcattctgtcaacatgtggcttcagaacttatagctagtactggtcctagatgtagtcatgtagttgtccaaaacatctagtagtacctaatttgggttagtgactaatcaggaaataatcgctaggattatgcccttgccaaactagggatgggttacggtgataatgtactggatgttcttaattaacagcatatcgattaatccttaattaacagcacattaattcatgtagatgatgattaattgtaggacagacgcatgcatatgatggcacaatgaaaccaaacttgtttttcttgaccaaaattgcacgaaatgggaaaaatctagtacttcatggtgggtgcctaaagtcctaaaccgtgggtattatgctgcaagttatcaagctgtaccggcaaagtacctcttccactgagctagctttttcttgtttggtgggctcgtaaactagatcaactctcgtaatcatacgctctctacggtcacgaaaacatatcgttttgaacattgacacacacaacatgtacaactaatttctgttgcccgaattatttgaaaactagataaaagtaataattataagtttttttgggagacaaacttatacctatacattcatctaactattctatatgttttttttctagataataactattctatatgttattggcttcttcaataattttataatatatcacatccatgttcgacattttcaaaacatgacttgaaaatggagggagtaattgtcaagctacgtacgggaattcataagaccaaagcttggatagagtacaaaagagaagaaaaaaatctcgtttttcacgtgcgtgtttcccaaactgataaatagtgtgcacttttacgaaaagtttctatagaaaaattatttcaaaaaatcatattaatctatttttcaaatataaattaatactcaattaatcatacactaataactcattttgttttacgtattttctcaaccttcactcttcctctcctctcaaacatagccgataaggagacgtgagttggcttctagtaatagctggttgcggtgcagctgcaaccaatgcttctgaatatgcctttagagatcatatagttgtcaaccgcttcatcgtgtgtttccaccagatttaaccgttacgattatcacggagcgacctacctaaaaaagaacacgcaattatgatagtaaatatttccccctttgaagtttttactacccaaagcgacaagtttttacccccgtaacaaattaaaaataaatgagaccacatgcagccagtagcatggcgtgcaagtgggatattgagggaactcatcaatggacagttggattggttttcccactgtttgggaggcaggcggtggttccctctctctttaatgtgcccatcgctgatgccagggctttctcttccttccttggaggacaggaccacccaaaataaaactcctctgcctctgccttggctagtgaattcatacagccaggttcataatccccatgacagataaaaaaccgcttgaatgatatatttggatttcacgaaaatcgttgataaaaaccgacaaaaaagggtagaatacaaacaagtattgttaaaaaaaattatttaatttttttaagttgaaggaaaaacgagtggtttgtggtccagaaattcatatagaatcgtaaacgtgagaagttcttttaacaacacatagacagtgtgatgtttcgtatcgatatagcggtaaaaatattataagtctacaaaaggctttagtcatgaaaacggaaaaaaaaacacaccacgcgtatactactagaagccactactgaagagcaaaactcttcagcaaaacacaacaccctaaaaaatatatttcaaacgatacctcgaacgaggatatgataccaatagcgtaaaaataaattattcaaaaaaactaatgtaacacgctatgattgtatcttgaattttcataactacatattgaataaactaagcggctaatatctctttgtttgtaaaagtttttgtaagaatttattttaccatgtatagcatcgctcttctttttcccttgcctctgttaccctctttttaactcttctagaagtaaattcatatgccatgttaaagaaaaaagagagggagaggaggcaaattcatgtgccactcgtgatagtgatgcaggtgcttcgtagtccacacaagcgtgcgtccctaagatactgatctgcacgtcacaaaaacaagccccctttttccaataccgcctagctcgaaaaccatcaaatgatagtatactcccaaccatgacagtctaagtcgaccaaatccacacaatctaagagcaagtttaatagtataaccagctattgtacctgctctgagacacatacaaactccagcaaacctctaccgaaagatcctcatgatgttagagacacattgatagctttctataaacaccagtacacatacccatcaggatgtccacgtatcagtgactcatcaacatcgctagtgtttgataaattaacaccattacatacacccttctgacgtgagatgttcacatatcactatattagtgactcattgacgttgttagtgtttgataaacaccactacatgctcccatctgatgcccacatatcagggactcacagttggtgtctgccaattggcatcccacttgttagcgagacgtggatgttatttgcctttttgttttggtttattggcttagacttttaagtcagtttaaattcatttttcatccatcccacacatatcaatacaaaactaaaaaaactggaacacccccaattctagtgtaactattttccatcttatctactcccaatacaaatattccctactttcacaaactccaatgcagtgactacctttaaagtaaacttattttgaaacaaataaaagagattaaaaatgaacctaagcctcaataaagaggcccttaaacgttttgactcataaattcgcttataattctaaaacaaagggcatcatcttttctcttatacttatacttatcagtcaaatttaaatttttaaccttaaatttggagttgattttggggttttttcattgaagtttatttttcagcctttgcttttagatcgctaaaaacacatatatatatgaaagttttattcacaaattatttttcatttacaaatacgccgttttgcttattctccgaataagcgaaacgatggggtccgaaagatggctccaataatttttgttcaagccaagaatgcatatatatagccggaagcccggaaatatatatggatgcgtcccattcggacgtagcgatctcgcgtcgcgtcgccgtcgggcgaggggcgagacgcaacgcaacacaagcaagcggaggcgaggcgagcgtgcgtgcgttcgtgcgggcggtcgctgggcgcgcgggcgggggggagcagtggcggcgacggcgacgggtcgggtcggtcgctttcggggcacatgcgcggggggcaggggagaaacgacggggtttaatgccgcttttgggcgatttggaaatttaagttggatcacctactggtggttgctcttttatttcttcacgggttctttcacacctttgctctgcggctgccctgccctgccctcggtgacgagctcgggtttaaagcttaaaagtttcttttaaaactcgagaagaaaataaaaagattatgttggcagaattcgaaatggatgtttgtaataatgttgcaggtgcttgtcggatgcgatttttctttttctttttctcttttttttttggggggggggggtagctgatctgtttctggaggtgtgaattgtaacaagaccaaaatgggaggatcttgggaccagaaattggcacatttaatcagcccccttaagacagcactgtgcgccagcgattgtaggttgaaacttgagagagagagaacagcacacacaaaaagacagaccagtgaattactagtactacctttgccttgtcaacaaccaacttctgtggctgttactcctactatactgtacttctgagtgcatccttccattggatggagttacaatttaaagcaaatattatgccagttttgtgctaaaagtcatctgattgggaaaaatccagtgacatggacaccctacaggcataacaattctccaattagcccaggggaatcagaaatcaatcaatctaatcagctcgatagctagttgctacgaaggagtattctcctacaggtagatctctgtttcaggctttctatgttatccgatcaggaggagcaaatgcacggacatgtaatcggatcaggtgcaaaacgcaaggacatcaagttgcagcgacaaggcacggatctccacacagttgagcgcaccaaccaacattccggactccagaggacagctctcttcttggaaagaaatgctcccttcttttattacacttgcatatggcattccacttccacaccaaatatcatccttttcaggcatgtggcaataacatcgactctttcagcaaccgcaacgcaattcaaagttttggacccccaaaaaagacaagcggctgcgtcctagcagaactacagaaaaccgtgaccacaatctgcgaacaccaaacagtggacgaaagtcaggaatagttgaagaaaaataggcaggtccgtctagtaccctatattagtacttggagaaaataaaagcagtcccttctaagtacccaatataagattgattgtaaaacattgggtgccatgagcctgtaacatgtcagttattagaaagtatcaaccataaatgtcttgctgtagatagagtgcgtctattaatggcataaaacaattctactaggagtagtttgtaaaaacagtccagtgacttttagtaaaatatacgtataattttcaattcttggatatttaacttaaatgctttcaattatccttattaaccttgattgtttaaaaggattcgtaccacaaatcatctggcaaccatgtagatctgttcactgctctacatcaatgtctgactgttcacctttattggaacctacgcgctgcaagaggaaagaaaagcaggcgtatgagagaaatatatacatactccctccgtcccaaaaaaggcaaaccatgggttttcgtgccaacgtttgactgtccgtcttatacgaattttttttataattagtattttcattgttgttagatgataaaacatgattaatactttatgtgtgacttatctttttaatttttttcataattttttcaaataagacagacggtcaaacgttggacacggaaaccagggtttgtctttttttggacggagggagtactccagatacaaagaacagagaagcaaatagtcatagcacaaatatgatcaagccatactctcccaaatactgaaattaatagcaaagcaaagagattttcctatttccagctgtcaacataacacttacagacagtgagacaaattattttgctaacagcatataacaatttaagtgagaaggttatcatgtaaaagagcagatgtgatttaccatccgtttgcttatatatggtttcatctcaagggacaacttgttgctcttctcttcgtgaggcttatggtttttctcaaactctttccttgattcctttcttgtaccagattgccagacaccaccaaagttagggagccaactagaatcagatgtttctggaacaagttcacctcgtttttccatctccatttctgctcttctcctctctgcccatgcagctcctacacgctttgggttaagctttccagattttcctttccgagaggatggacgagcataaccactaagtgactcattctcctgatcacgctcgctagcttctaaccagggaggaggagcacccatgtgcacatttgctttcaagccttcataacataacgatattatgttaaatttcacacaacaataaggaactaaaaatagatatctttcatttgctagagctgcagcctctttctgcatccaaattagtgacatgcttcaacagaaatcgttacaaatatatatatatatatattagaaaaactgtaaaagtgtgtagtaccctgactggaatttccaccagagtttctctgttggacctgaaaaaaattaaccaaataggaagaaagcagtcatatcttaatcatgcctgacatcaatgatgtatacatgaataataatgcaacaaagtacgagacaatatcaacgcttgcaactttgcatcagaagagttgtgggtaattatgcttcttttaaggaaattggaacctgcaagctaacagagaaggcttttttttgggggggtaaaagagatactgttagcactaagatttgaaactaaaaaaaatacgtttagcatccccacaactaagatacaagatacccaaaagataaaattgacatgctcctgctttgaacgacatcgactaaatcaattttttttccttgttcgaaactctgaatagaaaacactcgcttagttgttagctttgcctcaaatttcacagcaatgaaacacaataatggataacatccaaaggaccatttgcaatacctttttatggaatatacgcatgtgcacgtgttgcttacttacatgaacagaacaagaaaccgatgaatttggtccatttccgaggatagtaagttgaccacctgtggagaaaaggataattagcaaaatactactaatcaaatggtaaaataatacagtaaggagcattttaaaactcaggttcacctttcatttttgtgcctgcactttgaaacaagtctgtacccagcataacctgttgttcatgtaatgcaaccgatccacaaggtatgatgggcactccgaaagtctcaaatggagcagaatacggaatacttccaaaggaggaagatccctggcatgctgtactattggggtagtatgccccattagtaggactttgtaaaggcataacaacattagatgcagtattactagaagacgggatgtaagtttctgcaaaattatccaaatgtttagaggtagatttatttcggatatctttcagtggccccagagatggtccaatcaacccttcggtcgacgtctcttgttctgtactcgaagactcgcagcacttctcccactgaaatatcagaaacaccacatattaatacaccctccgcggctctgccacacctgccacacctagagtgatgaaacaatgtacttggtagcataaaacagacagcagtgcaccttagcaagctcatcctccgaaatcctaaacgaatccacctgatccatcccaccaccatgcttttgcaggaaagccttcacgccatttaggtgatcctggcttgcgagatgataaatagcattgctactgcaatagaataaaattgggctcagatcaatatagtaatatgtaagcattgaaacttctttctaatttaccctcaacgctaatgtaatgttgctccaatagcgccctagccctaatgcacgggaatccgacgctactgttcaatttgagaactcctaagggcaatccgaactgaaactagaaccaacttatccagatcgaggaaaccctaggagcaaggggacgagttgagtaccaagcgaagcggctgtcgaggtcgacgagtcggcggagcagaaggggcaccagaggggctgcag

SEQ ID NO: 53688 - DNA, 9922 bp, Oryza sativa
tttcaatttggaaaatttcgtgccgtttggaacaaaagaaaattttccgttcaaaagaaactctttttcacattattcttttatataggagtttacataacaccggcccatatgtatttttttttcaatttgatatcgtataaatcgcgatttgttattttttattttttgctgaatcacagctgcttgacatcccagttctctaacgagtgatttccccactttgcacttgttgatcttgcatcaatttatcactctttctctataaacaactctacacatttcacacttgtatattggggtaagtacctcctgctgagctgcacatgctcccgctactccctgggttataaatgtactccgttttaacttctactagcgtttgaaatttattcagaatataatatgatttattgttttctatttagcctatcatagccacatttaaaattttaaatattaattttagagttgatttttttttaaaaaatatgttctagcattggtttttagccataaaaaacatatatagacaaaaaatatctataaattattattttagtggctaatatgtgttacgacttataaccagctataagcagaatgctcaaactctcgtctcaaccaatctcaggtttcacagccatattgtatttaattaatctactacttactcatctcaatcgatcataattatctcccattaaatttcacttacttttatctccatacaaaattatagacactcttgcaatttgagacagaggaagtttctctattgcttgtcgagagcatcaaatattttgcaaatgaactgtaagctcctatttggagtgtttaagattttaagaagcggcttgttcatagctctaaaaatgttgggtttctaagagtttattttctgaattttacagttaagtattcctggaatgtgggtatttcaatgtttagggtagttgaagatccttgaaaaaaagtgggacgtaaatcctggtttaaaatgcaagaggccggttctcgtcttccttatggatgccttgattgtacatgtgtagaaacacagcacactacaccgaccaaacgaaacgaattgaccgatattaattcgtgaaaagatggacgctcttgtagtcgtagacaactctccagagcatactattccggtcccgtacgtaagaaacgccaacgaacatccattgccgtgacacgcgcgaggcggcaggtgtcccgtacatgctcctgtgaccggcctggtaaaaaaaaaccacagtgcaacgcaaagtacacatcttactcccatatactgatgcggcggcgatgtccatccaatccaccacaaatctaccagacgtttctgtacactgtgcactgttgaggggcaccatcaatgatgcataaacaaccggcaccacattactcccaggaggcgtgaccaccgcgacaatgaatataacttgccaacttgggatggcaaccacaggacgcgatcgatgccctccggctcccccccataactcgagtggttagcgcaggtgtaccgcaaagaggacggcagaatcgaaaaccaaacgcaggaggagcagccgcgatccaggagaaactgtgccggccaacactgttcaggcggagaggagccgcggtcccctcgggaggcttccgccatacggcacggcagccaagccgcccctgtacgcagagaagggcacagtagctgatgtactacctggttcaatcaaagaaggctcacctgctgtctccttcactgttgcgtcgagagacacggggctcagctggctgcagtgacgagctgcagtggagtgatttgaaacataatcgaagacgcaacaaacgtgagatgcgttttgaatgcttaatttgagtgtgtgttagcacatagtagcgtctatctccatttgccatttgggacagcggcatggacagatatctacgtgtgcgtgagtgctctctgactatctgcacaaacttgagcaccggaactaggaataggatggatatatctacttgtggtcttctgcacctgaactacgatgttagttgctcctgacgcttgcgacacgaaccctcactgaacttgaacttgaacttgggacttctggcgcttgacgtactggaggatcggctccttcacctgcggtcattttcacgggatcaattaaactcaacttgattacagcgccaaatgccaaatactagtacatgccaaatgccagatgtttcagttcagagttgggacatggagagtttaccgtgctggccttcctgaatcgcttgtcctgcgagcactgcgtcccgccagcaccagccaaagactttctgaccttctgcccgagaaccccactctccagggaacaaacggacgcctgctgcaaaggtatcacacagttcatcaccttcagctctacgtttgtctgtgatttaatttacctggattctgagtcgcatatggctcagaatcgtctgtggttagtaggggatcaggtttcggttatacctcgcgcacgcttgtaggagtcctgcttggatccttatccaccgtggaagcttcctgcccgctctgcatggacacgttctgctgcggctccggaagctcccgggtgcgggtgaggtcagatccgacggactggaggcaacccatcgtcgatccatctctcatttcatggcctataaagagaaacatattggacaatgtcatgttagtactatatacgcaaagacagatgccaagtccatggagatgcggattgttgttgccattaccactcaggtggtctttggggtcaggctcaccaggttttgcattggtatcatggcctgcatgatgaagcagagtttcagattaaccatgaataaaatgaatgttgtggaatgcaaagaattactagataaaaacttggtgctgttagatatgattatggtaccatttgttcggctatatcgacttccagaatcttttttatctcaaggagctttctgttggtgacttcagaatgaatgacagctttgcctgtaaaatagagtgacataggccataagatggtatggtgcacagtagtagtgaatcagtcatttgctcaaagattagtactagttctattagtacaatgcatggcggcaatggtcaatctgaaaagataagagtgatgtatctgaagttcctaaaatcattagttttcatctaaagcagcaacagcttcagtacatgtatattcttcacaagtattacagttagacaatgtttttcatgaggcatccaaaatccttcttcaagagaagttgttgacagttcttcatataataagtgaacatgacaaaaggtaatcacttgaagttgcacaatctatgtagaaaatgacactcagttggcatgttgattcagttattctcctttcacagttgtaacagaattgagcaaacaatacataacttgctcctggctgacagactaaaccagaaaagtaaataatgtaccatagaatagaagcatttgagattttgcaagagattagttcaaggtgttacctagtcttcggttggctgaattcttgacatatccgtcttgcaccattttttcaatcaacttacgaaccatgttctggctggcctccccatctagcttgccatgaagtttgcctactgacacataatccattggaagtgcatggtacagtgcctgtagcaacgatatatatcagcagaaatgacatgatgacctccaaatacaagccaagggtaagcgacagagatacaccttcatatacatcagatcaccattgctatttttagttccttcagtaggtgagacattttgcatgatgacctctttctttatgtgtggtgttgtaggatcagcaatctgaagccactctatgatgctagtgatggacagtacaatatgccacagggtaaaactaaaatatagcacatgaagaaaatgtttggttgaccttattaacagaataactatccttttttgctctggatagtaaaccatctttaagtagcctctccataatatctgaaaagtgagtcattagtcaagtatttcaaggctttagtgagagtgaagaaagaatgcctggtaagcacacataagtttttcacaccactaccttcaaccatttcctgcaaagcattcaacaagatattgttaatagccagccatacagctcatacagtatatcaagatattgtttgatttataaacactgatgacataaaagcgggtaaaagtttgtgacctacttgtaagtctagcacaaaacagtaaatactctaaatagctattttattatataaatgaaataccagtaggcattaccattgatatgtcggggaaattaacaaggacatctgaaacctcaagactttcagtgtctcttgagcatatccactctcttacttgagctgttagctcttcctcgtgaacaggatcttgagtatcatctgcaaacatacaaagtcagagaaacgtatgaaattttcaggtactacagagtcagagaatgttgaacatgtattgcacacttcatgaaaaataaaatgagcatccaaacatttgaataataacttaatagttgacataaaattcatttgtatggaaaaggatgcacagatgaagctctcagatcaaattaactgaccttctgagattgtaccattttgacctttgcaagtcccatctattttgataagtatgttagcaccaaaaacagaaagtacaacaagaatacaaacaaagaaactttaccatttggagcaacaatgtaacgctctgcttcagatgggcgaacctaatagaattagcgattcagtctatactacaggtaaaaggaagacaaaaatatgcgtatacatcgaaaggtggcatcacagcacactaaggagaaaattaagagaatctcactaataaagatgctcaattatatgttctcttaggtctttacctcagtgtcagaaaaatcattatcttggtcagattcattatccaagctcatattatcatcttcactgttgacattgttatcatcacaagggtcaaggacactcttgacctgcataaagaataaaaacatatgtagcaatgagtttaattgagaaaacagaggtttcctggtccaaacgactgctatctccataatccactaccttcaaagctaacacgagatgcttgctattgacatttccaacttccatcttcaaggggttcttgttccatatatttatggcctcgttgtcagcgcaacacttaaaaaagggtggctcgtaatcttcaggctgcaaatagcataataaattaactgttttcgattccacgaacaaagttctatagaacagaaaaggttgaatccttcatttgttcagagcaaaaataattatctattatggcggcttcaagtttcagtaaatagcaagaacaaattgctgcactcactgtgacatcatcgtagtatagcagcttcattagaatggtcctctgaggacaaatacaggatagcattaggtaagttcaatccattgtaacaaatctgtgaagtgcaaaaattacctcctctggcatttggtccaaggtcctcataagtgaaaccagtgttcttatcatcttacaagcagagctcctgattgggaaccatatgatcatgtcaggatatcagcagtgactagttaaagcttacaataattactttgcaattgccatacacatataaaaaccaataaacaaccattaatgagcttatctaaaggactaaattgaaaccataccttcagaactagaattctgcaagttgtggaagaatatttaagaacaactcgcagaaaagttggactcaaaattataagcccaactatgtttttaaaaaggatttacatcatttattgccacctcacagtcctatgtacctaaatttacaaagttactggaatctatgtacctcactttttcaccacattccttacatagaaaaagaaaatctgaactccttttagtcatcaatttgctcctacttctttgaaatcataaaattttaaactattgttatgttgggactgcaacttcattaaacaaacactctccaaaatgtataatgctaagcaatatgaaaaattaaccattaaatcgtagcatttagctaagcagcatggataactaactagaagtctagaatgaatcatagcctttaaaagggatatgtatgagagaacctcatctgatcaggagtgacttctgctgcatttgatttaaatgtagcactgtttttcttgctccctgtgcggctcaagttcattgcaacttcatcaccgctcgtgttggggtagctaaatgagactgcaggggagtttgacacagaataagaaaatgtttgacatatgacccacaatcactgatgtaaaaccaactttgtatgctagaagttagccatatttcacatggtaatactcacatgcatactcctcaatcattgggccttcctccttctcacagatgcagaagagaagggtcttgagatatttcttctgtagtgcatcatagacacctaaaatttatcacaaaaatggattaaatgaacaaattggaaaattaaaaagatttaacacgtaaaacaggacatattttcacctttttccatccaatcaatcaacctcctcgactcagtatccatgggcattagcttcttaatcttcatctctgcaataaataaaagggtgttccagctaataatatcatatcatctgaggaatttggtgtataaaagggttagggactataggtaatgtgacctagtgccggaaccgacttatcattgaagtacttctcagggaatagacctctgatgtagctgatgttgtatatagcaatgcggagcaaattccttgtctgtttggtcaaaatatcaccacgttatcacaatagcgttctaccatacataattcaaagagagttcagtattcaatgtaatagaaatagaagggcaataaaatcatcacaaattggattactgattaacaagtttaggccttattggatcctggtccacccccagggatggactgaaattgtagttcagtttcctagcccatcctggagcatggcccagggttttgggcttgccaaacaaggtgaggcacaaagttcaccaaacaacaaatgtgtcatgcttttcaatactttagcacatgttgaatcaaatagggtaccagtcccattcaaacacacacctgcaataaatttcttaacaaatgcataaatgaacatggaccatacgatatatttcacctactatgcacttgcagtcatgggatcctaagcacttctaggcaaagtgcagctgaccatgtgagcaaacaagtactagaaaagacaaagaaaaacattatttgattggatataaaccaactggttttttgaaagtacaagaggtaccaaagtttggtgatcaaccagtaatcctaaaactcatgtggcaaagccaatgtccacttattaaaccgagtatctaacaaagatgttaaaataggagtgagagtgggggctagtctaaaaatcatgccagcagaggtttaataagctggcatataattcctaaaggcataacataaattccaaattcaaatgatagcgcaacaaaataaccgattataaacagaagtgcagcttttcttatcacaaactaatgcaggattaagcaaatgtctgttcaaacccaaagtagtgtatcggaaatattttaaaaaacagaagaagaattaggtcatagaactatcagaacaggaaatctgggaataaccaaaccaatacgtgtggtactgtggtgtctcaattccacgtccaagcaacaagtttgaaaagagaaactaaaattactcatggaatctgctgctgccaaaaaaactctgaagtctaaagagataccaaaagcaagcacagcaagaattcaacgaactgaataaattttagatgcttctaacaatatgattcaaaacgattggaagtagaaactcttcacaaggctatggaagcaaggaaaaaacctttttaggccctgccaatttgatcgattcagtgaaccgtggggggtatgcacccatgattccagcatataatcatctacgcacaaatcatcaggccaatgctcgtgggtttcacaacgaaacaaaaacgaaacgggattatcaaaccagcgaatgtctcctagaattccaaccaaggtaggcaacgtttgttcaaaacccaaacaactaacaagcctactggaaacatttgaaaaaatcgactcatacgactgtcagaaatggaaatcctgaacaaccaggcccaggccaatacgagtcgtgtctcgattccatgttcaagcaagcatttcggaagcaaaatgaagttactcactgtaactgctgctcccaaaacacttcagaagagattccaaacgcaaagcacatgagaagttcaacgaactgaacaattccttagatgcttctggcgaaacagttcgaaacaacacgacttgaattcgaaattcttcgcaaggatatctaagccagggaaaaaaactttcaaccctaccaatttgatcaactacgcagactgcagagactatgcgcctatgtttccagcacgatggtctacgcacaaacaatcaggcaaatgcctgtgggtatcacaacgaaaccaaatcgaaacgcgattatcaaaccagtgaatgtctccttgaaatcccaaccgaatcaccacgcgagtagcaaaacaaagtgatgtgatccgttcaacaaaattctaatgctgagagaatcgcacaaaccagtagaaattctgctcaaaatttctgcgaaatttagcaaaccaaccagagatttttcacgagaacattatgtcaaaaaattttcacgagaacagattcggtgcctcaaaccagagaaacaaaactcacatcgatcaagcagcagggagaaaaaccaccgaatcatcattcagtgcgataccgaaacgatccatcagttacgcattcgagagatagtgctacacggagaaaccagaaaccaactccaatctgagatacccagaagcttttgaacgggcggagagcaccagaggaagtgaaacaaaaatcccaggactcatgctccaaacacgcctaaatccgcacgagaaatcggttaaaatctgcaaagcaccaatgaaatccacccaaaaacactagcaaagtgagatgctactgatgcttcgcactggccgcccaactagcaccatttggtagtcagcggacggagactaccagagaaagcgagaaacccaaaaccccacgacgatctccaaacacatccaaaatccgcacgagaaatcggttaaaatcagcaaagcaacagttaattccacccaaaagcactcgcaaagtgggggggggggggaaatccgacacgcgtgaccaccaacactcgaatcaaacccaaatcgaacgccagctactgcaaaccccagtacaccacacgagcgatcaaatccacagcgaaaaacctcccaaaaacctcggcagaaaaccctcgatcgggtgaaccgatccgatgtccggcaccgaaccaccgaaatcgaaagtcgcacgggaatcgaacaggagatgggcgaggagagaaaaaaaaactcaccagaagcagcgaatcctgctccgtgatctccgcctccttcgtcttctgagccatcacctgcatcgcaatcacccactccgatcagcacgcacacaccagcaagcgcaacgcgaaatcgaagcgagaacccaccatttcgtctctacggcggcgcgccgcgcgcgagatgagagaagggagaggggagaggagtgggagagagagagagagagagagcgagagaatttgcggggctttggagagctagttttctcttcttcttttt

SEQ ID NO: 53689 - DNA, 4483 bp, Oryza sativa
ctgcgcgccctcgtccgggaggtggtcggggagtgccgcgtccaggtacgctccgtcgcggcgctgcgggacgcccccgagatgtaccttgccctctccgccctctccgtcgactaccagtggcaggtcgaggacggcgacctcgagcgcctcgccgacgtcgccgagctcgcccgcgtcctcgacctcatgctcaaggtccacatcccgcagctcaagctccagctcgtcgacgtcgacctgcggcgcgggctcctcaacgacctcgtcggcttccgcgtgaggggttctctcgccatccacgcgctcacccaggacatggcggacgatgtccttgctgccagccccatgcccaccgccggctccggtgccctgcttcttcagacgcactcccgtctcacggagctcctgctggaccgcctcctcctccactccatgcaggcgcgggctctcgcactcaggattggtcatccgatctcgacgagtgtgcaggcgctcgacgagcttctgcacaacgacatcgccaacggcgtgcgagcggaccgtctccctgaggcgactccaggtcaactcgatcgcgctctccatcgcattaccaacatgttgggatcgcctgtttgatttacctccctgtttgatttacgaacagaattttggatgtgtagtagtaagagattgtattgcttagtccccctgttttgatttagggatttgagagttgatctacgaacagaaatttggatgtgtagtagtaagagattgtatcgcttagtccccctgtcactttaaaaaacgggaatacgcaaggagcgcatctttgtattaagaggagtaaaagtctgtacaggtgaaagagaaaacacagcaggacacgggattacaggaagtcacccaagagcattaaaccctaatctcgcgatacaatgttgcgacctgagcgctctaaaggcgtggccggtatggcagtattggcgagccgccacagcgctgcctcttccgccattgcccttgccacttctgtccagcttctgtgcttctggttgaacaccctgttatttcgctccttctagatagtccatgctgcgagagtagcaatggtatcaaaacctcgccgttgagagctcggtaaggtttccctcttgtcacacaaccaggagtggaatgaggtttcattgacaggcaagcattccgagcgaccgattgccgagagcagtagccaccagagctgtcttgatctgggcatgcgaccaaaatgtggttgatgctttcctcgtgctgatcgcataggacacacatgctaaggtggggcaagcccctgatgcttaacctgtccgccgtccagcagcggttgagtgcgaccagccagctgaagtaacggcagcgcggcggcgccagcgatttctagatcggcgtggattggaacgggattcgaccgaggaacaatgcttggtaggcggagcgggaggagtacatgcctgaactttcccatttccaaataaattggtcctggtgatccgagagctctatctcccgcaaaaacgaccagagattgagatactccacgatggcctgcaatccgagggctcctcgtatatcgctttagggatttgagagttggatgtgtagtagtaagagattgtatcgcttagtcccctgtcactttagggatttgagagttgttatggttgatttaccaattgttacgatttgttgcatttaccaattgggatagaaatgaatgatgaccttcatgtatcagcaaaatctaccaactgggatagaaatgaaatgattctacgctcttgatgaccttcatgtatcagcaaattaaatccagtggctgccagatttttcttttcgttggcttgttacctgacttcttgaatgtgcaactaaccatggttgagtgttgaaatttgttttaggaattgaggtcaagctgtagatatcttgtcagcccaatgcaaccaaaaatatgttgatagtatagctggtagagcatctgtaattgaaattcaaatgcagaaacctcttattaacctgtttatcacttggtgtcaaacaaaaggtagatgttccagttaatgtcactagcaaaatttagagatgaaagacgaaaatgattcagttgtgtcctgggttaatgaagagaaacgcaagcatgtaaagttacaaaacttattggacagtattataataatgtagtaaatgaagagagaaattacataaccatctacgctggataaatgctgagaaaaacacaactaagatttaacatgacaacggctgcaaggcttcgtaacagctaatttaactgtcgagggaacttttcgctcgatgaatgtttcaattgccaataccgctctgttggcttcagtgagcatcttgcctataggaaaacatttcttgtgttcgcctgtagaacagctagaaacaccacgggttgtatctagtgttaggcacttgagtgaggttgtattgtcaagaatataacatgttagctcgatcaagctctttgcagagcagaaaccagtgatcttcacgctctggaggttgccatgacgatggtgttcaggcatctgcctcaattgcaaggaatctccaaaaattgagacatgccccatgcgttcttgtgatacctgaagatgaaaagccaatgtgcttcaattgatggttaccactgtaaatggccaatacataagtttaaagaatgaaaattaacttacatccagaaagaaagtctccaaggaaggagaagcatcaagaaaagaaaccagagaaaaataatcataggctggggaaaaagtgaccattccaacaagagaaatagtcaagcacttgaggtggaggaatttgctaggcaacattggtgtgtcgaccatctgcggaaagataatcagactgatgatattcttctaaagtactgttgtaaggatatagcaagtccataatcatttaaagtttttgggtgtacctcatgaggagagccaatggttagagtttcaagatttggcacattggatggaagctctgcacaagcataatagacagcaccaggatagcacatggataggctcttcatttgcaacgattcgccaagcaagagttgcacatgattaattccaaagtgaaaactaccaagatttggagcactattctctatgacttgcagcattctacattcaaacacttccaggtggctaaggcgttgcaacaggcaaggtatcttcacacaaattattccatagcaatagttaagttccaaccgctccaaagcataagaattagagagaacgcaccctaactcattgcctgtaatatgtacaaaggccagatgcagcctcgtcaagtttcttaattcaaggttgattgtgggatggaaagaacacctgctaagataaagatgccgcattgagcttcctctcccatcagataaaagtgagcacgggaagttgtactcatcatcatattttgaatcaaagtaatttgtgttgtacgataatatcccaagagtgagttcttcaatcaatggtgtaacagcaatctgaagccaactgtcgagataataactggtgctggcattgtaaaatataccagattcaaaccttaatgatttgatgccaatgcctgagtggtttttcagaatgcaatcaactttcttgatgaaattcaagtccggtgtttctatacgaaatataagattaggatgatatcgccagaaactacgaaaagcacgagacacgcacgcagcacgagcagcatcccgtaatggcattagggagtgtatatgactccagatgtcctgcatgtataatcaggaaaatattgtgaatgtaaactattgcctcagttggaagggaaaacagtactagcatatagggtatatccgtatagcgcattggaatttgtggtaggcaaattgaactgcatttttattttgctccttttctctttcaaagttttagtagagtctgtcctgaaaaggataccgtatgtagaccgtcgtcagtgactagtaatgataaactaatatgaaacttatgcttagttaggcaaggactagccaataatatattatatctgagcatatgtgggtaaactaagatgtatgaaatgatgtgttttttgtacaatagcatcctacaaattataaaagatagaaaataaatagaaaaaaatacacatatattctttataggtacaattctcaacagatttggcagaaagccgatgtaagaaaccaatagctttggcagctacaccgtgagagataatagattgaacagaccaggaaaacaaaagaacgccatcctacaagaatattcacttctcccaccatttatactgaaattagagcgaacagtagtgaaaccacttcacatgaactgtgaagccagcaaaatgggcatggtttacttcaaagctttctcactctcctagtctagacatgttagttgtcaacaatcctgcaacagacatattg

SEQ ID NO: 53690 - DNA, 13822 bp, Oryza sativa
tttttagatctaaagtttatagaactaaagtttataagtcaaaagttttatatacatgtttcaaatttgaatttgaattatatctgatttaatttttaatttaaattcaaatattttctatatatagtatttctatacatctaaaatttatacacctaaagtttatagatccaaagtttataagccaaaagtttacatacccgattcaaatttaaatttgaattcaaatattttctatatatagtatttctatacatctaaagtttatacacctaaagtttatagatccaaagtttataagtcaaaagtttacatacaaattcaaatttaaattcaaattttttatatataatatttatttacataaatttttccaatttttgttttttttaaaaaattttgttgtgtactgtaacagggaagagaagaagaggaggaggaagggagagaagagagacgtacacggggaggggggtgcaggtatcacccgcgcattagcagtccccaaaggtataacagctagaacggagaaaaggtactcatgcagaacttttaggaggttgcagaaccagcactaaagatttgttcaaaaagttttactataggtgccgaggggtgcatttagaggctacttacagcagtgataaactcatagtaatgcttttcctctaatagaagtcttacattatcatcatttggtgtcatacctctggaaggttcaaccctgaatatcccattattttgccgccttcagaatttgcaagttgtagacagactgagccctttcttttagccactgaagcaataaaaaaaatctgcagcacatcacatgtgtacagacattaacaacggaaacaaaaaaatcatggtacaaataaatcagtttggttcccttgtccaacttttgtgaaagaacattcatggctataaatccaatttgtttccattagggaaaaaaaacagttcagtttagcattggtactttttgttgaaataaagaactctctcttttattctacacttctttagagcacatacataacatagtggctcgtcataggttctgcccaagcccaataggcattacagtgaaacttgtcatccagtggtatacatatttctccccaaaacttctcccaaatcttcttgtaagcaagatgcagattcttgtgaaatttcggtgtacagactgtgtagccagtttactagtttagctcaaaagagtcagtttgttctcctcacaaaaaaaaaagttaatttttttcctaagaaggaaccgtgaaacacaaatacacaatacctaaaggtttccgaataatttgctcaagaaacatatgcattaaattctgaacaagatgagagttgagagacactaaagagaggcagaaggaggtaggcttactacgggcttggatatgccgccgctcctgttgcacggacatgagccgcttgaggaccagcaaccccattgacaacacctcagctctgctagaaatcgatggcgccaacctctgatttccccctcctctcggtacccaaaacaagaaaaatcaatagtactatatcgctatttgcagaggcgaggtgagggattctcgccggcgccgacgcggactcccgcagcggaggtggaagggccaacaagccccttgtctgggtgttgttcttgccttctcggcctatgatgggctcagtcaatataataggggcaataatatggtccgtcagtggaggcccgatcacccacgagaaaaaaaaaacgattagtattggtaaaaatttgtcgacaaattttttttccgttaagatttgtcgaattttcagccgttaatctaaccttgacatccatgtactatttgtctcaacgctccatcgacacgcttaactcgctagtgctcgactaccttgtgcatccaatcgtgtagtgtacagtttcctatcaacttttcactctgccaaaaacgtataggggatgaaagtctagtaatgaagagagagagagaggaggtaagttgagaaaaaaatatagtgtaaatatagtacttttagagtgtaatttgtagtaattactttgtaactcatagtaaattacaatgttataatttctattagatttgtatgcaatttatttttttctatttttcactaaatataagttactctttatttttaactaaggttatctttaataatgagttttgtgttatgctaggtatgataaattatacatgctatttttatatgtgtattatgtaagtattaaaaaccctagtgattttggtttaaaaatccgaggtgatctataggtacttaaaatttaccccctcacataaacataaattgtttttcgtcaatatgacgctgacgtgacagtttagtcaatcaaaacaattaaagaaaataagtcgtggactcgtgggtatcactgttagtgctcctaggcccctagctctctctaaccacgcgagaaggccatgacgcatgacgagcaaaacggtggtggaagctggtcgtgccgagcccaaagctctgtgtccttttgttatggcaggtcgtgtcggtaacaccacccccgagcttcgtgtccggctatcagttgctacttgctagtcgtgtcgtgccgcccctctagatgaccaaatgggccgttcggtccggcctgggcccgagaccagctgggtcggtacggcccgacctacacgtcgggtcaagccatatccacccacgggctaataagactcttgactgtgtcaggctggtccaaaagtacaaaaacccatcgtgctcctctttgaaataagtctatttacatatgtcacctctttgggttgtgtcttatatggcttgaataaatctattttgcatccctcatctctttgggccgtggttatatggttagaataagtttatttacccccctcatctatttttacctctctgatcattggactatgtcgtgtcaggtcggcccatcgtgccgaggcagaggcccaggcaccgcccaacggtcggggtaggctagcatgggcttgactccagtcggtgcatgtcgtgcctgggccgagccaaaaccccatgccgtggggagggccctaggccttttggccatctatagccgcccctagtcaaatatgggtgatgagcaaggcaatgacaacaacgacagctgagctagcttgtcgaggatgaacatctctttgcctccttcctcctccctctctctcatccctatctctctcttagcatagatgacgaaggaggcggctctcaatgtggagaagcggcaacacagttgtggtctgaggaggcgacaggtctgcaagtcgatgacactcgggaaggcagcaacgagggaggtagaggaacgatggcgggagtggagcttgatgaggcaacgatgcaagctaagcaccagctctatgaggaagcggcgactaagctcagggaggtaggtcttggcaagacgggaccatggagctcaagcggcggagatcgatagagtggaggtgtatttggcctatagatggccaccctcccgtcacttgctcgagttcgaagcgctaacgtcgccatcacacaaggctctcccgttaaagtacaacctgctatctcctcgtcgatctagaggccgtgtagctagaagaatgggaggtagagaggagtacataacggggagggatagaaagaaatcacgagtagagaatggcaagcttgcaggtggtgggtagtggtccagtggtcctaataggagggtagcagtggcttgctaggtggagaaagtggaggagagggctagagagggtgaggaagaacgtacgcatgtatggccccccaatttgtatagttggcgctcgatatgacgtgatagtgggcctgtatagttggcgctgccgcagctgtacatataaagtactgttggtatagcctgcaacacagtgcaaataagggcagccaaacaggtccagtgtatgaaaactggtagaaaccaactgaagggtctttgaaagttagaagggtcggttatctttttttttttgagttgaggggtttgttcaaaacaatgtgaagagtcgagagggggaagtgtttgtaaaatggacttgcaagaaaaatgagtgaaatacatgtccgatctttaaagtagcatgataagatcgtttagatccttgatactgtaaaatacatatttagatccataatctctgttttatagagatggtagaaattctaaacttcctttaaccgtgtgtaattaccggcatatttttttgcactctatcctaacacacattttttttattccgactcctcccaaacacatactccctccgtattatattttaatgtataacaccattgactttttaaccaacgtttgactattcgttttattcaaaaattttgtgcaaatataaaaatatttatatcatgcttaaagaatatttggtgataaatcaaggcacaataaaataaatgataattacataaatttttttgaataaggcgaatggtcaaacattggaaaaaaaatcaacggcgtcatatattaaaatatggagggagtacacaccacggcaaagaaggccaagattccaccgtcgctcgccatcgcagaggcgtgttggggtttttccgatttgcccccaaattttggggccaatttggattgctaccaaaaacatgccctaacaatattttggtaatttaaatagtacttgtgtttgatttggattgaagcccattcattggtaatagctaatctagtttggcattatctagaacattctttactataatttaacattttgactttatgttggtagcaaaccaaatatgataaaaacaatcttaccttatcaaatatttggtagtaccaaaacttatctagattttgatactaccaaaaagggtaacaatacaaataggcccttggatatcacgcgccccctctcctcacggctgcggctataaattggagcccccttcccattccccgcaatccccccactgagtccagtccagaatcttcccacccaaatttactcctctcgttccctcccccaccaacggccgcgccgcgggtgtcacgatggcattggtggtgctcgcgatcaccagcctcgccgaggcggaggcggtggcgagggagctcggcgggccgcacagcccccacgtcgacgtccgcgtcgagtccgtcgtcctgagcgaggcacccgccatggcggcgatcatgtacgcgctcttcgacgactacggctggctcgtcggcaacctcgacaggctcctcgacctcgccggcgtcgacgagcacctctccatcgtcgccgacgtcaatctccccaggctcgcgcgggacgtgcacgaccccaacgccctcgcgcggctacgcgacagcgccgccaccatcatccgcctcgccaggagggtcggcgggccatccaccgccgcctacaccaacttcggcaaccgcatcaccaagctcgcccaccacatccaggaccccaaccgctcggtgctggagctccgtggccgcctcggcgaggccgccacccgcgtcaacttactcaggtccagccacttcgatttctgagccagacctgaatatcttcaaccgcatctcgctttttgccgtgaggattcgcacgtttcatgtgagagaacagagttcgtcccctagatttgttacgactacctgaacatgtttcaaaatgtcacaaaaaaagtgaaaataatttctgggtggtgttggtatttccctgttcgatttggtataatttgtccccccccctttttttcctttcgaatgaatgagagtatgattggttcatctttacattttctcccatcgtggatcatcctattgcttgctgtctctcagttaatggtttggaattttggatgcactaggatatgcatgatttctccagttttctattgatcccactcctttcggcacttgatgcgattagcgtgtgctacaagaatttggtggaataccgacccggcgaaaattagtttggtcgaatactatcatgtgctttgatcctgctgcattttaaaaaaaaagtaaatggcgtttacagtatacacttgcggggctctggtctctagagagtgttttttttaaaaaaaatcttttacccgagtaattttcctttcgaggaaattataaagtggaatgttcttttaggaaattaatggcgtttacagtatatacttgcggggctctagtctccagagagtgtttttttttaaaaaaaaatcttttacccgagtaattttcctttcgaggaaattataaagtggaatgttcttttgggaaattaatggcgtttacagtatacacttgcggggctctggtctccagagagtgtattttttttaaaaaaaatcttttacccgagtaattttcttttcgaggaaattataaagtggaatgttattttggaaaattaacttgtaaaacaagtagtagtagtagtaagtttaactagaaacaaaggcgcggcattgccacgcccagctgaaattcagcgagctaatttgtccaaagtaacagtaactattacttcatattaagaaggatccatcatatgcccttccaaagatctccatgcggcatatgcaccgtacgtccttagcaacttgtgattttgctaggaaccagcactactttccttgtgtaaattgattaagtccaggaataacatatacaaatactatcacaacctgacagacaagatgaggtactaagactgcatatttatctttcctaaacattatgaattactaatataacaaactcatttgccaatcaatcacctcttctgaatgtatactcaatttgtgccaaacatagatttgttgtagaatcttttcagtgtattcagtacaggctgaaatttttagagaaaccttcgacactacaattcaaagccaaatcatacaatattttaggacctgtaaactggggcctgcctacccaatcagggagcaaaaccgtagctcagcaatcaccatgaagtagttggcagcctctgattggcctgatccttgcttacctgtctcttgttttttttttttgggaacaatcaccggaggggagaggttccccacctgtattccattgcaaaagcactgaggttaagagtacaaattatctcttgttgacccagcttatacttttgtgagagggactaaagtttagtccctacttccgaaacaccaccttactatatggctgaagatagaccaccacaggtaccacttgctgctgatgttgctgtgctctagaactctttggccatggcaagtcctggagacctggagtggtggccattgtttccactttccacagcatgagcacttattgatgatggaagatggaaccaatgacacaacaataagcaaagatagacttcttctccgtgtccctgtggctagaaaattagtctccccatctcacaaaaaactcaacctaggagggtcacattcccttctaaattgagttttttttttgacagagaggatgtcacaccccagtctggcaccgccgtacaacggcacatgataggagcgtgtcatagaaaaaacggcgcgaaccgcttcctacgaaaccgcgatctcagtaccagtcccaggacatagtgctggtacccacggtgacaaatatgattcattgcaaatccttaaaataaatagatgacttatttaccttaatttaggttgcagcttagaacagcctgagaaatgcaaccgacgacgcaaacgaggaaacaccaacaacagcagcagcagcggaaccaacggactaacacccaacaccacaggcgacggctgggaaccaggacgaaaccctaatcttcactttacttcatcttcaacttcagggtggaggaactatatatatttatatagagcaagggtgagtactttcgtactcagcaagtcacgggaatttagatgtttgatgcaagcttggaagagaggcaaggttgttttgcaaatcttttgtttgaaatcattttgaaatcactaagtgaattatttctttttaggtttgggtcgaaaagagacttgcgtctcgattcggcttaagagatgcttttcaacaacttaattggtaatgtaccgacctcccgggtcagatcattacttctcggctcccagagccatttcacttgattaatcggctcccagagcctttttcattttctcgaactcccaaagtccagctgcccagcagcacaacattccgcttccactcgggaagcctagtctatgatgcccgtagacatcccgaatcacacagattcgtttctgaccactcaggtcatccatctgccacataggttgattctggttacgattcccacaccacaacaacttttcacaaagcacatgcaaataaatctacgcaacaggaaacatctcacatccgcccatgaccgtgggcacggttgttcggacagttagttaacctctgcagagggggtacactttacccacacgacattactaacccggatgtagcgcccgttccgtcgtggcgcctagcgggaaaaactatctcttaaaaaccctatttgcgaaatcagtttccttgcttgttgtctagtgtccgtgccatctcagatctcaaatccccgatctatcgtcaagttcaatcccgaatccaagtccttcccaaatcaaatccctccgcaaaagtctattttgcctccctcgggttcgatgggccgaatccctctcggcccatctccccctccctctctctctctctctctctctctctccctctctctctctctccctctccctctctctctctccccgctctgcccgtgaaccgcgtcgagctctccctctccactctcgcggctgttcccgccgatgccacccaaatcgccgcgccgcccgcgcgtgcgcgcgcgccgtggtggccgaccggccagtcgccgccgccgtcagcgcctgccgcgcctgccccgcgtctgccgcccgtgtctccgctccactccaaaccgccccgccgtcatcgccgtcgtcatcgactcggccccgcctctccccgcgcgtgcctccaagggacgggggcagagctcctcctccctctgccgcgtcgccctctctccctcctccttttccccaaagcggcaaggaggcaagccctctttctttccccctttttcccttttccctcccgccggcgtcatcctccccccctcctgtcgccgttttggccgcgagcgccgagcgccagctcgctcccttgaccgcccaaggtcggtttccaaaccgacatcgccgccctataaacccaagcgcctccctcttttccctcccaatcttccccgtttctcgcccgcgccattgctgtctctcccgccagccgccgccgtcgcgtgtgccggaggagccggtgcgcgttaggacgcggaaggggactccgggcgctcgccttcttcctcttccccgacccgacgccggagagatcactcccgtgccgtcggcctctcgtcacaacgccccgcctcatctcggtagtgcatttccccgttctccctcctcgatccatctcctccccttagttttcggtagtagcatgtgtagccttcccgtagctagctagcgccgccccaaccgttgtcgccgctcgctgtgtgctcgccgccgtcgccgccagtgctccgtagcgcccgctcgtcgccggccttgctcagcgtagctccacccaatccgacgctagcaacggattcccgtagccgcgtagatgctctcaccgccaggaatcgacccctcatgacctcatcgccgtttcccccttccctcgccgccggttgccgccgccgtcgagctccctccggcgaatccgagccgtcggctcgtctcccctcatcctgtgcaacatcccggtgtgctcgccttcgcctgtatcgccctggttcgctccgccgctcgccgccgtcgtccgccatccgttccgaccggcgtcgtcttctacctcccgccggcccgcgtggcagccacgtaggcgccacctcggcgccacctcggccgcgaccggatcggctgacctggccagccgctccctccgtttccccccccccccacgtgcgcgtggtccacggtgagccgtgaggctacgcgtgcgcccgccgcaccgcgtcctccgcgaaccgcgcgcatgcgccgcgtctccctccccaaaccctagcacgccccgcgtgcacctcgctcacgatgagccgagtcgccgacaagcgggtcccacccaggaccacgcgggatggacccggcccaccggctctctctctcccctcctcgcccgtgcgcgcgccttgggccgccttcttgggccggccggcccattaagctcggccgagccgccccattctctcgggccgcgccctagccgcccgagggaagtctaatttccctccctcctccttttcctttcttttctttttcaaaaaggatttaaataaatccttttcctttagaccaaaaatccaataatctgagaaattcaatatcttcccaaccgtaagtccgtttgactccgttcaacttccaaaattcctcaaatctcgagatctatctaatggcacgcttagaggtcattaatagggctttatttttgccgtttgttgagttgtcccgtttcgcgtgtagtttcggagcccgaagacccgtagtgcgaggatttcgaggatcaagctcaagatctcgagcaaggcaagccacccttgaacatcttgagcctatatttgaacttaattatgttgcttgaaaaatattatgcattgataggatcgcacttaatccgcttgtcccgtctgcaaggcagattggcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttgggttttacaaaagatttggaaaacccgacacctgggccggtgcttgcgaactaaatgaatttccaaaaccgcggaccgggaaacgtaccgggtgtacggtttcccgctcttgcacttaaggaccgtttccttggaatttcatccgaacataagacaagtgcgaccacatgggtgaaatgggacacccctgactgagtaactagcttatcgggggagccatgatgctaagagacatgtggattcgccggggtggtgtcggggaggacccctgggcttcctggcatagtatggtctgagacctaatctggtgttggtctgggacccctctcgttggcatatggtgaacctgtgtcggctttcgaaatgccttgtcatgaaatccttaaggtctctagtcgtggccgttctgcacgggctggatgattcgggttagtaatgtcgtgtgggtaaagtgtaccccctctgcagaggttattaaaactgttcgaacagccgcgcccacggtcatgggcagatgtgaggtgattcctagcgtagttttgtttgactactgctttgtgaaatttgctgaagtggtttgggattgatgtttggaaaatctgcggctgatgggatcagccaggcctgggtggccgtttgaaagctgttggccgggtgccaatcttgatcaattcaaaagactgatacattgcatatactccgaccggacgagacgcactgtctcatccgtgtcgtttgagaagcactcacttagttgtttcagaaaagagttcaaataaaatcaattgcaaaaacaacagcccttccttgaagcctgcattaaacacttatttcccatggcttgctgagtactcccgtactcacccttgctctatataaataaccccccagttgctgaagaagatgaagcggatcccgctgacgaggagttcttctaggagcaagccggttacgatgagttttagggtttcggcctagttctcaagtcgcgcctgagatgtgtggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttgaagcgtcacgggctagttccgctcgggactagttcggggcgtgacaccggatcacccagctcgtgagatcagccacgtcgggagaccttaaggctttcatgacaaggcatttcgaaagccaacacaggattgccatatgccaacgagaggggtcccagaccgacaacaggttaggtcccagaccatactgtgccaggaagcccaagggttctacccgacaccaccctgttgaatccacatgtctcttggcatcaaggcttccctggtttgctatttactcagccaggggcgtcccattgcacccgtgtggtcgcacttgttatatgctcggatgaatttcccacaggaatcggtccttatatgcgaatacgggacagtgccacacaggcacaacccccgcatcgcgagttttcacaatttattttattttcaaacacgccgacaccacatgtcgggttttcaaggcttctcaaacccatttcccaagttttcgacaatcaacggtgtatgtgggatatttggtatacgcactcagagagcacgaataccgaggtaccacaagagtggagcgacaaggaatcagggtagtacagcctataggaatttgtgcgactactaggtaggtccgtcggtttagcacgcaaaccgaggccaagcaagttaagtgtgtgattctactaatgcaagttgcaacaaaataataatgattttccaattataggagcaattggtcaaagggtgacttgccttgctcaaggtcttcacgaagctggacgagggatgtatattagactttttcgggcggcaagggcgcggcccgagggttgaaggaggctcggccgagccatttgggccggcgcgggcgcggggaaggtggcccattagggcgcgcggaagagagagggagcggtccggtggaccgagtgcacctcgcgggttccaggtggggcccgcttgtcggtgacacggcccacggtgggatgggcgcccgcgagggcggcgctagggttcggtggggatggcgcacgggcggtgcgccggatggaccgagacgcgtcgggcccacgcgcagcctcacggctcgcggtggaccgcgcgcgcgagcgggagacggagggagcggctgaccggggtcagcttgacctggtccggccgagctggcgccgacgtggcgccttcgtggcagccacgtgggccggcgggaggaggaagaaggggaggccgagatggacggcggacggcggcacgcatcggcagaacggcggcgaggcgcggcgagaggaagggggaccacaggagcgatgagcggagcgaggaggagcgagccaacgggacagattagaagaggaagggccgacgacgacgaatcgtggcagaggtcaccgctggtgagaggaagagggaaactcgccgggggggagagggatcgattcacggtgggggaagcacctccggcattcaaggaatgtgtttccggcgccggatgggacggaggtgcaccgaggagggccggcgacgagcggcggcctccgggagcggacgacaatggcggcgaggccatgccgggcggcagcggggctcggggcggcgtccacgcgcgttcgatagagctacgggtgctagct

SEQ ID NO: 53691 - DNA, 4563 bp, Oryza sativa
acgctgagggggctcgggtttttatagcggagggggagaggtcggtttggaggagggaaaccgacattggcggtcaagggatgcaggggcgacgagctggcggtcgtcgacgcgtgcagccaaggcggcggcaggtgatgacgctggcggtgtcgggcaaaagtggaaaaggaggggaaaaaaagggggctctgctctttgccgagttggggagggagagggatgggagcgggagctcggcctcacggttttggcaggacacgcgtggagcggctcgggcatgcgctgcagagctcgcggcaggcagcggggccgagcggcagcgcggcgcaggcgctgacggtggcggcgaccgggcggtcggccacgaccggcgcgtgcgcgggaaccgaaggcggtggcgggttcaaatggcggcggcgggaatcggtgacggggagagaggaacagagagagcgagagagagagagaaccgagaggaaggagagagctttctctcccgagcggctcgcgtgcggcgcacgtgagaagggggaaggcagctgagggagggaggagggctgagggagagaagtgggctgatgggaggaaatccggcccatccaaaacaagaggaggcaaaatagacttttgctgggaaatctgatttggagagaaatttgatatggagtttgaatttgaatgcaaaatgggaatttggatatttttggagtcgtgcggatatttggcaaggttttcaagagaggatttgaatctcgaatacttgaatcggaatagggatttcgaggagaaggatttgatggcgacgagagggatcaaggacagatttgaattgagatccacggcacaacttagactcgcacacaaggaacaaaaattttcgcaattaggattttgccgaattagtttttaacgtctcacgaaaagcggagcgttacagaggagtagtaagctggtgtgtgcaatgtgttataggcttatagctagaggcttaataaaggggcagtaaaatgtggtagatgctacttggaaaatcatctagcactcctatctgaaataaatggacatcttggcatcacctccctatcgccactaatcacctagtaacttgcatggaattcggtataagagatatggcctttttttaattaaaaaataaacatgtgtttagaaccaacagaatgagtacaagtttgtgttaacatgaaaatgggatagtatacatgaacgtattaaggaaatacatcaagctgctaattaaggacaaaaaggaagagcacatgatcaagtgagttcaacaggcaacagcaaactttacttccatagtttcactatcatcttaaacactgctatgatattctctgtcctcaatgcgactgtaccagataacaacacaactcttgttattattcgtggagaccccatattgcagaatttcaatcacttggtactaccggccactactcccagccaaggctccgagcatcaactactcgccaagagcttcagtcacctgcccagcactgcgcagcccagatatcatcatcaagtaggtgaccatgtctggctgtccggggctataccattcgccaccatccaacacacaacctcattggcagagtcaaaacaatcactggaggcgtacaacccgacgagcatcgtgcacgccgagtcgggcgaaatgccatccgcagccgtagcgtccagcacggcgagcagtgcgcccgggtgggaagcgtaagagagcgccgcggtggccgtggtgaagcaggcgtgcggcgccggaggatgcccatttcgtcgagcaggtggaaggcgcggtccgcgctcgcgccgttccccgacttgtagttgcaggggttcggcgaccgtagtgcggctgtgtcagggtaggcgacgtaggccggaaggacagctgcttggcgaggtcgacgaatcggaggaggaaccggtggtctcggaggaggaggcgatggaagggggagcgcatgggtggtgcggaaggaggatgcggcggaggcgacatctatcggagagcggtggttggttgtagccttgcaggatgcagctcacggcggagcgcgctacgtttgggcggcggacaacggccgaacgacgggaggagcagcgctggcggcgaagcgagaggagtccgactggcggagctgccgaagatggccgagttcagattaacgcttttgcaaaaaaaccctccgcaaactacgtactccttccgtcccataatacaagagattttgagtttttatttgcattgtttgaccactcgtcttattcaaaaaatttatgtaaatataaaaaataaaaagttgtgcttaaagtaatttgaataataaagtatgtcaaaaaaatgaataataattccaatttttttttgaattagacgagtggtcaaatagtgaaaaaaaactcagaatcacttatattataggacggagggagtatattgcaacgaggtccaccgcacgagatgagacccgatggctgcgcgcgactcaatccgcctgcgccacgtggcgccgctaatcgcccggtaatttgcatggaattcggtactcctgccaccctcagaaatttctagaacagcctacggctataactacacgccatgttccgtggcatgcctggtgacctgtaaattctctttcctctcttggctgagtttgatgagaaggggattgataagattggaaagatacgcaaaacgagatgagtcattagtgtatgattaatttattattaactattttaaattttaaaataaatcaatatgattttctaaagcaactttcctatagatttttttttcaaaaaacacactatttagtagttcgggaagcgtgcgcgcagaaaacgaaacaaacaaactcacaatgtcattgtgccgaacacagccggtcggctgtttgccgacccggcgaaataattcccagaaggggagagagactccgtaatctatcatggtctttggggttaatgaagagaacgtgaccaatgtaaaatacaaaattaaacattgaactgtacaaaatatacttagtaatttgagacagaaattaaagcatgagagaacaaacacacaagataatcatgttgaaaaaagaattacaactaagattcaattatatggcaacgggggcaaggtttcacaacatttaacttaactgtggaaggaacttttcgttcaatttatgtttcgatagccaacatagccctgttggctttagggatcatggccttgtccataggaaagcattggctgtgtttacctgtagaacagctataaacaccacgagtagtatccagtgtaaggtactcaagtgacgttgtacagtcaagaatacaacatgttagctcgatcaagctcttcgcggagcagaaacaagtgatcaccacactctggaggttgtcatgacgatattcttgcatctgcctcatatttgaggaatctccaaaaattgagtcatcctccatgctgtcctttggtatctggagatgaaaagccaaatatactttaattgatggttactaccatagacactagataactttgcagaatgaaaattatcttacacccagaagtaaagtctccaagaaaggagaagcatcaagaaaagaaactagagagaaataatcatatgcatgggaaacttcagcaagatcgatagtcaaacacttgagatggaggaatttgctaggcaacattggtgtgttaaccatctgcataaatatgatgatcatcagactggagacattcttctaatgtgtaagtattgttatatgaataccgcaagtgtattttcgagtttttgagtgtacctcgtgatacgagcaaatggtgagagtttcaagatttggcacattgggtatagactctacacgagcataatagacagcgttgcaatagtattgcaaagatagtgtcttcatctgcaacgattcaccaagcaagagttgtacgtgtttacctccaaaatcaaaactgcaaatatttggagccttattctctattacttgcagcattctgcattcaaacactttcaggtgattgaggcgttgcaactgacaaggtaccttcatgcaaactatttcatcacaatgctcaagttccaaccactccaaagcataacaactgaagagaaggcaccctaactcatctcctgtaatatggacattaaacagatgcaacttcatcaggcttctcaagtcaaggttgattgtgggatggaagctacaactgccaagataaagatgtcgcattgagcttgctctcccatcagacagaattgtgcatggtaagttgtactccacattttatgaataatgagatagcctaagggagagtttttcgatccatggtgtaatagcaatatgaagccaactatcaaaatgatggctgatgctagtgctccttctagtattgtaagaactatcatattcaaagtttaccgacttgatgccaatgcctgagtggtttttcacaatgcgatcaaatttgttgatgaaatccgagcccagtattccaatacaaaatataagattggg

SEQ ID NO: 53692 - DNA, 10206 bp, Oryza sativa
tagtagcttataaggcataggagcactaaagatccattcacaaaattttatctaggtgacatactgacataggaccaccggtgtgcacagttagaggctactagcagtcatagactcatagtgaatcctcacttctaatatcttagaggctacttagagtcttccattgtcggcttttggtgacatacctctggaaggtctagccctgaatatcttgtttttttgttgccttcagaatttgcaacttgttgacagagtgatccctttcttttagccgctgaatcaatcgaaccgtctgcagatacatcaggcatggttatgtacagacatgaacagggaaataaaatagtaaggtggtgtccttaacagctgtcctatacccaaaacctccttatatgctttcaaccaaagcagggtactagtaatctcttgcttcaatagaaaaaagtagtgaactgtgtcaagttcttgcttatattggtcattggaagcaacaaatgcaatatagttttatgggtgcttagcttcatcggttcccccatggagacattgcactccttcctagttcctcccaacttaaccccatatttacccccatacaacccatactacagtaaaactaggcacggaggctcccatgttatctttgggagatttgctccgatccaataaaaagtacatcgagctaccggtaccgtgagacatcaaatcgtttttaatcgttggaacggagcaaatctcttggatctaacaatgccaatcctacctaactagatctaacgatcaaaaatgatttgatatcatgaggtaccggtaactcgatatactttttgctagaccggagcaaatatctatcttttcacacctaaagtcgatctcatattttttttagtgcatggatgatgacagtcaaaataaacattgctcatcgcactactgcacgattgattttactggatgcccccctttttgtttccatgcggtccataagtggaaccacacggaaaaatagggaaccggcgctagggtgtcgcccgcacgggaaaattgattttccggtgcggacgtcctaatccaaccacacgggatattcctccctcctttccctcacacccacttcaaatttttcctatctctctcttcctttttcccctttattccctctcaatcactcccctttctctctaccttatctcttcttttatcccgtcctctctctcagcctccctcaaccctctctctataccttatctcttctccctcaaccactccctcaactggctggggcgaggtggcggcgctcgggcgcggcggcggcctaggtgaggcgggggccaggccgaggtggtggccgggcgaggcggccaccgggccgaggccggtggttgggcgtgaggcggcggtcgggcgtggtggcggctgggcgaggcggccgccgggccgaggcggcggctgggcgatgcggcagtcgggcacggcggctgcctgggcgaggcggcagtcgggcacggcggctgcctgggcgaggcggcggccgggcgcgacggcgagcagtgaggcggccgtcaagacgtcgccgagggcgctgaccgcatggccctcaccgtcgacgaccacggggctgtagccgacgacttctgcggcgccaccgcctcaccttccaccaccgccacaccttccaccacctcgtcgagaacgcctacctcccccacgtcctcgccgagggccgcgccgtcaccgtccgcaaccgccagcgccgcctcttcaccaacgggtgcggcggtcgggcgcggcagcggcgtgggcgaggcggcggcgagcagcgaggcaaggcttcgtcgtcgcttgtcgtcctcctcatggtcgtcacgtgcatcgtcaaggcagcgatgcggcggccgacggcgatttttgcttttttttttttggttttttttttgttccgggtggaataacacaaccgaacggatatatcggtcgttctgcccgcacacaaaaatgctgattttcacagacacccggctgcagacgggccgtacaaccgcacggggaaatcttgtctgtagtagtgtcggtctaacaaaaagaaaactgcgaatatcacacaaacattgccgagtaaatgttgttgcgacggccgacagtaatatgaacaggttacagatggcaaagacggtatatatggagattagattagagaggcaggaggcacgatggagggaagcttaccacggcctcggatgtgccgccgcttccccatgacgctgacgcggcggagggatccgatatcaagcagagaaatcgacgatttcgccgctcttctccctctctctccgcctatatatttcgcttgttcaaggggagaggaggaggaggagatgagaactcgccggaggccgtacgtcgtcgtcgccctgatctggagcctcgcggagttgcgctgctaggtgcgagagaaaggagatatttaactcatcgtaatatggaacggagggatttgtagtactacggtctgatactctgatctattcaggttcatagtcctaataccgaataaaaaccttccatagatgatactagtatctttgaattttgcccagatcattaatgaactgataaaatctggacaaatgtcgttttaataaaaaaacaaaaaaaatcagcttttttttttgacttacggagaaacacgtacggccgctgcatcttatccagtcctgttaagtttcttctcattttcctagcaaagatggcgattctgacacttcgtttgtcggatgggaatgtttggtcgcaccagtcattgcgagattagatcttactctttactctctccgtcccttaatataagaaattttgacatttattatattgttttacctttgtcctattcaaaaaactttggaattatttttttttgacttgctttattatccaaagtattttaagcataactttttgttttttatatttacacaattttttcaaaataaaacacgtgatcaaacagtacaaataaaatatcaaaattccttgtattaaggtacaggggagtagtttctttggttttccttcctttatcatgtccccttccccccttttgtattatccctgtaaataacttttacttctccttgatacaaaatgtgcttcttatgtattccaaaaaaaaacattattttcattttatttgaatcttggtcgttcatattttctaatgataaaacggaaacttgcaaatattctccgcgcgtcagttttggttacacctttttttttgttaacctgacactttagaacaaatattttcccttctttctgttaatataagggaacttgcaatacatctgatgcaccatggttaaaatttcacaagcaaaagttatagtaattgtattatcctgttcaagatttgatgataaaagcaaaactatataattatctattggacagttctaattagtagttcaagagagaaagcaccggacactttaaaatcaccgaattaccaagaaaattaagttgaagaaaaataataattacaaatatgattcaacagcatggcaacggctgcaaggcttcacaacatttagcttgaccgtggaaggaacttttcgctcgatgtatgtttggatagccaggactgcccttttggcttccgttatcatgattttgtccataggaaagcatctgtcgtgttcacctgtagaacagctgaaaaaaccacgagttgtatccagtgtaaggtacttgagtgcaactgtattgtcaagaatataacatgttagctcgatcaagctctttgcagagtagaaaccggtgatctccacactccggaggttgtcatgacggtgtcctggcatttgcctcatatgtgaggaatctccaataatcgagtcatgctccatgtggttctgcgatatctggacatgaaaaccaataataaactttttcatttgatgggctagtcacttaatcataagtttgcaggattaaaattgacttacacccaaaaggaaagtctccaaggaagggcaagcgtcgagaaaataaaccaggtaaagataattataagctggggaagatgagataatggtatgatcaatggtcaagcacttgagatggaggaatttgctaggcaatattggtgtatcaaccatctgcataaaaagcataaagatcatcaggctgaaggcatgaatattgttatatggacatcacaagtctatgatcatttatgttttttgagtaccttgtcagtcgagcatcagagggtgagagtttcaagatttggcgcattggatggaagctttgcatgagcataatacatagcatcggggtagtgcaaggatagtctcttcattcgcaacgattcgccaagtaagagttgtacctgcctacctccaaagtcaaaactgcaaagatttggagccttattctcaactacttgaattctgcaatcaaacacttctaggtggctgaggcactgcaacagggaaggtatcttcagacaaattattccattgcaatacataagttctaactgctccaaacaatgagaatttgagagaaggcaccctaactcatctcctgtaatatgtacattaatcagatgcaaccttgtcaggtttctcaagtcaaggttgattgtgggatggaatccacaattgccaagataaagatgccgcattgagcttgctctcccatcagctagaagtgagcatgggaagctgtactccatattgaatgaagatagagataggctaatggtgagttcttcgatccacggtgtaatagcaatctgatgccaactatcgaaatgatggctgatgctagtgctccttctagtattgtaaaaactattatattgaaactttaccgacttgatgccaattcctgagtgatttttcataatgcggtcaaatttgttgatgaaatccgagcccagtattccaatacaacatataagattgggatggcatcgccaggaatgacgaaaagcacgagacacgcatgctgcacgagcagcatctttgaatgacattagggagtgtatatggcaccagatttcctacaagcactagcaaggataaaagtttttttaaaagaattgtgaaggttcaattggaagggaaagcagtactattagtagcttataaggaatagctctttgggatttgtggtacgcaaactgaacggcacattttcatttttctccttttccctttcaaagttttcttagtggctatcgggaaaaagataaagcagattgtagccagtgactaattatgatcacatagtatgaaacctattcttgcttgaagtatgcagcggtagtcaacaatgttatgtatgaaatgatgcttttctccctacaatatcatcctataaattagtcaaaggtaatgaagaaaaaaataaacatgtatcttaaggacaaatcgcacattgggggttctggtaaacataaacattgatcatcaggaaactggtcgagaccagagtaatcacataaaagaagtacaggaacccgctgataagtgaggaagaacctttagaaagtgaactgccttaacaagattattaaggtgacgccatcacaaacaattttctgcttgagtgataaaggtgcaacagctagaacagagaaaaggtgccctcatgcagaattgtagaagattgcagctataaatatctgttcataaatctggatcaggctcctctaacttcaaaggcacgtgcctttgtcactaacatgtaggcccaatgaaccatggacccatctgtcagtgacaaagacatggtacctttgagtttgaaggtagaggatctcaatccttttgatctagccaccatatgaccaccagtgtgtagttagagactacttagagcagtcatagaatcatagtgacccactttgcttctaatataagtatttcttatcagcattaggtaccatacctctggaaggctaggcactgaatatcttgttcttttggcgccttcagaatctgcaacgtggtgacagaatgagcccttccttttagccagtgaagcaattgaacaaacacatcatttgcgtggttatatgcagacatcaatcaacaggggaaaacatcagatcaaagcacatgaatgaacacgaacaattcaatttggttcagttgtccagctttttgtgaaaagagcgggtattcactccaatttgtttcattacttcctacaaatcaaattcaaccgagcattgctaccttttacctcccaaaagaaaaaaacaattctacactattttgttcctaaattccacagatcataatgtcccattgccccttcttgaattgcttgcaagcgagatgctctttttttccccaaaaaagcaatcgtggctatcaaacacaattgctgaagaagaagaaggtaggagagggagggctactgcggggtcggagttgccgtcgccgccgacggcgatgccgctcctgtcgcgcagacatgagacgcttcggatccagcatcttccccatggcaacgcggcgaatacctcgccggaattcgcgccgtcgccggattcgcctcgctgccaccgccgcagcagaggtggagtccgaagacctaagggcaaagggagtccgacatgggccggtcctgtgctgatatgggctttctgggctgtgatgggctcggacgatagagtccggccttcacaaccaggcccatgtcggtggcagcttgacaaactgagtctattcttttttgttaatgaaattcatttctgatcttcacttcaaagaaatcacaactaattactacaaggttatacacggctataaaattagaaaaagtgatactacctccatttcatattataaaacattttaactgttttagtcaaacttatttaggttcgaccaaatttataaaaaaaatattagcaacatgtacaacaataaattaggttcattagatgcaacattaaatatattttgataatatgtctgtttagttttataaaatgttgctatatttttctttaaacatgatcaaacttaaagaagtttgattagaaaaaaaaatcgaaacgagttataatataaaacgggggagtaggcacatgaatactagccgaggcggatcaatgttacgttgacaattcaagagatggtgaatgaccatgcatgagattgaattagctgcaaattaagctaaagggacacacttggttaagggtatgtcttcacataacgtgttgtagaagtgattagagcctttgatgttcagggacgaatatactccctccttccctaaatgtttgtcaccgttgacttttttaaacatgtttgaccgttcgttttattcaaaaacttttgtgatatgtgtaaaactatatgtatacataaaagtatatttaacaataaatcaaatgatagaaaatgaattaacaattacttaaattttttgaataagacgaacggtcaaacattttttaaaaagtcaacggcgtcaaatattttaggatggaggtagtatatagctagtctgttgcaagtcaataccctcggagaaactgccttggatgaaattccttccttccctataaattattacaccaaactatacagataacataggcagtgacacgaatcatggcatatccgaagcataactcgcaattagtccgcgacaccgaccaatacgcaaataatctaaattcttacgagtacgtgacatgggatcagcggatatatcatatatgaaccggctaattaatctaaaactctaaacttcataactctcttttctttccccaagactaacgcaaaatcatatacacacgcaaaatttaggaggaaattgaacctatcgatttattttggccgtcgaatgcatgctgagattatggatacgcgctgaaagcctgtttggcacagctccaacttcagttccacctctcctcaagctggagctcagccaaacagtttcagctccatctaaaattagtgtggagctgggtggagctctctcacaaaatgaacgagaggtggatttaggtttaaatagcttcacaactccactccagacttaactcttgcagctaaatttaagagttggagctttaccaaacagaccctatgattcgtgtaagttgtaagggagaaaaatcgcgtgcgggggatgactataaaatgcccttgctccagagcgagcaaattaagcaaaagaacttggtgggcacctagcactagcagcgactgtggtatatatgggaggaggaggcggcggcggcggcgcagcctggctggcgtggctgctcgtcgtcgtcgcggccatcgccgccgtggggcacggcggcggcgtgcagccgctgtcgcgggtggccatccaccgcgcgcgcgtcgcgctcgacgcgtccgccgccgtgcgggcgtcgccgtcgctcctcggcgcgcaggtacgtacgtgagcgtgcgcgtcctttaatccagcttttgctgtgcgccctccgttcctgccgctctctgcgttctctgcaacgcacggcaaagctactacctccgtctcaaaataagtgatgtcataagtatccgtctcaaaataagtgatgtcgtaagtatctgtgttcaacgtttaaccgtttattttatttaaaaaaattaaaaaaaatagtcacacataaaatactatttatgttttaccatctaataataaaaaaataatcataaaatttttttaaataaaatgaacggtcaaacgtttgttttgaaacgagtgaagtactcgaccacactacgcagtagcaacattgcgcgtacctaattaggtatactcgctccattacatcttacaagtagctttaaccttttctactcaaactttttttgagtttgatagtatcactagaaacatttagctacatttataacatcaaatttaaattagttttattaaatttaacatttaatatattgtgataatatttttgtctttgttgctataactttgtataaatttgatcaaactttaaaaaaattgattagaaaaagttaaaataacttataatgttaaatggagagagtttgcattagcttctcagttggctactaccccgtatttcgtaagtgcattatccaaaccattaagttatatttttttaaaaaaaacttttgtacgtaattttttattaaattatgtttaatttataataattaatattcaattaatcgttgggtaataactgttcgtacgtaccaaggaaaagccatccattccgttgtatcaaaccgagcctagcagtgtttgaggaaaaagaaatgagaagatattcaaaacgagataaacaattagcacatgatattttaaacttgaaaaataattactatgaactatttaaacaagtttcctatatttttttaaatttaaaagacatattcctccatctcaaaataagtgcagccgtatgattcaaatttgaactacagcgttacacttattttcgaacgaaaggtgtatcgtttaacagttttaaaaacatgcactactgtaaccactcatctgaaacgcagccttagcgacaccacacaagccaagcctggtttagttcccaacgttttcttttcaaacttctaacttttccatcacatcaaaaattttatacacacataaactttcaacttttccgtcacatcattctaatttcaattaaacttcaaattttggcgtgaactaaacacacccgagcgatttacttcaaattttagaggatcagatccgacgaaattcaaactaatcaaatgaaagtgtaaaaatccttcatcacaagtaatgcgaataaaaatagtgaccggtcaaacaataccgcgcgtcgagtcaactcccggccccaaaacttatcaatctgtccccgcgcatgtgaactcaaacccatccgatcggttgactcgcaactgatcatgcgtagtaccccccgaatattcggacgagatgatcacatcatcacgcgtcccctagaaaaacccactccgccgccgccgtcgtcgcgtcgcacgcggcgccctaaaacagcagccgccgcgccggccgctcgccacattcacacgagcggggccggcctctctcacgagagcaaaccaacaaactagttcggcgagcgagctcggtcaatcgggataccgccaaagagtgcgtgcgagtggcaatggcgatgccgct

SEQ ID NO: 53693 - DNA, 6296 bp, Oryza sativa
  unsure (1)..(6296): unsure at all n locations
tcgccgtcgccgttgcagttcggaacgaaatcaaatttctcaatatctcaaacatctcctaatgatatcaatcgttcttcctctcgccagattggattttcttttttttttaaaaaaaatggagaagatgattacatcactagcctctgcatgagtcatgaacaaaagctggggatcggggccctgtttagattccaacatttttcttcaaacttctaacttttctattacatcgaactttcctacacacataaattttcaactttccgtcacatcgtccaatttcttcaaaattccaattttagtagtgatgccatgtttttagtggcgaaatgtaccatggatattcttcgaaattgattgattgattgattggtggatgggtttgagtgtattgcccatgcttgtgctagattgctagtgtggtcacaggccacatggaattgcttcccacgcctgatagggtcaaatggtatttgcttcgactttccatttgtcagtgtacggttttgatgcactacgatctgcatgattgatcccatttcgtttttatcttaaattattgttgctcctattggtattcgatgtgatcgaatcaagatttgtctcctcgtaaaaagaaaatcaggatttctttgacccatttccattgtttatctgacactgttgtggatacagggggaagatactgcctgggtaactgttgatttcgcagctccgcatgcgagtgacggcgattggatcggagtattctctccttcaaatttcaagtatgaaacaagtatatttgccatggatttcaaaatttgaatagtgagaccatgtgatgtgagtttgtagattacaatcacaatgaccatgatctgatgaactcttgcactttcctgcagcgcgtccacatgccccggtccttctggatcagactcaggacctgttatatgctctgcaccaataaaggtttgtaggaataatagcatcatgtttgtaaaagttctgcaaatgaactcctaaactgattttttttgtatgtctggtttcagtatcagcttgcaaattattcttcagattatggcaagacaggaaaaggcactctcaagtttcagttgatcaatcagaggcaggacttctcctttgcactgttcactggtggtctctcaaatgtgagttcaaaacatcacattgtaatttttttttagataattcacattgtaattttatccagtccttattactaaagaaatggcaactgacttaatgtatttcatttccagccaaagcttatcgcagtatcaaataagatcgccttcgcaaacccgaaagctccggtttaccctcgtctagctcaaggcaaatcctggaatgaggtgaattatcttcttctctctgactcacatttgcaaatcatcctcttctctctgactcacatttgcaaatctagatatacagatctaatatgagatgcatcctagcttaaaacgtcaaatctctgaagaatttgttgctttgtcttgctagatgactgtcacatggactagtggttatgacatcaaagaggcatatccctttgttgaatggggcatgaaatggagccctcctacgcgcacagcagctggcaccgtcacttttgatcgcgaaagcttatgcggtatggaccgtataaaagatcccttttatgcattatcttctgtatatgcatataatagcatgaaatttgtgaggagcttgcaaaaatgtcaaaattacacaatcctagatgtccaatcttgatgccctgatgtggtttaaattgtctgaagttagtacattgtgttcctcacagtagtttttgcttgtgcaggagaacctgcccgtactgttggttggagagatccaggtttcatacacacagcattcctgactgatttatggccaaataaagagtaaattacttcctatggctctatcaacattttttttcaattgtgaatactggtcttctgactatgccatttttcctgctagatactattacaagattggacatatgctacctgatggaaaaattgtatggggcaaattttactccttcaaagcacctccttttcctgggcaaaagtcactgcagagggttgtcatttttggtgatatgggaaaggtaaaatatacaccagcgcaaaatgtatcgatagttttagtactctctccttcaaaaataattactccctctggtcaaaaatatttatcgtttgggacaagatttagttaaacttttaagttcactgcttagctcagtcctgaagcaaaactacctcatgtttcttctgaattcacatggttttatcacttgcaggccgagagggatggaagcaacgagtacagcaactaccagcctggatcactgaacacaactgacacactgatcaaggaccttgacaacatcgacattgtatttcacatcggtgacattacctatgccaacgggtacatttcccagtgggatcagttcactcagcaagtcgagccgatcactgctcgagtcccctacatgattgcaaggtctttcttgatgaacatctttggtttattaaatctccaagccggttaactaattctatgataattactaacatgtttgatacgattggtttgattcagtggaaaccatgaacgggattggccaaacagtggatctttcttcaatgggacagattctggaggggagtgtggggtgcttgctgagaccatgtactacacacccacagagaacagggcaaactactggtaagtctcagactctctctgtatatataatcaactcaaatttcaatttccatttttttaaaaaaaaattgaatacgtttgtactgaattttgaatatttttttctaaattttagttggaggcacattcttagtttataaaaccaacagaaaaggcatttttgtttttgaaaaccggatgtttcgagtaaggtcgagatcacaaactggctcggtgatgctcaaaaagttcaaactaaatctgaattttgttggcaaaatttggtcaaatttcatcggtagtcaacggatttcatgaaaaaaaaataggggaaaccgtttcagaaagcagttcagttttgcggactctgcacgtcctactgggatccaccgacctgaaattttcattccgaaattgtgaaccctgctgtcaactggttgccattgtagaccggaatgcctgaattttgaacaaacaatcttttattttttttgctaaaatttaaaatattcgaaatttgttctgaactttgttgggcaggtacaagacggactacgggatgttcagattctgcgtggcggacagcgagcacgactggcgggaaggcacggagcagtacgcgttcatcgagagctgcctcgccacggtggaccggaagaagcagccatggctggtgttcatcgcgcaccgcgtcctcggctactcctcgggcttcttctacggcgccggcggcgccttcgcggagccgacggcaaggcagagcctccagaggctatggcagcggcaccgcgtcgacctcgccttctacggccacgtccacaactacgagcggacgtgcccggtctacgacgggcggtgcgcgtcgccggagaggtcgcgctactccggcgcggtgggcggcaccatccacgcggtggtcggcggcggcggcagccacctgagcaacttcaccgccgaggcgccgccgtggagcgtgtacagggagatggactacggcttcgtcaagctcacggcgttcaactacacgtcgctgctctacgagtacaggcggtccagcgacggcgaggtgcacgacagcttcaccgtccaccgggagtaccgcgacgtgctcgcctgcgtcgccgacagctgcccgccgaccatcccgccggcgacgtgatccagctccggtgattccgccggcgagtctgccggcgacgtgtgcactattgctgcttggtggtgcttgcgggcctcgtctgtaatcttgacttgtcaatcgtgtgtaaattgaattgcgaaatatttcgaaattaagtcaaataaagaaatgttacaaaattatgtgttttaaatccttaattactcctcgtctgaaaattaaacaagttattttcaaatttgaatgcaaacgaagcagatccccacctctccgggcttgatccgcaccgcacaatgtggatcggacggttcatggccctcaagggggttcggcgaataaatctccgaacccctcctcgcctcgactcgtactggttttggttggatcggggcaagaggaattcacaacccagtgaactataattaaaatatttagaaatatatatatatatatatatatatatatatatatatatatataatcaaacaattaaatccttaattacctcgtagaattcacaactcagtcagctaattcattataatatgaacagttttcctactgatctactccatgttcatgtgaaattcaaatttttaatttgaatttggtgaggcgacgattagttagttggccaaggtgtgggggtcgcaggcgtcgacggcgcaggcgagcacgtccttgtagcccctggtgatggagaacgcgtcgagcacctcgccgtcgtcgctgcggatgaactcgagctccagccgcgagtggtcgcgcgccgtgagcttcacgtacccgtagctctcgctcctcgccgcgctccactgcggccactcgccgccggcgtaccccctcagcctggcgccgcccgtgccggccacgacgtggatcgtgccgcccagcgcgccggtgtacgccgccgccggcgagctcccgttcccgccgccccccgccgccgccggcgccgccgtgcaggtgttctcgtagaccgggcacgtccgctcgtagttgtggacgtggccgtagacggcgaggtcgacgcggtgcttctgccacagcggctgcagcgtccgccccatgggctccgagaaggagccctccctggcgtagtactcgttcgacgagtagccgagcgggcggtgcgcggcgaacaccagccacggctggtgcttacggtccgccgccgcgaagcaaccgtccaggaacgcgtgctgcgccgtgccggggcgccagtcgtgctccgtgtcgccgacgcagaagcggaacatgccgtggtcggcggcgtaccagggcttgccgcggttcgccgccgccggcgcgcggaagtaggtctccgcggggacgccgcactcgccgtgcgagtcgtcgccgccgtagaagccgccggtgtcccgggacgtgcgctcgtggttgccgctcgccaccatgtagggcacccgggaggcgaccggcgagatctgcgccgtgaactggtcccactgcgccaggaagccattggcgtaggagaggtcgccgatgtggaagacggcgtcgtagttgggcaggtccttgatcagccgctccgtcgtcacctgcgcccccggctgaaatccggcgagctcattgctcccatcactttgcccctgtcccaacaaaaaaaaaaaaactcagccaatacactccaaattcaaatttacacaaaaaaaaacatgtatagacagtatattttaaatttaaacagaaactcttagccactacgtattaaatttaaatttaaatttaaacagaaactcttagcttctacacttcaaatttaaatttaaaaaggaactcttagatactacactttaggtttaaatttaaagttagacaccaaggaatgacttagtgtcaatggttttaatggtttcaaggagaagcaaatattcctagtgagcgtgctcaacaagaatcgaatcaatggtttttcttccttgttttttttatctttattttcttccttccttggcataggccggtctggctgagtgcgtcatgtaacaaaaactatattcttctaatatattgacgtgcaatccttttgcgcgttcgcaaaaaaaaaaggtgcatgccggcaactcctgccacaacgctatgagcgcatctcagaattaaatttaaacagaaactcttagctgctacactttaaatttaaaatttaaagcatattacaagtctacaacatatggaaacagatcagcacgcattttcaaataaaatgtgaacattgtcatcagaatgtgcacaagtttgatgaaattcttacgagtcccatgtctccgaaaatgacaattcgctggagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53694 - DNA, 1196 bp, Oryza sativa
attgttatgacaagtgattaattgaagccctgatgattactcaagtgtacattttcttacatgagcggacacaacagttgacctatgaactgcaatgtgcaatctatctaagtgacaactatgaataataataataataaaaccaatggtgcaatgtgtttgagagggaggcatatggagcttatatatagccatcagtgcatcgctttcatgacggtggaatattggtataggttaggtgcagagacttggacactaacacggtggaattgataaaaattttcaagctaatcatatagttttacaactggtcgaactatattaggtacagcttttggatggtagtagcatatacatagcttcctctatttcgacggctaaactgaaccaacttagtacggcacatgctacactcttttgcgtactaaggttggatagggtgagactatcaagaataaaaagactccttttgaatccttgaattttacagaaatttcaaatggattagttcaattccaaaaaaaaaaaaaattctataaattcctccattcaaggaatgcaaaagttagatgaattctgccaataaattttttaattaatatactagaagagcatatttttcactttgtttttaattttatattataatatactttttatattgtttttgtattggtacaatgtacatgggagaaaagcaagcaagctgcttagtttaattaggagtacacagtactatgctcttttgtgacctgtgagctgtcttgtaatactgacctggcgtcgcctcatgaatccgacgtgccactggccagcatctctgcggccagctggcacaagctgacaagctgtagccatcgccacgtaggatgggtaccacgacaaaaaatgacttgcattgctttttgcaagtgtttgtttagtcgccactactgtcgttgcaacttcttaatcacccctactttgtgtaccaatgtatgtatatatgcatacacgccccaagatggagtacattaattactagtttcatgtcacaatccaaagtaattatattttgggtacatacagagaaattaattgatttggaagctaacctctacttacatgttttgatggatacgtgtgcaatgcacaggcccttttaattcttttttttttgaaggtagtactatagtgttttgccgtgctggtaatct

SEQ ID NO: 53695 - DNA, 3692 bp, Oryza sativa
gttttatcagctgcataattaggtgatgggatttgtcaattggatgctggaattgcatgctcaaccatcaaacaaattgtttagtttaaaaaacgtaaagtaaaagggaaatgaaaagatgggaaaaaataaaggaaattaaacatgggatcacgttggttgcatgtgcaccaaagactaagctccgtattctagaccaagtgatgactaactaatttttatagtttatgagcgtgcaaagatgtggagaatctgaattattctttttaattttttttgcaagtggggaatctctagtctttatgtccattttatcactttggaaaatggaaagaaaaataagacaacatcggtcataccgtactacttttgttctcctaaaaaagaaggaaaacttcaaagtatgtatcactgcacatatgatcgaaaaaagaccaatttataaaagaagaaaaaaaaaacagaaacaatcactggtattggaccaaatagcacataaaattcagttaggggagcccactaaggagcatttgcaacaaacttttcatagaagaatatatgtaaacaatatagtatatactaatatgtagctctcccatattattgttgggatttctctctacagtttgcattgttagttagggagtgaacatcttcctctttttagctagtccaaataccttccttgcattggtattttccctttttactcgtccaaagcaacaatttccaatgggttattcatatcataagattaacttgattgcatataaatttcttcacggcaacgtaaatttatgaacatgattcaattaatttctatcagagtgtagtattttcaacatgatataaattaatttactaggtttttataattctgcatttttttgttgaaaattatggaggccatatgggaaagggtgacgatggagttgtcggtgatatggggtatggcagacagggaggagtatatactactgctacacaaagtcacaaaactacaccgaataaatcaaattatttcttcagtagcagcagcagcaaacagctcatcaggtgttggtgatacctatgttccgggcaccgatgcggccgtcggccaccgacacggcgactccaccggctgcagccggtgtccggcaccggcgatcgccggtgagcccagccatcttctttcttctacactgacagactagactaggattcgtctttgcctcgggattcccaccaaagcagagatgtcaaaatggtcccggtcaaactgccctacccaaccacattattgaaaattgctaatttaatcgttaacaaatcgtaaaataaataccaaaaccaagtggatcccagtaaacaatgctttgaacatgcaaattaacaactcctatgtgtctacatctcatgctaatgtgcaataacatgagaagctgctcctaagattgaacagattttgacaaaggtgagatctttcgaattttgaaacatttttcacgggcaaaacacagatcaaccaatcagaacgtcagtattagaggctattcactacttggaagctgttaacagtttttcacacttgacacggtatcagcagtcaaaaaattttcaatgagccactgtccatgtgcaagtattcctttttcttgttacaaaaataattatgaccgatctgaatcttaatggtgcaatgtgtgtggtttgtgcagggcataattctgggtcctaaagggagataaatgatgttaaaattcgttgagtcacatgcattatgaacagatctatccatgcatctgccttattggtgtggtgtggaggatgatgagggctctacatgcatatgcatatgcatcccatgtgacatgttattcagcttccatccaatccaactatctcccagtcctcctcaccccacaccatccactcaacaacagcaaaaatcttttttcaatttcctcaatgagatcagcacagcaggctcaaccaaagaaacaattatcagcaatgatccaacaaccatacagttcagaaaagggggtaaccaggttggtgccaaacatcataaaggccacagcccacactaccaccccctcttgttaacacacaaacagtctcagggtgccattgtttagtatacaagcattgttgttgtagatgtatcagcaattaatgaaggtgttgataaggaaacataagagcataaatgcatgctgaaatttcaacctccaaattaagctagaagagttcatcaggaaaatgacagtaaatacatttaccactttacagtgcagatccatgatacagaccagtggaaatatgaaccggcacaatgaaaccacagcacttccttctgaatatctgatatcttcaggtacactagtcataagattgttacagaacataactgaatatgctccaccaagggggaaaagggggatatcatcatatattgagaacaacaataaataatgttggaagctgtatggtttgtttccttcttcaggctacttctcaggagctctgagtgaaggaatgatgtcatggttactacttcaaaacaatacatagcaattatatgccatacaatgtactgtccagtctccactatacagctactatacatgtgaagtgaatgagctcgcacatcactgtagtatctacatgtttcaattgctctactctgatcgtatacacttcaaatcttgggtaatagcttcaagtgtgaagctgtgtctcagtttctctgttctgatcatatacactacatcttgggtactagcttcatcataaagttgtatcgcactccttttgctatcttaggttctggccacttagcatcttctggtacatggatgcatttgtatcctagatttttgtacagacgcagcgcagcaatgttgtttacatcacaatgtaatgccatggatcggcaaccccaactctttgctcgctcctctgcttctgcaacaagcattttagcgattcctttacgacgttcttcctttcggactgcaacatttgctatatatgcaatacctgttctgcatgtttcaaacaaatctggatgatgtcaggcggcaaagtactagctcgtgtgttatattaaccctccaaaaatataataatggacaatcttctacagtttatacagagtgaggcaaatgaaaacaaggcttcacatatctgagcatttcatcagtgcaaaagaatagcacaaccaatgtttttgttgactttgtatccaaccaaaaacaacttattccatacatgccacagtgctgcagcttcatttagaccgcataaggtgttagaagaggttgtggcagtgttgagatggatgtcataagaggtgccatgctctataatgcagtgcaataaatattagaaaactgccacaagaaacgaactcagagaatatccttttatgttatcttgtatatgacatttcacatctggtgagattaaaggccacacagggcagcctttttggcagtgttttcatgatgatctgttggctaatttggaaggaaagaaacgcaagagtattcgaacaaagagacaaaaaccctgctcagttggttgaggatatcaaagaggaaataatcatctggaagtctgcaggtctcttttcacattgtgagaagtagaactgtttttcagccttagggctttgtattttccctttctcgtggggtaaggtt

SEQ ID NO: 53696 - DNA, 10734 bp, Oryza sativa
ggtccctactatctaacatctccaccctgtatcgaatgcatgagaaattatcactgctaagtataaacatacctcccattatgcaataatacgacgtaattatatgtacactggtaagcatgcatccaaattcttccatactatgacgtatttaatttaacctatatgtacatagaccaaagcaatcaaatatacttcacatgcatggttttagccaagcacgggcaaccaaatgccgaaataaactcatattcccaatgtatttcacatgcatattggtaaaaatatgttctattgacctaaatccccaaatatgtccatgcatatcacagtaaaaaataccataccacggttcaagccacggtaaccacggtagggtggacggttaccacggttttcacacgattaccgcacatacgtatatcgtctcatagattacgaagccgacggtaaccatacaaaaccgcacggttaccgctcctaaccgcgcgaaaaccttcaaaacggagggattacctcttgcccgtcgacccaggcggttaccgtcgcgtaccgcgtggttaccgccgcttaccgcgcgggaaccggcctcgccggcgcggaggcggcggatctggcgcgggcgcacgccgtcgccccttcgggtcctgagcgcagctacgcgagagaggggaaaaacagtaggattcgccagagaaacgaagcagaggcttccaaagatattttcctcccattgtgggccttattgggcctcgtgaacagtgcatacttggcccattccatttaatcttttttcttttttataattcacaataggttttgcgctcaaatttgaatttacctgcatctttttgatgaaattttttcaccataacaacatacaaaacaagctttacatccatgattttttttgatttttttggattatttttcaaatttttgaatttgagcaaaatttgcccaaaccctaccgccggtttttgttaccgaccccccacggtaagcccggtaaccgcggttaccgcgcggttaccgacgagaaagtgaaccctggttgagacagactcatcattctttctctgtttcaaattagctgtcgttataggtttgtgctagttcaaacattttaattttggatcatcaatttttataaaatggtatagttttaatatttgaacatttatatttttattcatcattagaaatactttcgtattttgttaagtatataatttatatgttgttaaactacatggatttcaaatgattaatagtcaaagatatgcatattttgacttaggataaacataaaagacaaggtgatttgaaagaagtttttttttcagtaaaaaaggagcctgaatttgaaaggtaatttttaatccgttttcttttctagagagtgactcccagcaataaagcagtgttattctctttgataaatgggcgacagtctgagctttgaacttactgttaaccctcctaataatgcaataaacctaagcatattcgtagcgtgcgcatcaggtaaaaacatccaagtcaatcactagctagtggcgcatgtgggaggcaagaattaagagcatcttgaggactagcactgtacaaccattccaattttacttggttgagagttgagagttgagacagacaacgattgcattcccctgtacattatactccgtatttaatatccccgttttttttatagttattacttcctccgattcaaaatgtttgacaccgttaactttttagcatatatttgaccgttcgtcttattcaaaaaagttggtgaaatatgtaaaactacatatgtacatgaaagtatatttaacaataaatcaaatgatatgaaaagaataaataattacttaaattttttgaataagacgaatagtcaaacatgtactaaaaaaatcaacgatgtcaaacattttgaaacagagggagtactaaataataaaaaggataatgtcgctggaatataaaagtagctttcatatttttctctactatatttggggaggtatatacattcttgttacttaaagagataactcctatatagtactataaggtaatatatatacacctctttacattaatattattgactgtatatttttattctaattaatttaaccaatttaaattttctacctctcaagtagtggggatataatgtacctctctctccaaggatgagagaaaaccttctaaaacggatggaccaaacaacgtcacagaaagtacaaattacacacagccagatgtttagttttttccgataaaatcatatgtttatctgatgtaaacggaacttttagcaatacacaaggtataattccctctcttactaacaagtgaggtagctccaagtcactaaatgatgtagatcaagatggcaaattatcatggttttaaatagcgggttcagacatttaacggttaacctttttaaataactgtaacggttaaattgagctataacggctaatttatacataaaagcacgtagctaaaatccttctcaaatagttacagtccgatattcaaaaccatgcaaattatgagatgccacatgtaaacatgtttccacaacaaatttttttctgattgatctataccgaaatttcaccatacaaatttaatagcagtaaaattactactagtattgtagagagtacgtgatgccaaattggagatggtggcgtgcagggtttccgtcgctgaccgcaacccgtagactccaaaagagaaaagagcgacggaggaataagaagaagaagaagcgcacaaaagcgagagccgcctcctttcacgggattcaatagcgaccccaacccaacccctctattgcttgcttagcatggtggccaatcgttgaataggatgccaccatctggactcctcttttgttctcttgcactaatctagtgcacataggcacatgaaaaaacaagaagaacatcatatatctgaacgatgaaagggacacgggtgcaaattaaaatcgacaacgaagagagatcgttgcgaacagtcactgacatatgggttcggacgagtcgtatcagctaacgaggctcacatgtcagtgactgttttgtaacgatttcgtagaatacatgacgtgacgattaagatgagttaaaattaatctatccatggatttcttgctgttgctattgccgcactgggcctgcttaaattagggtcaagtgctggaaatgggcagctcgattggcgctgtgaaagagacggatcatccaatccaccgtcagaagaaaaccttgcgccttttaagggacatttcgccaatttgccgttgcgattgcgatctccatcgccgtggtagggacaaaaacaaaacaagactttcacatgctcattttctcatttcattacattacattacacttctgcgttcgttgctagtcgctaccactttggtcttcggaagcacagagaatctgcttagtttaagcacagcaaaatctgatcatcaagcaaaagtcatgagagagccgtagaccaatctttttcgaatagagccagtcgagaccagtgagtgtagtagtttttgcagcaggttccaaactccaaaggcaaaagcagtagtaaaagaaagtgagccagattcagctcaagccaaccagcctcctctgcatgtggctggttgaacagtctacatatggatgctacaacactttgacccgtctctcccagattattcgcctcttggctcaatccagcatgacatatctaggacactgcactgcagcatctgctgcttcttgtctactccatctctgaagaagttgttgttcttgcatattattgccaatgcattatatgtaaaatactaaccactggtagtactgaaagtgcaggtgattagtgcacaaaatgatggaagaacatgttgacgatgagtgagtgaggtgcatggatggatggtggacatgtgcagggtgatggagtgggtgggcgcaggcatcatggattgatggcgagggtcaaagaaaagcgcatggaatggatgggtcaggcaggcaagaggcaggaggcacaggcagcatctcagcttgggcagtggagccaccgagcaacaaaccaaaccaggcccaaacaatctcgccactgttgcatggattgacatgtgtgggtgtggggttcctcctccctcctcatggcacctctcaaaactttaggccttatttagttccttatttagttcctgaaaaaaaatattttagtttcatatcgaacatttgactggatattgaaagaggtttttaacacaaataaaaaaactaattttataacttacctgaaaaccacgagatgaatttattaagcctaattaatttgtcattagcacatgtaagttacttagcacttatggctaattatagactaactaggctcaacagattcgtctcgcgattttcgtgcaaactgtgcaattagtttttcattttatctatatttaatgttctatgcatatgtccaaagattcgatctgatgtttttggaaaaaattaggaactaaaaacaaggcctgagataatgtctaaattgtaaagttatcataggcattttattatcgatgaacgaaatcataatagatgtgttattatcgatgggcgctcaccatatcactataaaagtagttaaccatacacacaaacactcaaatcaaatatagagcttgcactcatgtaaatagatttcaccataataaacataaccagccgcctccgttgtcaaagtgtttgttgggggagttttagattctaataagcagctggttgatagccagcttataagaatcactggatttcttagtttctgactttcagttcattttttaatttcaccattacaattttttaaaatctgaaaaaaacctaaattgtcggaggaagcttataattctgagaaaaagttctgcgtgtcagaagttttgcaaacagacccaaagtttatgagctggtactagtatgagctcactttgattgattcagctcaggtcaggtcacatgcatgccattgccacccactagtctactggtcactcactcgctcactgccgacacccggccgcggcatcgatctgtggcgtacgtatgcgtttgttttttagctggtttggtgcgtgcacatccaggaatcatcagatttgccggctgccatgctgtgccgtgccggtgggtgatcgatcatgctgcaccggcgcaacagattaatcggcacaacacgcatatatatagagtacagtgctcgtaaagcaacgttttctcttcttctttaatggtttcatccatccttccattcgttcgttcagtgccaaggtcaaagaatgcggtgggatatgatatggtagatgggggcgtgcgctaattcagatccaatgaaacgatcgacggcgcttttttcaattatctgtggcagattccacgctctaacatgcgttaatatatagacggtgtcgtgaaagcacccgaaaacatcgcatggagtgttggcccaccgggatttaaatgctcttgcccttaaatattagagcaaatttaattgtaaaactaaaggatttcagaacatatcacagtacaacgaatctagacataataatatgttgcatctctccagaatcccttatattatggaacggggggagtagttgttctaagtcaacttaagagttaacatgtataataaattagctataagtttatatccaatttttatgatgtacggtcgcacagaattagtcggctttcgtgaaaccgttagctcttggtttgtgaaaaccggtctatattaataggtttttttttcatgacattgattaaaagttaccggtttttagccaaccggtgaggaacagttttttactttaaaatcgataagttaaaccctactcccaggccatcaccacccaccatgtgcaaaaatccacaggacgcccgctgcatgcactacattgtcaccgcgctgcgctgcccctgcctgttttgctctctcagagcaaggtcaataacaaagcccactatcggctgcaatgggtgtacacatcatctgaattaaagcattatagttaagatatattatatagacttactatatcataaatattttattgttttatggacccaccatcttttccctcttttcagagttctctttctttctcggagttctcgttcttctcgtttcttgccagtgaggacggggcaacatagacgtgggtgagggcgagtgagatggcgaccgttgcagcggacaccgggcgacaacggcagcgtccacggaagacgcatgtgaaggtggtgacggcgtccatagaggatgtaggcgaagggcaacaacacaatctagtggacacaagctatggcggtagtcacagaggacaaggacgacgaacacgagcggatgtgggcgaggacggggggatggaagtggatgacgacgacatccgcgaaggacgaggacggcaggagggatgcgtgcgacgctagatgccgcggaggacgagtacgtcggctgtggcggaggtgggcgacgacgacaggacagctgtgggcgatgacggtggctacgagtgagggcgatgggacgtacgcgcgaggatgatagctcttattcggttattcactgccatcgctagttactgcgggccccacaacctcgggtcgagcatatagctggacggctaagagcaggtacaatagcaggctataagctagctataaatatattttaaaaagataaatgaagagagataagagcagcgggctacagatctgtagccagctgcagcacagactccaaaatgtaatatgtgtataacaggtgggaccaggtattaatagcatagtaagcaactattatataaattgactattatattagctatatatgatttgaagctagtaatagactacactattaaacttgctctaattagtcacccgcccattctatctctcttcccttctctccttcagctcaggaaaaattaatcctgttgaatctcctaccgttcattatttgtaaccgctctgacaacgcaacgccgctacagttgcggtatccatcgtaaaccgtgcggtgcgatgcggcacggacgcagcgggcgggggtccatggcttgatcaggggtcgaattgacaacacgattaacataaacacaacacggctgggctgctgcgtcgagatacatagggtacgtttactttcatgcgaaaaaaaccttactaaattttgttaatactaaaattttaatatagttgttaaaattttgacaacttatcaaaattttggcaggatttcttatatagttcccaaaatttggcaacaaactaaatattccggccttgtccgtttccacgctgccagctgcagatgcagacatgcaatgcactgctctggtcctacccccctacgtattgcaagcagatttaattactgcgtctttgcagcctatacgtactctccagtctctacagtacatggagatgtactataccattacaggcaggtacaacagctgactaagcgggctacaaaatagtaccacatcatcaatttcctatgtagatgagagagaacgaagcggacgactaaattgtcgtccggcgttagcatttttctccacgcagtatcggtcgtgtgcagccgaccctggcgctaaaaacgctgtttgtggggcctgcacgtcctcagacgatcccgtgagaactggctaccccgcggcgcacgatccccttcccccagcggtgtgcaaatccatctccgccgttcgtgcgcgatctcatcaccttctgcgtgcttcgtcttccatccacgcgatcgtgagcgaaaactgtgccgtgaaaaactctgatgccacatcgtttgacgaaaatcagcacaggaaatccactccttcctcacgagctcttcttgccaacaaacacgtgctttgtacttttagtactccagagaaattggttagtatgatctgtgctatgatcctggtgtttggtgaacaaagtttatctcacaacacaaatagctacaataatacaattcactcttgatcatatatattgatatgtgcatgtcataattaattgtttgattatgagatacagtcagtcaatagacaatctattgtactagtagttggctttagccctggactattagcccacagcgggctatactattagccttgctgttactgtttcgcctgtacaatccaaatcaccagtactgttgctcctcattttcatgacaacaccaatggcacatgctttcttctggttaatgcatgcaaattgtaattagcatcttaagctctcaaatatggagtagactattcttttacgagtagtaccagcaaagttgcagttgacctcatcagtgctcaaggacagactcacagacatcacagcagggcaagcaaaagtgaccgcccacaccacaatagattactcctactactgatactccatgcatttgctctcattccctcctttatataaagtcacagcctgcttttctatgactatttgctcacttattctttttttttctccccttcatctcttctctctctctggcccttgcttttttgctcctggtttgggacttccggacttgggatactattttgggacatgttttaaggttcagctctataaaggtgtcattctgcttccctggactggatgtatcaaacattcgtttaacacctgcaagggcaatacaaacttaaaccacaggtttttttcctttatgattttttagataaattaaaagcatcatttgtacttcatccgtcccataaaaaaccaatttagtaatgaatgtgacacatcctaatataataaattcggacatatgtctgttcagattcattatactaagatatgtcatattcagttttatattcgtttgtttagaccaaggaagtaagtaactagtatacccaacaaatgacattggaatgaactagtggtaagaatacactacagcaactcgccaattatatcagtaaatgcttgtgcccatcaacggcgacacgaggaaatcagtgacgagaaaaaaaagcaccagcaattaaacaggaaaggcaaaaaaaaacaaaagaaattgacacactcctctttttttcccctttaatcatcgggagaataaaaagaaggaaacaaaacggaacacacccgaaaataagttgagaggcagaggaggcagacagcagcagataggcagacaaagcaagccagagatctagctccgcttgtcggaaagaagtagtagagcctctctcacaaaaaaaaaagaaataaagaaataaaaaatcgagcaagaaaaatcacaagaaactcttctttctctttttttttggcttaatcacagtttttttgtgtgttttttcccttacacatactgtgccagtggccagtgttcagcgccaccacccacaggccacaggccacagcttggcaggttgggctttgagccgagctgagctgaggtctccacttacttcttcactgctcgccatcatctcgttctttccaagcccttcttctttcttttttccccctcgccataggcgccctgtgctttgctcgctcgctgcttttctctttcttaaaaggctgctccctcactcacaactccctctctctctctctctctctctctctctctctctctcctcacctcttcttgttcttcttctctctctcttgtcactcatcatcatcactcttcagcttgcttggttggttggtggagcttgggagttgaggtcaaatagccatcgatacacactcctctttcttttctctcttcatttctttctttacatcgtctctttcttgatttcccaatctactaagctcctactagctctgtgctctgctgcttcctcccatccatggcggcggttgccagcgacccacctacctacaagtagcttaagctcaagctcagctcagatcggagaggggtggtagaggtagtagcagtagttgagagagagagtgaggatggagagcagatggaggaaggccaagatgtcgctggggctcaacctctgcgtctacgtgcccaggacgctggacgacggcgactcgccgtccaccgggtcgtccacggcggcgctggtgtcgccggtggcgtcctcgtcgtcggcggcgaccagcgccaacaccacgcccacggcggagcagagggtcaagggcgccggcgcgctcatgccgaccaccccgacgccgacctccgccggacttcgcctctccaaatccggcagcaaatccttcaaggtacagtccctccttcacatccttcacatctctatgtatgaagcataaaaaaaaagagaaaagaagcttgcaactttgcaagcaaaattacagccaagatccatccatatgcacacaaaagtcacaaattaattccttttttttctctcgatttatgcctgctcggttgatttcagttccagtaattattgtagcaagttctgattcaggttgtacacctgtgatggatgttcttttttgccacacatgatgcatgcaactgtgcaagtagctttgctttcatgatttcatcacacgcacacacacacacacacacaaacacagagagaagataaaaaagaggagctcaagaggagaaaaggagatgctggagaagatgggcagagggcaatggtggaggagg

SEQ ID NO: 53697 - DNA, 4159 bp, Oryza sativa
ctttcacttccattgtatagctgcaaatgttaagcatggaagcaacaattgcccagtttgccgcaccaagtggaaggaactcccatttcgaggtcccttgcctggtgaatttcctcaaggaagtgcaaggattaatccagttaatgggcaccaaaatggcgggcagatgaccatactgcgaccacttccccgtgctcgttcttctggtcggctgcatcatatgacatcgttgttgcctgacactgaccgtagtatttttaacgatgatgaacccttggactcactgtctgaagcaaatgaaggctcgcagcaggggtgtttaagaacagtggaaataaagacatatcctgagttcactgaagttccagaaagtacttcagaaagaaattttacagtcctagttcatctaaaggcaccccttgctcagactttgcaaacaagcagcaaacttgaagatggcaatagcttgggcacaactcgagcccctgttgatctcatcacagtgcttgatgtcagtgggagcatggctggtaccaaacttgcattgctgaaaagagccatgggatttgtcattcagaaccttggctcctcagatcggctttctgtaattgccttctcatcatctgcacgtagactcttccccctccgtcggatgactgagactggtcgtcagcaaagcttgcaagctgtttattcactgacatcaaatggtgggaccaatattgctgagggcctgaggaaaggctccaaagtgattgaagatcgacaggccaagaatccagtgtgcagcatcatcctactatcagatgggcaagatacatatacagtctcaccaaccgctggtgtacacaaagcagcaccagagtactgctcactcctgccatatactagtaatggttgtcaacaggtaccagttcatgtctttggatttggtgctgaccatgattcagtctcgctgcattcaatctcacaaacctccgggggcaccttttcattcatagagacagaggctgccatccaagatgcatttgcccagtgtattggtggactcttgagtgttgttgcacaggatttgcatgtaaaggtggagagcctccaccctgatgtacactttggctcgatcagatcaggaagctattctagcagacttgcagatgacaagaggaatggctccatagatgttggtgacatgtatgccgaagaggagagggatttccttatgtcagtaaatgttcccccaggttacggtgaaacagcacttctcaaagttggctgtgtctacaaagatccactgatgaaggagactatcaatatggctgatgtgcaagtcaagatctctagaccagcattcgtctcagtacaaagcgtgtcaatcgaggtggaccgacaaaagaaccgtcttcatgcagctgaagtcatggctgaagcaaggttgtctgccgagcgtggtgacctgacacatgctgtttccttactcgaagactgccggaggatgatcatggggtcaacatcaggacaatccggtgatcggttgtgccaagcattggatgctgagctgaaggagatgcaagaaaggatggccaatcgccaaaggtacgaagcatcaggccgcgcctatgtcctctccggcttgagctcacactcatggcagagagcaactgcgcgaggtgactccacagacagcgagagcctaatccaggcctaccagacttcatccatggtcgacatgctgctgcgctcgcagacaatgagccgctcctcaacccctccacagatgaggcatgtgaagtcgtttccagcgcgcccgcagcctaggtaactgcaatttctagtgtttggcaacgccaataaggatgggttttgctaaagcctagatgtgaatttggtgaaagtagtagtgtcagttgaattcttggttttgtggcgggaggacgggacgggggtatagtttgtgtggtataagggggattttaacggtgtaaattaatttgggtgtggtgggggtaaaagggaaaaagaatctgtatttgggagaaggatggtataagagttggggaaatggggtaagatagggtggctattattttttttttccttcttgttggttacctggtatactcccagtattgtactagtagctctcctctctcctttgtgtggtgatgtacataaagagaagggtatacatttgtgaactggaatgtggttgaggatggggatggatacctaatccttttgcaaggcttggcttgcctcttcctggaaattgaaaattctgatcatggcctcttgtgttctgttttgtttccgtttgcatctgctggtgatgctgctgcatgttgtcatcttggtatgacgctttgctttgatttgttggcttggtggaactggtagggatgatccagttggcatcttcagcatcaggagtttggacaatcatcagctgggaatcggttggtagatgaagttgtattgatgaggaaaaaaaattctcccagttgatatagatgaaataatttggtggagcaaatgggcaacactagcatcttagcatgtactaccttcatcctgtttagattcgcagcacttagaatatatcacatcacatctagtactagattaacttattctatagaatatatcacatctagtactagaatatatcatatccagcactagattaacttattctgtgatggtggaagtgtactcgatatggcgagagaagagaaaggaaaattggggaatctgcggaggaattggcaccttgaaatgcttgaccgatcgttgatagatcgcagccgccctccaccgccggccacggagcggcgtttctccagctcgatctgccgattcgggcaccgccgaaaccacgcggcggcgggcgatcgccgtcggccaccgctgcgccgcgccgccaggaaacgtgccggtttccagcattttggtgcggcccaagaacgggatgaatactttcgagggtagggatttgcaataagtttacttcagatacctcatcttacgtcgagtttgaatttgtataacgtgtctctcaactgcaataccggtatacccgagattgtaggacggtatacaaaagagttgaatgggacgagttgaatgggatccaaaagagttggcgtcgaggatacctggtattgtgtttgaaggatatgtgcaacttaaacatgacctcaactagggaccaaaagtaaacttattccatggattttggcctgcatgcggttcattttggttggcccgacttacgtgcggctggcccatgtgagttcggtagcaaggatctgtattgcgtgcggcccattctgtttgggccagggaggaggagttgttgggccgaaatgtgtttgggcctgcgtgatggaaaggaaagggacgttggcgtggcggttggtggtgggcggggttgacgtgaatggctcaactacgaccgtgcttgtgtttgctgtgctgctgctgctgatccggtcggtcaggtagctacgctccgccaatctccgatagcgaccgacccaaacgcaaacgcaagcgctagcgctgatcgatacgtactacgcaccgcctaccgtcaggaacagctcggtttgccaaaaaccggaacacaaaccgacagtttgatttttcgattaatttttttaaaaaataaactggttttttaattaaaagatgttcgaatattgtcgagggtctattgttttgaaacaattttcattaactccgagacaatagttgatattccattttttggctctggaacggttcaccctgattcgaacactattactaatatagtatagtttattcattttccttttcttaaaaaaaacataatatgaacgcaaacgttgataaccgcgtacactcacccatataaagacacaagcacgccctaccgttaggaacacatccaaactatttgaccggcatatctttaaattgacgatgtcaatacgaatgtttcactgtcgactggtatattatttatacaattttttttagtttcatttgaatctggtgtagccggtcttcctccgccgcctgccagcgttcaaagcgaaaacgatgccaaaatcatcatttgttaacagtgcaaccagcacatcatcgccactagggatgaaaacggagcggatagttt

SEQ ID NO: 53698 - DNA, 2046 bp, Oryza sativa
caggtacggaactgttatagaaaaagtataatgtaacgagtgaagtacgaaatgatttaattagcacatgattaattaagttttaattagagtaaagtccatcacggtccctaaatggtaccgctgtgtcatcccggtcactatactcacaaatcgaccgttcagatccttaaacttgttcgactgtgtcatccaggtccctaaacttgcagatcactcgtttaggtcctccaacttgttcagttgtgtcaccccggtccctaaacaggacggtctaaaagctttatatcaaaaataattcataacttttttatgtaaactctaatgaagacaaactttatattaaaattatagccctcgacgcgacctacaactttgtagttgataagtttttgaattaaaactgtttagggtcccaaaatattgttgcatttttatagattttgaaattttaattttaaaattacattttgggacaaaaaaatgacttaaaataaaaaaaatcaactataaagttgtagatctcgttgagggctacaagtttgatataaagtttgtctttattagagttcacataaaaaagttatgaattatttttaaatacaaagtctttagactgtcctatttgacccagatgatattcaaatctaagtttagggaccgaggtgacacaactgaacaagttggagaatctaaacgagtgatctgcaattttagtgaccgggatgacacagttgaacaagtttgagaaccggaacgatcgatttgtgagtttagggaccgcgatgacacagtggtacaagtttaaggaccggtgatggtctttactcttttaattattataaattttaaaaagtaatttatctgatattttaaagtgatttctatataaaatgcttttatggaatacacacgttagcagtttgaaaaacgtacgataacacacgaagtgagcacaacagggtttaatgctatatatgatttgactttgttttgctactgttttgtttgttttgtttcgatttataatctaaattggcagagtttgtatcaatcgtaaaaattgtctttgtaacgcaatacgtatttttgccagttaacgcaatacgtatttttgctagtttaataaataaagaaagaggcctaattaacaaaggacgataggtgtacgagcatagcatcaggtcccgttcgaagccaaccgaagtttgtttggtgtttatatgggggttcacatgagggggggtgcagatctgtgtggttcacaacgagatggccagcttagatccacgaggagaagatggccaactgtcggttactagctcggttgacggtgcggctcaatttctttcaacattttccatttcttgttgaggagagaaaggtacaaacctgaaaaaaaagttattcccatccatgaaaatccctgaaaaagtcaaggagcatatgacacaaaaaaagtttattgcactcactataattatttatcttattatttttttggaatatcatttttggatagaacgatttttatgttttccctaacaaatttatttggtgtttttaaaatttcacatcatctaccacccttcttgaatttcctggatcctttggggctgtaattttcagatataccaaatgttttgacctagcaacgacaagatacagtggaggagcaaaaaaacaaagtagctgtgcaaagcatgcacaaagaacacacaatagaaaggtcttttttgggtggcagaaaaacggttaaggtttcaacagttgaaagtaaaaaaaaaaaaagaaaacacacacacaacgcggaatgtgaaaggtatgggcattctctagaaggaaggagcgttcaacgtgtttgtcagttgacaccgtctcaatatgcgggctttattcccaggggtcccagctgtcatccagcaaggggccgtttagttcccaaaagtttttccaaaaaacattacatcgaatatttggacacatgtatgagtattaaatataaataaaaagaaaaactaattgcacagttacggggaaatagcg

SEQ ID NO: 53699 - DNA, 3520 bp, Oryza sativa
accatgcaccacttagcaatacaattattacaatctattaaaagcacattaacataacatacaacaaagtacataaataaaataataggaacccctacactaacatgttacaagtcagctgtaaacacatgtgaaaaagagaagagaagagaagagaagagaagagaaggaaaacaatctatatattggtagccagttgtagcacagactctaatactgtacagactctaataacacgtgagtgtataagaggtaagaccatatattaatggtgtaatatatgattatagctaacttagctattagatcagctataaatgaattggagctaatagttggttatattattaaacttactctcatatgctttccctttctcagctccagctcattcgctattcgaagaaaaaaaaaactaccaccaaaatacgcaaaaaataataccagtactagatctcgactaatcccgcgtcacgaacttgctaatcagtcaataaacctaatcaggagacaccaaaccaccgaaaaaaaaaggagagaaataataatattcgcgcatccatcacgaccccaactcgtcctcatatcgcggccacccgccgacccagcgacgacagcgcagggaagaagggaggacgcgacgcgacacgagcgcgagaggaaagcggaggagatcgaggagaaactccatttccccccccctcgccttctccgatttccctcgcgtggaatccccttggactcctccccctcccgccgccgcgcgagccgggcacggcgagcggcgccgccctgcccccgccgatctgctctgccttctcctcaggttcgccgtcttgttggattcgcctttttttgcgttcgtttcgggcgccgtcagatccccgcgccgtgtttggtgagcgtgagctaacggaatggcacggccagatctcgtgggggggatccgaggcggtcggcggatgctagatctggggcggggagctgtacgatcgccgccgcgttagatctggtcccgttgctcgcgccggattccgctgcttttgttgttcaaattgttttggtttcgagctttacctttgcgggctattgggttggatgctccgtgatgcttcgaagctacgggagaatgttagtgatgatgcttttttggatcttatggacgaattttatacaggggcttgcaccgaggaggaggaggaggagagagctgagcagaacaagctagattctcaaggaagggcgccatgaagaaagtattcgatcaaacagtccgggacctgtacgtgattcacctgccatcttatcgtataccgtgtgcagttcgagctccgttcgtttgcttgatacaatatatttctgtcgtaatttaatctgttctggtctttgtttttgcagaaaaagagaggtgaacaagaaggtcctcaaggtgcctggtatagaacaaaaggtatcagagatctctgctgctccctcacgcaaaagcatgtgttaagcatgatagttactgaatttaatggattgctcgcctttcaattttcataaagcataatcagtgacatcagacttattccattttgctcgatggcctcatacagattcttgatgccacaagcaacgagccatgggccccacatggatcactcttggcagaaatcgcccaagcaacacaaaattagtatgttttcttcttgggcttttgttatttgatcacctttgtaacaaacaaaacctaattttcccggtgccaatgccctttgcgtgcttgcagccatgagtaccagatggtcatgaatgttgtgtggaagaggatcaatgacactggtaaaaatggcggcatgtttataaggtgtgttttcttatttgcttttaccccttaaccttcagtgttctctccttttatggatgtaagtggaaatagccacagcaatatgtagggcagtttattctgatgctatactatgcttgatatgtagggattgattgtcctggattacttggttgctcatggtacagagcgagttattgatgacataagggaacattcttatcagatatcggtattgctggaaatctattttctgtttcatatactccatgtagtttctgcctcaagtttcgtcagtatcttagttgcttgatgctcattaactttgttattataattgcagacactagctgatttccagtatatcgattcgagtgggaaagatcaaggtagcaatgtacggcggaaatcccagagccttgttagtttagttaatgacaaagagaggatacaggaagttaggcagaaagcacttgataccagggacaagtgagtgtgcttgcttttcgttatattggtacattgtgttttgtggacatgcatattctctgttttattgactacttttatgtgttcatctgaagataccggagtgcattcgccaccagtggaacacacaggagcccaggtggctatgacaatgaccgctatgaaggaagctatggcagtaggtatgataacagacctggctgcgggggagaaagagagtatggatatagggatgatgacagatatggtgttgctggaactactcccaatcggcaaggagatcgttattctagggattctaatgagcagcgctacagcagagatagagaagatgagtacaaaggaagtcatagcatccatgaatatgcagaaggatcaggtcgcaggagctatggacgagatagggattcatatggggatgatgaagcttattcatcccggtccgtttcattgtttttttctggatttaaatttttacacgttcatatagcagtcaataagcagcctataagattgttatttcattaagttgctaatattcacttggttatttatggttctttatggaccctaacttacatacatttttccatcacagtggccggcaaagcaatgctgacggacctactcaggatgagaggtaaatgatggagaaatgctaagttcataacatattaacttgtcttatttgagcaatttatcttatgttctgtacctccttcggtaggcccatggagcggaagccttctaaccagcagattgcttcaccaccgccaaactatgaagatgtcacaagagatacacaggataataatcatgatggacggtatgtattttatgttataatgtttgatcagtagacatgacaacgatctctgatttctgaactaccgttcaatatcagaaatggagggactgtgcctgtgccagttgctgcagcaaaggtgtcttcacctccaagaacaagtgtacccccaggtcaagtgaatggtgtacatgataatactgtggaagacgtacctgcaccaccacctactcatcctgaagttaatgggtttgacgagtttgatcctcgtggatcagtaccacgtatattttcctccttttttgacacattgcattgcatatgaaccaaaagcccacattaatagaaagcatcacacaatattattttctgatacatttatgaagagaactgtagaa

SEQ ID NO: 53700 - DNA, 1967 bp, Oryza sativa
tacagtagtctcatcaaatgattgcacgcgacaaagtgacacacactataagacaaaactttatttaaatcatgttgttgtcttaaatgtatttaaacagcagcagtagtggtcacagaattgtggtcagtacaaactttttgaattaacatcaagatacttgttttggtgatgggatggttgtgttgttctatgtttatttgattggaatttgccttgtctggtagttaaatccaaccacctgttcatcttatccttttggattttgaccttgcaagcctttgatgcaactaatccttttggggatcctacgcctttcaaggctgttcatgaagaaactcctgcagtttctcacacaaatgctgcacctgctggttctttccatgctactgaacctgctgcagatgcaaatcctttccagcctgcttcagcagcaagctttggttttggagacactcttggcgacctctcttttggatcgaatgctgcacccgggcagcaagatatttttgtgcccacctcatcacattcagaggtaccacctgcaaacccatctgtgcaccctgaacaggcagtcccatcttatgtctcctcccaggcacctcagcatgcagctgctggtccacaaactcatgctgctcccgcttcatttgcttctcaagcacctcccacttcatttgcttctcaagcacctcaagcaggggcaccctatcctcaggctgcctccacatttcctcattcacaagcatctcatcctgcagccactaatccatctacaatccctcagaatgttgccacaccatttgctcctttacaaatgcctcaacctgtaccatcaggccaatcaaactattttatgcaaccagttccagggactggcattaatggcatgtctggggctccttcacagaatggagcaccatcctacatcccttcacaggcttctcaatttgcagctccaacaaatctacagccctctcagccaaccttccccccacaaactgccatggcagcttcacaggcaacatcaatttctcgaggggcatctcagcctcttgcagtgccgaattcaatgccttctggtgtgaactttccattacaatcaagttcatcagctccccctgaaacaatcctttcagccttgcaagttagtcagtctgagccagtgaagaaatttgagtccaaatctacagtttgggctgatacattgagccgaggtttagtcaatctggacatctctggacgtaagtggcttctctctggctgtcttctacacttgtacttttgtacttttgtgatctgacgtaatcttatgtctgttttacagcaaaggctaatccgcacgctgatattggagttgacttcgattcaatcaatcgcaaggagaaaaggcaagaaaagaaagtctctcaagctcctgtggtatctacgatcactatgggcaaagccatgggaactggctccggcatcggtcgggcaggtgcgagtgccatggcacctccagccaacccaatgggtgcaagcaggggcattggcatgggtatgggcgctgctggttccggttacggtggtggaatgggaatgaaccggccaatgggcatgggaatgggaatgaaccaacaaatgggtatgggaatggggatgaaccaacaggccatgggaatggggatgaaccaacaggccatgggaatggggatgaaccaacaaccaatgggaatgaacatgggcatggggatgaaccagggtatgggaatgaacatgcggcctcctatgggaatgggtccaggtagtggatataatccaatgggtaccggatacggagggcagcaaccatatggtgggtacaggtgagattatactgtacaatgcgatactcagtgaggggttgagaaacagtttaagaggcgtttggattttggtcacctggattttctttatgtatgggttcttttgttttgggtgggggg

SEQ ID NO: 53701 - DNA, 19267 bp, Oryza sativa
aggttcaggtcatcaggtggcatcaaaacgtgtatgcattggcgcatgcacggtcgagaatttataagtcattttgactttgctcacgctactagcgtcctagctacaaaatctcgttgggccaaggtttccgtttcttcttttgagaatcccgcggtcaccacaagccgacgcctctaaagtcaaaactggttaaatatcgagctttgtacgccaacgagttgcagtaacctctgcgtgataatattggcttaatcacttccatcgattacctttcagcttatagccgtaaccaaaaattaaattttaaaatttagtttcgatgttgattttaggagttttcatcttagtttttttttttaattttctctgttttaaaataaaccaacctttatacatctatatcaaaattcatatataaaagtcggtttatttttggaacatatgaagtattatttgccttttaaattgctaataacatatttataaaagttttattcataaattatttttaagttgttaataagccgttagagcttataatcagcaaaagtgaaagtgattcttgtacacttatgtctcattacccaagtataagaacacaggtcagtcatccaccctagtcaaaatcaagactccgacccttgcatcatggaggcctaaagcttaacgaaatggccatggcaccattctttcggaagcagagaaaaagctccggttgagctgtatcgctagtactaccatatttgtgatgcaagtttgacctaaaaacgcagggtcccttgcttgctctggaaaaagaaatcagaagacgattgcagacggtgtttgaactcaaaaaatcaaaatgattggccctgaaaaagtctgaccacccacagttaagaggaacacaaattgttaactgttgcttgcactgaaggacattgagcagtgaattcaccaggggttttaacctacaggtttgcagcaagcgtaatcttggtaataggttgtaacagcatattctaatgactaattagtcggccaataataattccaccagatacaaatgtctgcaaaactctgaatactagtacagtgcattttgtgaggtgcaatgcacactatagaatctgaatctctagacagagcacagcattgttttcagtttttgtacagtgattcagagttgctgacatacagtacagtacagtacattgccctgggctcagaaaacgagcaggattgcttcttcggatgaactgtgcatctttgccctcaaactgcagcaaactcgattgcaatgttggcgtgaatgcatgtgcgaatgctcttggtttgtaggtgtcgcgagatccacgaatgccggtggtctctgcgtgctctaatggcgatacgacgcctctcgcttggattagctgcattctcgctgtgccccttttcctccttttcttgcttccttcgtctctccgagtgactcatcctgctttagctttaacccataataaacttgtcatctggcttgcattgcccatggtggtttaaccagggttcacgctacgtgtgttgacattttgcagatcactgcagcattgggaactgtgtcccgttattagttctatgatcactgttaattactcgtgattccggtaattaggcttgactgaagcataaatccttcagatcaaaggccatttcttgggaacttgctggttctttgtctgttccctctgttagctttgtttgcaaaatgcaaaccctttattcacatcatccaacgtgccagagttcgatcattctagtaatttgagaacaaaattttaaaaaaccacattttacagccataatcttcggatgcaaaagttggcttttgacgctgtccggcagagcgcatactatactaattaagccaatgcatgcttggttttcttagcttagttttgtctgaatatttcctgtgatgttgagagcattttgtgcagagagcatgtagctctcgcttcgttgacactcgccatcgtcgtgcctagtgttcacattcctccttcctctcactctaagcttctgacagcaccaagtgattacagtttgatttgcttcggaaccaattctgaactttgcagtgcagcatcgacggtgcccttattactagcttataaaaaggaggcacatgatgcattgcaacctagagtccagtccatgaacgatcatatctacctgcactgcattcctctgtgctcgactctcctgtatcttcctttctctgaatctctgattcatctgatgttcattcattcattcgtctgctgctgcactgcactctgatgcagtaactgctgcttattctgatcctgcaatgcttctgctgaattctgcatgtatcagctcaatctgaagagttaattacgttgtttctggcgtttcatttcctgaaggtaatagcaaacaatttctctgaacttcatagtaacatgccactaagtatctttttttttcttttttttttgttctcgtgtcttgtactagcagtcatcaggctacaactagctagctgcatatacaaataacctaaggcaagtcatatacaggttgcttgtgtgttctgaatcatgtaatccactttactgaattcttactgcatctcttagattcagagtaagtaattcatcgtgtagcttatatactcatcaagtcaaaagtagtactagtagagatttctaatacatttcatctcacacagttgatcgttgaacgcttttttttttctctctttcagttgatttcccggcacaaagtgcacactagtagagacgttgcgaaagaatttaaaccgatcgatcaggcggggtggcgcgagcgagttcccgccaccaccatgggcgtcacccgcgcgcacatcgtgaagaatgacgcactggaggggatgctgggcgagttcgtcggcggcggcaagggcggcgggaaggcggggcgcgcggcggcgaggcactcgtcgcggctggtcgcggcgctgacgtgcctccagctcgcgttcgccatctacgccaccttcctactctactacatgagccccgccgtggacctccgcgccaagccggacttcgcgtgggcgacgcgcatcgcgcagcactggaagcagctcatggcgcagcccgacggcggcggcggcggcatggcggtgtcgccggaggaggtgtgcgagcacgagagcatcgacttcgagcagaagaagtcgacggacgccgtgatgatccgcctcaagcgcgagctctacgacgaggtccgcgacttccagcgccggagcttcggcgccgagacgctgccggagctcctccggatgcgctcgcggtggagcgccgccgccgccgccgccggcaatcagccgcgggtgacggtgatcctgaaccacttcaagcggcggacgctgtgcgcgcagctggacacgctccggcggcagacggtgccgttccaccgcgcctgggtgctcgccttcgggagcccgaacgaggcggcgctccgccggatcgtcggcagctacaacgactcccgcatcagcttcgtctcctccggccacgacttcaagtactacggccgcttccagatggcgctgcagtcggagtccgacttcgtctacgtcctcgacgacgacatgatcccgggcgcccgcatgctcgagatcctcacccatgtcgccggcaccgacaagtaccgcaacgccgtgctcggcagcatcggccgcatcctccccttccgccagaaggacttcaccttcccgagctaccgcaagttccgctccaaggaggccggcctctacctccccgacccggcgtacgacatcgccgtcgaccgcatcgtgcaggtggacttcctctcgagctcgtggttcctcgccgccgacctcgtcaaggcgctcttcatcgaggtccccttcaccttcatgaccggcgaggatctccacctgagctaccagctgcagaagtacatgggcgccgggtcgttcgtgctccccgtcgacgccggcgacaaggagacgtggggggacagcgagcaccgcctcgcgtacgtggcggagacgacggtgatcttcaaggacatcgtgcaggtgcgggacgagcagtggtggcgcgcgctcacctccggctacgtcacgcagtgggcggcgatgcacccacagaaggtggacgcgctcttctacgcgcactcgctcggcgaggtccgcgcgctggcgccgctgctggagcggttccgcaccaccgccgggaggaaggcctacctcgtcgtctccggcggcggccactgcccctgcgaggaggcggcggcggtgctcaagtggcccaaggttgtgtgcaaggagaggcgcttcaagatcttcgacctcgccgtcggcgcgctctccggcccctcccactccgacgtgcccgtcctccacgccgtctactccagcatgcgcggcatcgtccgcatgcacaacccgagcgtcatcgtcgccgtcgccgacgtcgactccaagatcaaggacgccctccgcatggccgccgacgccgccgtcaaccgcaccgccctcgtcctcctcccccgcaactccatctccaaggttctctggatggccaacctccgccccacctcactgcccagtaagcttcttctacctcaaagctctaatccgccattgttgcattacatcaaagctctaaccattcgggaaagtgaattcatacctcgaggggatatcccctggtttcgtgaatacacctaaatagtcatcaaaaaatatataaaaaaaattagcaacataaattaatatgaaatatatcactccataaacacataagtttaaattcaacttctataagttataacaaaaataatagatatagttgcgaatgtgcgataactattttcagtttaatttgttatctttgttgcaatttatagaagttaaatttggtcttgcatgtttgtggaatgatatatttaatattaatctatgttatcaattttttttattttttttataacaatctagatgacatgcaaaccacgagtgtatcgagggatgaaaatccagatcctaaccaatccatggatttcacgcagactggaacaggatgcggatctcggtgaacatcatcacgcagaaccgggccaagtcgctgcggcggctgctggcgtcgctgcgggacgcctactacgtcggcgacgaggtgccgatcagcttcaacatggacagccgcgtggacgcggcgacgctgaacgtcgtcaacgccttcgactggccgcacggcggcaagacgctgcggcggaggatcatccagggcgggctgatccgcgccgtgagcgagagctggtacccggcgaccgacgacgactacggcctcctcctcgaggacgacatcgaggtctccccctactactacctctggatcaagtacgccctcctcgcctaccgctacgacccccaggtctctctccctgagctctcctccatctccctctacacgccgcgcctcgtcgaggtcgtcaaggagcggccgcgctggaacgccaccgcgttcttcggccgcagcaagaaccaccaccccaacaccccctatcttcaccagcttccctgcagctggggcgccgtcttcttccccaagcactggcgcgagttctacgcgtacatggcggcgaggttcaccgaggatgccaagcagaatccagttcagatacctcggtcccgcaccaatggctggcaggcgtcttggaagaagttcctcatcgacatgatgtacctgcgtggctacgtcgcgctctacccgaacttccccgaccagagcagcttctccaccaaccacatggagcccggcgcgcacatcagcgccaagggcaacgtcgtcaagcacgacaagagggacttcgaggtgccgctcgtcgccgacgacttctcgccgctgctccccgccgggaggatgccgccggcgtccaagctccccgtgctcaacctcttcaaccagccggtctccttcaaggcgctcaaggccgccggcgccaagctccgccaggacgtcatcggctgcgccgccacgcagctcgtcgccgtcgaccacgtcaccggcctcccaaagaactgcaccgccttctgatcccaagaaattgaaattgcatatatatattttgcattgaatttcttcgatgcatgaacacgttataaacgatctgatgacccatacgttgttttaccattcgtgatttttattcttttgctcacgatctctacactgtatttagctgtggtttacatgtctcgtttatttcggttttctttgtatcatttagcagtgaaactgaagggagttgcagagcattttcgcgctctgtacgatggtctgtaaagggctaaagatgtagccaaaagtggcttctctttgttattgttcttgattttcaccatagattcatcattcatggaaagtacgctgctacctcaataagaactgttctagttgtatagtcttcaattcctctgtttgtgtacaatgatcttcaattcacaacaggttcatgcagagtacattgatttcagagagagagagaagcaatcttgagatggttctaggacagtaaatttgtgaaggaacgacagcaatttcccaccattttgggcctagcaattctgctatgcttgatgtttcatactactacttgcttagacaggagctccagtatccaaatagcagctgatccactctctgcttttaattgtaaattttactgaatgtcataaatcttcgggtgaacaaagtacagaaacagtaggagtatgactctgctcatcgaataatcgctactagcaatccatcttgagatttcaaccgtggagaagaaatggtgagaggaattaaagatggaaaagagaaacagagcgcctcagttttagccttcaggagagtaatgccgacttgcagagagctgcatatgatttagtcgctgctcccctctcctgcccggtcgcccacgtggacgccatcggccatttaggcatttaccaatctggtgatctgccggacctcatcgccggtccgccggccgctggcgtcttcactggtcatcgccggccgcgtccgggcctcacctagtcacctcccttcggccttggaccaacagcccaacaggcaattccttcgagaaggctaattcgcgactggtggcgtgcggagaggagggcggtggacggcgcggtttctttttttttttttcggtttacagtttcctttttttttctgtttcatctttccgtatcgccctttgaatcgtaggaataaaaaaacggaggaataggaaaaatataggattctgacaggaatgtaagtgtaaaacagaggattgcaaaacacagaaaaaacataggaattatcgtttgattggaccatagttaaaatacaggaatcggatgagagagatagactcaaaggatttttaccaagaggttggacctcttgctaagtttcctctaaaaccaatatgcaacaagccattccataggaattttgtaggatttggaaaacttcaacctttgaatcaaagggctacatgggaaaatttcctgtaagatttcaatcctatgaaattccttcataattcctttgattcaaaggggccatagtattttcgccttttttaatacgtatttatagaactttgtatacatacacatacaaactttatatacgcgtatacaaactttatatacacgtatataaactttgtatatacgtatacaaagtttgtatatgtgtatattttgggtttttatccgtacgcactcaaacttagtatatgcatatacaaagtttatatacacgtatacaaagtttgtataagtgtgttttttagacttttttatacatacgaacacaaactttgtatacatatgtatatttttatacattaaagtgtgtatgtatatacaatatacatacatataaattttgtatttacgtatacaaaatttatatgtatgtatatagtatatgcatacgtatatacactagtacttcctccgtttcacaatgtaagtcattctagcatttgccatattcatattgatgttaatgaatctagataggggagtggattctaatccctcgaggggatatcccctcgtatacctttttctttcaaattcgatgtaaatagttatgaaaaaatctgaaaaaaattgacaatgtagagtataatgatacctactagtgcaccaaaattcaagttcaaatttgaactacacatcgagaaacaaaaaagacaaatttagatataaacagtacgctactattcatatgctgaatttgtcttttttatatctcgacgtgtgagttgagtttggacttaagattttgtggagttgtatatatatgttgtatgaatgttgtcaaatttttccagaatttttcataaccgtttaaatggtttttaagcaaacgaggaaacatcgcttcgagggattagaatagtttcccatctagatagatatatatgtctagattcattaccatcaatatgaatgtggcaaatactagaatgacttacattgtgaaacagagggagtatataggagaagagagactagagggggccagctgatcgcgcacgtgcgcggccgcgcgactagccgcggatcagcagccccctaatgcagaagcggattcaacgtgggtgcctgcagggggacttgagtctcactacacccacaagacctatggataccccctcagcacccttttcgattttttcaccatggatgataaaccaaaggtctctagatggctagaggttgaaaaaactgcgtaattgagcccccccaatttttttcccggatccgcccatgccccaatgccttggcctcctctcacttctcctctttttttctaattcttgatttgatttgatttgatttagtgtaagaactccaatatttctattaaaagttttgaatcactgtataactagcatgtaacatgttagccacgtagattacatggctagaattattatatttttctcacataatagcatatatattttcacattttattaataaaatatattaaatggtaacataattttaagttctgtactaacttgatcagattaacaaatgtgtaataacttaattatatttctatatagactctagattcctcttccaatattccttcttttttaatttgaagtttcgttatttataaattttattcctatatgtactctaaacccttatttcaatatttattatttttaaattccgaatttcagttatttataaattttatttctatatggactctagattcatattccttattttttttaattccgaacttttgttatttataaattatacttctatatggattctaaactctttttttcaatattccttatttttaattcttaattttagttatttctaaattgtattcatatatggtctctagactccttttccaatattccttattttaatattcctcaaccactcgcagagaactccggtgggatcgctaccacgccggtaattggaccaggtgtgtagttgtaccttgaccactcgtaaagaactcgtagaggtggtgggatcgctaccacgcaggtactcggaccaggtctctagtcataccttgatcactcgtagagaacttttagaggtggtgggatcgctaccacgctggtactcggaccaagtgtgtagtcgtacctcaactactcgtggagaactcttagaggtggtgggatcgctaccatgtggctactcagaccaggtgtgtagtcatagctcaactactcatggagaactcgtagaggtgttgggatcgctttttaaaccacgcctgtactcggaccaggtgtatagtcatacatcaaccattcgcaggagcgcttgagttgattattacatgtgcttttcatgtggccaacatgacatcacatacctaacttataagcatgtcagatgtccattcgcaatcatgccgggtgatcaagctgacaatgctcgcgaggagattgtatgtagcaaccttttcacaaataaactgggtcgtgaccggcactaaatgtgagataggccgccggtatttgttggtaggtttggtccgacaagtccacgtttgttcgagaacgttctcgacaacggggtgtaatcgacctctggctattagagtgctcgatcattcctaaaaaatattttctataagacaaaatatatagcatagaaagctgagtacatactcagaaaattgtataaatcttctagtattgcaacatatataacatagaaagccgagtacatactcagaaaattgtataaatcttctagtattgtcaggatgtaatgagcatatttggattaagaatcgggtattatgtataccgtaaacaagcgtcatatatacaaaaagaatagagtaagccctcagtattaaatggtaatcggcctaatatagggagcatttgcacaatagatattgtataaaaatatgttatatgtaaacataataaattattgatatgaaaataggtatggtaaattgtatatataaaatattatgtatctttgtagatatatgccgaatatatatttgaaatttttagattaattgaaatcaattagtctactaattacctttttggacacatactacagtctacaggtaatatgcgtgtctgtctcctggatgtccatgtgcacgtttctggtaagtgaccaccaaacaagcacgttggttttgtcctttaccgaataggtgcatggatcgggtcatacggtgtattcgcagttacagtagtagactcgtaggtatgtgtcgacagagtagattgtgattacggtatttgcatgatatgagtatcgttcgtgctaacgtagaagcgaaattgagataaaagagatatagacaagtatttttatataggtttgggctccttgattgtcaggtaatagctctactcctgtcgatcgaagccggtgttgctcttattcatcaggatcatatgagcacaatatttgggtctaacctacctagtcgtcgtcgacgtggcagcatggaacaccacatgtagtagacgacagggtagtcttcttacttgaatattaactagacgaggttagaggatagctctagatccctcatgtcggcctctgtgactccagattgggtctatctaggcatgtccctcatgtttgtgtttgttggcatatttttgtgtgtgttttctcttcttctaggggatcttgtatttatacccacgaatatcccttttttcaagtagaactaggaagatacatatggatatgatccgaataatccttgtagtttccaacttgaagtagtttccttccttatctagaacacctttcgtatatgaggtatgatttggtataagactagttatatggtgggcctcaccgagaccaatccaagatcattaagcatgccttatccataacacacaatatgcattagttgttgtcgtgttcgacttgatgatagatgggaggatgcaagcgcacgacaagtttgcaggggagatcaacatagtactctgtactcgactctgattgctcgagagtgccgatgtccgtccaatgtgaagggcagtcttcccgaggtttaggttgttgagtcttggtttgcgttgatttgaaagtaatcagcccgggtgaactcttgtggtcgacgatatcgaaccgttgttagtcaatcttggtagatggaaattgttggtggcgacgttatctagtcgggtcatatttcccagagcccaagccgttgaagtatctctcgtcgaaaaaaccacactagcaatgtcttgacaaagtttaagacaacgaggatcccgctccattgaagagaacgcgctccgattgggtcgtatctcctaaagccgaagtcatcagaaagttcgccacttgaaacccatctcgtcaaaaacttgaagcaccaagtcccctacctagtgctccactatcgagggtggatatcccgaccacagtatttatacagtatggatatccctacctggtgttaggttatacgtgagattgaggtaaaagagacgggagacagatattttcatacaggtttgggtcccttaactaaccggtaatagccttactcatattggccaaaaccagtgttgcctttatatataaatatcatacgagtacactatttgggatgatttaatctagtctttgtcggcttggcggcatggagctctcacacgtaggcgacggctggtgtagtattcgttctcggatctcgaatatgaactcggcgagattggaggtagcgctagatccctcatgtcgacctttgtggctccaaattgggtttgtctaggcttgccttccattggtctagatttgtattggcttctgttggcgtgtccccctcctcctaggggtcttgtatttatactctcggatgtctccttgtccaagtaaaactagggagataagtatgtatatgatccttgtccaaatagaactaggaagataagtatatatacgatccgagtaatccttaagtgcccgagtagaagtttgttttttcttctttatccggaacaccttccgtatatgaagcataattccgtataagatttagtatatggtgggccccgccaaccccaacctaagattattgagtatgcattatctataacactcattcctagaggctagatggaggaggctgccccccagtaccacgtggccctccccaaggggagtcaggcccgaggtggggcggcagccactccttcttagagactagatggaggaggctgccccccaataccacgtggccctcccccaaggggagtcaggtccgaagtgggacggcggtcaccccctcatgtgactaggggtcgggctcccccgaccccctcagcaggtcgccacgtgcggtgggttaggtggccaccttcgagcgctcacctacccacattaatggtgacctgagcagacgcgccacgccgcatttaatgtggcgtgcaccgcgcgctaatttggtctgtgactggtcgaatgaccgacaggacccggggtgtcaggcgtactattgcatgggtcagggggcgtgcaccctgtcttgtcccatcagtcatgatgacgagaggtcttaacctctcatcctggccagagttggtccgtccgccctggtcaattggggattccgtttcccggcgcaaatagggacccagaagtctccacccattaatagcagctgacatgggcgcccctcgtgtcaggcagcaagatttgacaggccccatcatcaagatgacgtgcgcttgcttcccaagtcaagagacaaacaggcatttaatgcaaaacacttctccaccggagctaggtttttgggcccatgtggtaaccccttgagatataaaaggaggtccaggcctagaaaaagggaggagggatcgaggacgatccattggacactctagagcagtctctagccacggatgatcaacaccacattttactccaacaaagagatcttataatccttcactcaaggagcatagcacaggagtagggtattacgcttcttagcggcccgaacctatataaatccttttggtctcatcatctttgaggggctcgaccccctcaacacaaacactgcttcgctcaccgaatcctcaaatctcacccgctgcctccggctgaacttacaaaggagggtctcatgaccttccgctagagaggatcactcctcgacaaaaccaactagcaatttctcctctagatgggttcaatccagcaccagatacacaatgcaacatgaaatccgagccaagttggttgaaatatagggattgcgaagaacaagaaaacaacaggtcaactggtacctgggtagaggattatatacgccggcggtagctcagccacatcgtagccggcctcctccacaacttgaagccacaccaacgaattggattcgcgcagatcggcacagccgggcgatcgatcggcggactagaggcgatctatcgtatcgtaggacgtccgacgctatcgatgagatcaataggcccaataggcccattgccgtgaggcacccgcacctctttgctcagtttgtgcgagttttctttgttctgttttggccatgaactcttcaagtttgtctaattctgatcctctacttctaaaccgtttaatgatgagcaatgaacgatgggagaaagaaacagagcgactctgtttctagtcttcaggtcagaaggagagtaaggcagatttgcagagagttgaacatgatattgcgaattgtgacgggctgatgatgtacttagtacattttcatggacatggcaggcccaagttttattaccactagcagccgaacaatatctaaagaggatttgattcgttattgtattcatgactcctcttaaatctactgtagtttcttctcaagcagttgagccccgtgaaaaatcactcatactaaggtggagtactagaacacaagatgaagatttgaatgttcatcatccgcacacggtacatctatggtgtggctgtgggtagtaagacgataaataatctccattctgaaccctcgtttgtcagaattagtttgcattatgttctttcttttgtctttatattattgtactgatccggcacaacagtagatttcccattcataatctgcacgacagtacagcaatgttcaagtgcccactggtccagcacattattaggtgcccaactgcccagcagaagccgcaaattgagttgtcagtaatcagcagtagcgcatagttataccagaggtagccagatcacaagaagaaagaaaaagttcagagcataaaggaatatatctcctcaaattggatgatcacaacttgtacagagggaggcaccaccaaccaacaaggcaggagaaacagaaaaaaggcatatagagatatataattaattgctacaaagtaattgctagtatagaaaccaaataacacttatcaatccctagacatagatgaactgcaaaaagaatttttcggagttcagtacatcaagctccaatataaactatgatggatgtcccccctgagtagctactagcaagaagaaacttctaattagcaaaccaacaaactccacttcctcatcaccccccttaaaaaaaacacatctcattttcctcctcctaattgactgactgactagctgcaaagttttcctctctaaatctgtctccctctgctgctggtttagctctccttctcacctacctaattttgcaagcaactgcaaatctgcaatgcaacaaccactgtgattcatctatttctcctgccctcctcctctctctctctctcacccacctctatacaaaacaaaaaatcatctttttaaggggaaccaattaatcaatagacaaaaaggaaaaaaataaaaccccaagaaaagccctagtgaactaacgccagtatgaccccggcgatcgatccatggattgatgatgatgctgatgctgatgctgatggaaaccaatgcagagcgggtggtgatcgatgatggatgatggcttcaggagggcaatgctgctgatgatcacactgctgtccatgtccatgtccatggtgatggtgatgacgaggaagacgacgcactgacgactgaagcaagcatgcatgcatacatactaacatgtatacatatatagctaagggggactgagaccgacgaccaaccgtcctccgacgacgccgccgccgccgccgggagattaatcccggcggcggatgtactgcaggaggtcgcaggacgggtcggcggtccgggttgccttctggcgcatctccaccaccttcttgtgggagttggaatggatggacggcatgaaggtggggctcgccgccgggcggtactccgggaagaggcggccggacttgtagcggacgccgcacgcgttgcagagcgtcttggggccgagcgggcccgcgcgccactgcggcgtcttctcgatctggcaatgcgtgcaccgccgcacggtgcccggcgggagcgcgagcgcgccgccttcctcgtagtcggcgtccgccgcgtcggcgtcggcctcggcgtcagaggcggcggccggagcggccggcttcttggccttcttcttcttcttcatcggcggcgggtgcgggttggactcggcaatgctctcgggatccgagtgcgacgaggtggacgagtacattggcgtcggcaccaggatggtggtctccgtcgccgccggcgcgccgcggacagccgggaacgcggacggcctagaccgtttgctgcgcgcgcgcgccgggatgacgagcacgggcggctccgggcgcggcgacacgggcgcggaccacgcgcggccgctgccggagaacgactccgacgaggaggacgccgacgaggaggacgacgaggaggagcccccattggttgccacgttgaagccgctgtgctccagcacggagatggggctggagctgcggaacagcgcctcctccgccttgtccggcagcacgacgccggcgttcgccgtcagcgccgacgccttgatcggcgccgcgcagttgacgcccggaaaactcggctcgtgcgggatggttccatcgtcgaacagccccgacagccactccagctgcgccatgtccatgtccagctcatcacactgcaaacgacaaccattgccacgtcagatcagtcacatttcctctacagctgcattgcagcagcctgctaattttgtcgttactagctgttcatgttcatggtcagtagtactactgctagtaccaccatgacatcataatttcttccatccactactactgtgtaaatctactgtaaatcaatcatcattagcggttggaggaaggggcccaggtttaatttcggttgcttaaagcggagaaaagggttactgctatgctaggactgtttgtaccacgttgggtttagtactagcatagtatagttgttgggcaggctaactacccaaagtaaatgggccccaaaaaggccgaaaccgccgtaaaaatccaaccaaacggaagcaaaaaactcccatcacgatggcacgccgacgcccgtccaccgacacggccatcgcctgacccaactaccccattcacacacgacgcgcgcgccgcgtggcgtggagcgggcgccaacgcctaattggcgcccagctgttttgaacttgaaccgctcgaccgacgccgacgccgacgccgacgccggcagcggcaatatcgtccgaattcctctaaatcggccgtacgctcaaccacggggaggtggtgggggagggggaacttaccgggccaatgtgggcgtccttgcggtcgaacacctcggcgccgagcgcgccggccgcgtcgaacagcgccgacgcgtcgtccttcgcgggggccggcggcggggggagcgccatcatctgcggcggcggtggcggcgccgccgccatggtggcgtggccgccgatgatgcgcgaggacagcgggctccctggcgccggcgcgtcgagcaggagcacgtcggcggccgactcctccttggggaagtcgagcaggtcgtcgatgtggtcgaagaggtcgccgcaggtcgcctccaggaggctctgctcccgcagcatgtcctccacgaatccaacgcccgccattgctgctgctaccaaatcacaatctgttcaccgtataaatacagaggggagagaatgaagaaacgcgtgtcaataatgcctcatctcgagatcaatgtttggatatgcatgcattaaacaaggcagtatccacaataataagaaagcaaattaaagcaacacggatttattcacctatgataaaattaatcaattccaaggatatgatccacctatatcaataataagataaaattcgtataaatggttacacaacacaccactgccagaaatggatagatgacgaggcgttactaatctatccctactactaccagaagaagtgcaaatctatctctctgagctgtaaatcaaaagctgcaggagggagatttttttttcttctctttcaaagtgacggcaggagcgggctccatatgtatgcggtgcatgatgacgcgcttccgtgggtgggccccacccacccccagccatgtgaccccgcatgtgacgggtgaattttcttttctttattctgaagcaaggctatacaatacagatggcgtactactctacccagggaagaaaattaatatacactcactccgtatataaaataaaaataataaaaaaataataaaagtaaaaaagaaagaaaaaatctgggcgtttgtttgattgattcaccaccaaggactccatccctatgcgtacgagtagtaaaagtcaaagcttgccagcacaaggaatttgtcaaaagggcggggggattagctgacgtggaggcgccctattggtccggacgcgtcactggcgtgccactggacaaagcagccgcctccctcggtaaaagcagctaattattgccgagtcctcgggtgaaaacaccgaggaattcatcaaatttttttctcgcatcaatcgcggccattcccacaggaggagggagcagtacggatcatgcaaaggcgaatcttgccatggcggcaatggaaggaatctttttggttttttttttccctttttgttgttgtttttactgcttgcttgccggcgtattgcctctcagaatttgcacattttttctcactgtccccaaatgtttccagataatccagactgtaaaaaaaagtactacaaaatcagggggacgcggttgaaaaagcttggaataatagcagtagtaccgacgtgtgaaccctgataatcccatccaatttttccatgactttctatccatctagtagccggaagcttccctttagtaattttactctcgatttttttgaattgatttgaaaattttgaaatcttcaaattgagaaagagtccaaatcggaggcttccgagtttcgtcatcctcctatattcctcccctttcgtcttccttccggggaagatgaatgaagcaatgaacgtgcaaaaaaacacgcatggcaatgaattaagctggcgacgcggcgaaatacggccgcgcgccaccgggaagccaacttaaaatgcaaagcccctttgaattcccgatcatttcttgccatttttttgaatttgaagaaagcggcggcggctgattttgcgggggggggggggggggg

SEQ ID NO: 53702 - DNA, 4355 bp, Oryza sativa
  unsure (1)..(4355): unsure at all n locations
ggagagagaaatgggaaagaacacatcacatgcagcaggagcagctaggctttcagctcacctgtgtgggaaaattgtctctgtttcctcgcaccgatcgatcaacacctgctcgatcgctctcctcgatcagcttttgcttgccttgccaaaaaaaattgtctctgctacctcttgttgcactctaactagctgctgttgccgatcaagaagctggctatctgaatgcgtttgtttatgtaagtagggagcagctgcgaactaactctatatatctagtacaccttctgcatggacatggttgctccagaggaggaaaaggatgagcagattatgataggaggaagaagaagaaagttgctgcctgccttgcaccactgcaattatatggagagcacttcactgtactcctaaggcagagagatggcgcaattccggagtgctatataggtggaggtaaatggaagaacggaaggagggggatggagaaaaaaggatgcgtgcgtgggtcggtggaattcaattctagagctataagaggaggtgtatgtagtactactagtatatgtatatactgggggaggagttaagctgcaggcagagctcaaaaaaaatttcaaaaataataaaaatggaggattaaatatgggtgtgagaacgtgagggaaggtaagaaaccagcacagctttcaggctttcagctgggacttgagaggagacgaaaccaaaaaaaaaaaaaaaaagtggtatctgcttgctgggctatggctcctgggttttgaacgttggaggctagctaagctatggcggagtggagatccactcccactcctcgttcccttttacactggtgctcgcacacgacctgcacggcacacgcggatgggaggaagaaaaaaggagacgatgcgtcgagctggaacggcacgaaagagacgaccagagagaggcgcccttctacagctaagcttccgtccgtcagtcactcactgcctcgtgaggacccagcaacaactagtactactactgctgctactatgcatgccatttactgggtctgggacgactacttctcccacgattattacgattacggtcacgattagcagtgtggtaaatgggttgtttaaccatccatgacgtaaaaaaaatcaaaatcaaatcagcgtggtaattaggatcgttgagcaaccacaattgcttgctggtagtaagtgctacagtacagggagatggggacggtaggtgagccttcctccctcactgctagctgtcctcgcccctgtcgtgacgttgaagtttcctccctctttctctctcctcacatccctctttttttcccctctcccagttaaccaaaaaaacccagaaaatacaaaatgctaaaatcaccagctcagattttttttctctccctcctgtatgtacacatggcgctgggttatcacacatggatgggcatgagatgccagctgctgtcacgacggtcacgactttcctcccccttgcctccgccgctcgctccttcacactgtttaaccgacagccaccgctcccgggcatcggtcgtcggatcctctgcggccactggtaaaatcctcgcacgccagaccggtcgtctcgtcgcagctactagcgtccagccgtgtcgcggttagcgcgcgcctccacggaagcatcccgcggtcgccgccgcaccgcggccgcgcattgaccgcgcggaggccgcgtcgtcttgcttcgcttgcagctgggtgagaacggtcagaaacaattggaatcggtagcatctcttataaaacaatattagattaatcggtaattaattatatttattatttaaattactcagtgtcaatagatacagcaaaaaaattagaaaaaaaaatttaaaaatagccaaaacgataccattttggaaacggcgctccgtccatcagttgatcggcagccgtatggacgcggactcgcgagccgcgcggcgcagggtgcgtagccgcatgcgacttggagaccgcgacggcgatgtgggggggcaagttgggcaacgagacagacgctgcggaattgcctcttgattgagaaggacgcgaacccgattcaaaaattttctttctcggtccaaaggactcgtggggttgtaaattcaaaacttatctaactcgatcgtcgattgcatatccgttcggttttgttttttttctatgtgcctacttgttggcgttctagggtcagcgtacgtatgctctctcgcctaacacttttttgagtgttctggtatattgcccaacccatggaggatatgtgcgcacgaacgacagtgcagttaatccactgtctctgtcaaattaatcccttcggtcgatagatatttaccgaacttaattactgccgtgcccatgttacgacttactaggatatatacatgacgtatacgcacatatataggacgtaatagtagtagtagttgatcctttgatccctgatgcattactactagattaatcttatcctgccaatcgatcgatctgcatgcatgcatgcagctggtgttggtggtagcaaagcacacctgcacatgaacgatcgcatctggatcgagcagcagtagtggccaggtcgggtcactcactcactcactcgacctacctacttctctctactactacctcctgcgtgtgtgcacacacacagccacgaatacaaacgaacgaacttggtttcgttcgtgcatgcaggtggatgggatgccatcggggactactactacacccgtctaaaattaggatatctttttgagtttttacttataacatttgactattcttcttatttaaaatattagtgtaaattaaaaaatcatatttaaagtacttttggtaataaattaagtcgcaaatttaaaaataataattctatatattttttaatatgatgaatggttgaacgttaaaaattttttaaaacgataagtatattgaaacagagaagtactgatcacacaaatcaacaacaagagttgtcctgcacaggcagcacagcatgcaagcacagctgcgccacatgtgacttaacgaccatcgtggttggggttgggaaaaaaatcgcacggaaaaaatggcgattaattgctggaaacgggagaacggagaagaggggggtgcgtggtgatggaaaaggggagcaacggaaagggaaggaagagtaaagtgaccgcacaaccgatggttgttcgggcctcactgcccccagcaaatcatatgacgggtcccactccactacgctactgatcaacctcttttcttttcttttttttctcatatcatcttctttctttgcataactaacttgggttgcactccttgcatccattccttgagctttactactccccaactcactctcactctctaccccgatcacacctaaacccattggccacgccagcaccaaagcctgttccacgtgtacgacagtcggattcgtaatgcttggcttcatctttttagtgtaaaactcgatacggtatcagagtcaatttgacgaaaacgtaaacccactttcaatcaggtgaacantaagtcatatcgtcaatgaatgtttaaacttttcatatatatatatagggatctggaggatgaagcatgcatcattttattttataaaaaaaatatttaaagcgtacaacttgatgggaaggaattgaaaaggtattaaccattttgcggtgacataattcatatgtgtgtgtttttttcagtggttgttgcggttgccactgccgttttcgcgaggcataattcgagcctaatgatgccgactttttcctcgatcgcgcgctgcggacgcagcagaaagaaattcgtgcgcggcatgtctttgcttgtttgccaccgacggggccgagcgacctctgccagacaaatgggtggcatattatactagcaaaggaggtcgacactgaagagttgatcgagtgagttaacatcactcgtcaccaacccgtatatatacgttgtcaaatcaatcggccgggcaactcaaattttatgtcaatctttgttaacatatttttaaaattattaaacggtgtgtttgattaaaaaaattatataaaaattgttttaaaatactaaataaattcatcgttcaagtttgcagtaactaaaacttaattaatcttaaccgtgcagttgtatggttttcgggtctggtttttcttctaaagtggaccgattctcttcttctaaatataaaagtggaacaaagttccgccagtggtttaaaaaaacttaattaatcatacgttaatatatttttaattttaggattgctaatttgatctttatctttat

SEQ ID NO: 53703 - DNA, 6665 bp, Oryza sativa
cagtagtccatgcaattgtatttctatatggactctactctcctcttctgatattccttattttttaattccaaaagtcaagtatttgtaaattgtatttctatatggactctagtcccctcttctaatattccttatttttaattccgaatttcagctatttgtaaattgtatttctatatggactctgttttttctttttctccgattaatgtgagaatttctaggccatgagagcgaacgtggaggctcctttttctattcctttaatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttatttttaattccgaatttcagctatttgtaaattgtatttctatatggactctgttttttctttttctccgattaatgtgagaatttctaggccatgagagcgaacgtggaggctcctttttctattcctttaattatataatagataatactttaccactatttaccgataaatattagcacacttacttaaagttgaaacgattaaattttttcacaccttaacaagcataaggaaatcttaccatatttataagtcaatggcgtgcgagatttagtttgctggaaaaaaaatattgccatgactgtatctataaacaaacaactgctaatgtgatcaaacccgtctaaccttagacgtgacaaaactgtggtaaaacgtggctgacaacctaagggcatccacaatgtagtctaaaactagtccataagcaataaaatatttcattcagctacctcaccatattgtggaactagtccatagcaagaaaatagcaaaagctacctataagctataagcatatgtgttgctcatatagaataaaatatgttatttgtctctattttctctctcctcctaatactagttgctatctatatacattgataataatagttatagtctatatatgtgggtcccatttatatggactacttttgctatatgcattgttgttgccgtaagcacaacctactgctgtattgttgcgtaacgcgtacagcaaagcgcaagtggagaccatgcatcgatgcagagatgcatgcagctagcccatgtcgagaaacaggataaagaaaaggggaattgcgagatggcaaacgcccaaaacgggcagcttgttgcctggagaggaagagtgctggagagtagtagagcattgagcattgcagaacgtgggtgcaagtacaagcccactttacttttaagtttttttttttttaccaacgctgcatgttacccctcatggatggatgataatgccctttctggtttcatcagtacaatgtacagtacagtactagctctagtttgggatgatcacctactttatttgttcagcacccgtagtagttgtataatctatgctactagttgtatccaatgcccatccattcaagtgatggcatccaaataatacaatagcgagaacctatcatccaacaaataagcgaaacgacatatttaccaacgacaaataatttataaataaaacttttatatacgtgttcctaacgatataaaagcaaaggctaaaaaataaagttcgagatataaaagcaaaggctaaaaaaataaactttgattaaaaaactcaaattcaactccaaatttaatattgagaattcaaagctgataaatataagtataagtgtgaggccgtagtataatctaatctaatctaatcaacctgtttgttctctcactgcagttgggtcccacaacacagcaagggcgagtgagtgagcgagtggtgcggcggcacgcagcgacgacgaaccaggaaacgaagcaacgcaacggtggacagctcacgcgcggtggggggcagcgtggtcggcggcacgtgacaccccccgcccgcggcttggcttgtcgtgaacccagccagccatgtgagtagtgatcaccgggggctctacgccgtcgattccgaatccgatgggcgtgatcagacggcagagagaggggaggaggggggcaattcagcgcggggatcacgcatgcgttcacgcgtcggtgtctgtttggattctgaacaagaagaacaacagtgggtcgattttcagtgacgcgctgctgggttgtgaagtcgacaaatgaggttcctcctctctatcgtactccagccgttccataaaaaaatctagaattagatgtttgattcataatattaatatgtgttacattcggtgatagtacatctattatctcgatgctgctagctacgagtactagtttcatactgaaattttctctttaaaaattgttccattctaaaccaacctctttacactgtaataataattagtttatttatttttactctgaagtaggttataaaaagaaatagattattcattaatttataaatttcagctgtggggtctttaataattaatattgatagcgagtcggttaacaaattcagcatggttaacaaatttcatcttcagaacatactgtttatttgccaaatcagctctggatgttggtatagcaatctgacgataaacccaccttttttctgaaccatgatgaaccgatccaaccagctgacctgacatcagtttcatagtgaggtcctacaacatcccggtctgttcatcaatgagcagttcccaatttgacagcatgtagccaagctactgctaccagtactgtcctcttcgtaagtctttccaccatttttaatggctgacgacggtggtaaaatatattttaccactagtacttaagatagtagtgattcattggattccaaaagaaaaataaacggtttgaatcaatttatgttaccaatagagaacattatagttgtcggtaagaaattcccatgcatctaccaacctcatcttttctcttatgcatatacttatcagttaaaatttaaattttcaaccttaaatttatagttgattttaggattttttttattgaagtttatctttcagcctttgcttttagatcgctaagaacacatatataaaagttttattcttaaattatctttgtttgtaaatatgttgtcaaacaatggggccgtatatactccctctgtcccattataagtacagccataagtttccgtgcctaatgttcaaccgtccgtcttatttgaaaattatgaaaaaaatttaaaagttaagtcacgcataaaatactatttatattttaccatctaataacaataaaaatactaatcataaaaatatttcaaataagaagaatgatcaaagttaggtgctaaaaccctgtcacgccccgaactagtcccgaccagcactagcccgtgacgctccaaattaacctgttaatcgataccagtcccaggaaacagtgctgatatcacagggagacagaatatcacagcaacagaggtctctttattatagagtagatgtacagtcatgttgggctgcggacagatcccgagctcacaactgcatcacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaagtaagtgtttaatgcaggcttcaaggaaaggctggtgtttttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggccaacaacttttcaaacggccacccgggccaacaacttttcaaacggccacccgggcctagctgatcccatcagctgcagatttttcaaacaccgaaccccttttcacacagcaatttcacaagcagtagtcaaaccaaactacgctaggaatcacctcacatccgcccatgaccgtgggcacggctattcgaacagtttgttaacctctgcagagggggtacactttacccacatgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaaatgcaagagcaggaaaccgtacacccggtacgttccccgatccgcggttttggaaaattcatttagttcgcaagcaccgacccaggtgtcgggttttccaagtcttttgtaaaactccagttttacccaagttgttaaacagattttaagtttgaaggcgtccgtcgatactcgcacagggtgcacgaatatcgagacgcaactagatggttacaaggggacaagatatagcaattaacaaaggaaggatcaaatgcgacaaattaggtaggtccgccaatctgccttgcagacgggacaaacagattaagtgcgatcctatcaatgcataatattttgcaagggatataattaaatttcaaatataggctcaagatattcaaaggtggcttgccttgctcgagatctggagcttgatcctcaaaatcctcgcactgcgggtcttcgggctccgaaactacacgcaaaacgaggacaactcaacaaacggcaaaaataaagccctattaatgacctctaagcgtgcaattagatagatctcgagatttgacaaattttggaagttgaacggagtctaacggatttactgttgggaagatattgaatttctaagattattggatttttgatctaaaggaaaaaggattaaattaaatcctttttgaaaaagaaaagaaagagggaggagaagtagacttccctcgggcggctagggcgtggcccgagagaagaagcgcggctcggccgagctaatgggccggccggcccaagaggacccggcccagagcgcgcgcgggaggggagaaaagagggggccggtggaccgggctcaccacgcgcggtcccgggtgggacccgcttgtcagcggctcggctcaccgtgcggagggagtacgcggctcatgcgcgcgggcggggaagggacgcggtgcacgcgcgcgaacgcgagagccgcgccatgcgcccctccgcttctcccccgctcagctccgctccgcctcgctcgcgcgccgcgcgctctagcgcgtaagccgcccgcgccgagccaagtccaaacccacaactgtatttattttgcgacggagggtgtatctccttagaggatcacatccagacttttgctgcgcaatgagcgcagcaacatgagcaagcaaatgtcaactccttttttccacaggtcttcgactagcacaatcgacatgagtacatacattgacacaaagtgaatgacaggtggagctatcatattcttcatacacgctggcgaggggggcccacacgacagtggcagcaaagctagtgcaggagcattggcttgcaaggaaggaaacaaagagaaaaaagacaggggagagagacgcagaagaattccttgaaagcacactatactatcatccaatcgatcgatcgattgatcaggtgatgggctacccatatgcacatcacagttcctgtacacagtacatcccccctttctgtttctctcagcatataattgtttcagtttgtatgggccaccaaataataattcctctttgttttatactagctgggaattttcaggccactgatcacagtgttcagtacaccaccctgatcaacagtttaggaacaaaacatactcattagagtaatttgaaacacaagaacgccaaaaaatgattgtttatgaaaaccgattaattaattgaaaccctgattacttatgtgtatacttatttcatcagcagacagaatgttgacatatgaactgcaatgtgcgatgatgaacta

SEQ ID NO: 53704 - DNA, 4647 bp, Oryza sativa
caaaaagagttgacatggcttctctcaaaacaagctttggtgcctcaattccaaaatttcaacaaaatattttttgcacaactattgtatttggatcagctgtccagttccatgtatttgtttagaaaacaaaaaagatagtgatcatatgatgctatgaattgaattagtgatttgactgttccttttttattagagggtaagttgacgaagtattcttaaagtggtctgatggatccctgcctattcttgaatgaatatttaattatatgctgtcatttctcatttagttactttcaactaatactacgtgcacattcactttttcttctagtctagtattccacgcggcaaagcaacgtgtactttctagtcaaccaaggcctagtttagctgaggaaaattgttaggtttggttctcacattgaatatacggacacacatttaaagtattaaacgtagttcaataacaaaacaaattatatatttcgtcagaaaactgcgagacgaatttattaagcctaattaatccattattagcaaatgtttactgtagcaccacattgttaaatcatgacgcaattaggcttaaaagattcgtctcgcaatttaaacgcaatctgtgtaattattttttttctacatttaatattctatacatgtattcaaacatttgatgtgacagcataaaaatttttgttttaacagcgtaagttttttttgctttgggaactaaacacagcgcgccctctaagaaaagaacacgtcgccgcgtgttctttcagtcaactcctaatacacgacgcagcttccatgacacatcctcctgatcttggcatatttgccctccaaaaaacgaaggaaggaagcttgtgcgcgatctatttatatggatatcaagcccggccggcatgtaaaagcaagacggcaagaagaacaacacgaaggcgattatacatgttagaaatggctaccactagtacactgcatcaggcggttgcctacttattagccgtcatgctcgtctgcttggcgccggtgacaccggcatcggctcagccatggccgggctgccccgacaagtgcgggaacatcagcatctcctaccccttcggcattggcgccggctgcgcccgggacaaagacttccagctcgagtgcgacggcaacactccgcacttcaactacctggatgatcgtgagaaaaagctggtgagcctttccatcgccgacggcgaggtccgggtcttcgtcgacgcgggaagcaactgccacgacgaccgcttcaaagcaatcagtgggcactaccgcacgccggactacggccgcagcatcgcctaccggttctccacagcgaggaaccgccttgtcgtgctcgggtgccccgtccttggctacttggttgacgccgacgataactacgtcactggctgcacatccacgtgccggcggtcgcagtcgcagggtgacttgccgggccagtgcaccggcgagtcggggtgctgccagaacaccatgccccgcgctctcaacgtctacaagccttacatactcacgttgaataagacagaggaaccaacgcgaaacgtccccgaccaacaggagctcccgccgacggaacccgtcttccgccatctcgactcaacaaaatgccagtatgtgttcgtggcggaggacaagtggatcaacaccacctacagctatcgcgccttcatcaaccgaaccagcgacttcaccgtccccgtcgtgctcgactgggccatccggaacgccggcaactgcgacatcgccgtgcgcaacaggacggactacgcgtgccggagcgcgcacagcgagtgcttcaacgccagcgacggccaggggtaccggtgcaggtgctccaagggctacgagggcaacccctacctcgacggtggatgcaaaggtgggtgcctaaaacgcaaatggagtaataatctttctgacaaaaaaaaattaagtgatgaatatgttttgctttgccaacgctagacatcgatgaatgccaacgcacaaaggaatacccatgcttcggaaaatgcacaaacacaatcggaagctacacctgcgaatgccgaccggggactagtggaaatgcaacccaggagaatggatgcctcccaacggacaagttcacgttagctctgaaagtcgttacaggtattcaatcggccggttatcaagcaacattattaatgcacttattttcttgtcgggaactaatgaatatcattggcataccatgttcaggggtcagcgtcggtgtgttcctgttactgttcatgttgttctggctctacctggggctccaaaagaggaagctcatcagaacgaagcaaagattctttgagcagaacggtggcgtgcttctccagcaacagatgagttcctatggtggcaccagcggcggagcgggtgggttcaagattttctccaaggaagagctcgagaaggccaccaacagctttgccgccgaccgtgttcttggccgcggtggctacggcatcgtctacaaaggcgtcctggaggacaacatggtggtggccatcaagaagtcaaagatgatagaggaggcacagaccaaggaatttgcgaaggagatgtgcatcctctcccagatcaaccacaagaacgtcgtcaagttgctcggttgttgtcttgaagtcgaagttcccatgctagtttatgagtttgtctcaaacggcaccctcgaccactacatccatggcagcactctcaacactgtcatatccttggactctcgtcttcggatagcggcagagtcagcagaggcactctcctacatgcattcttcagcctcaccacccatcctccacggagatgtcaagacggcaaatatcctccttgatgacaaactcaccgcaaaagtttcagattttgggacatcaaaactggtgcctaatgatgagttcgagattgcaactctggtgcaagggacatgtgggtacctagaccctgagtacctcatgacatgtcagctgactaacaagagtgatgtgtacagttttggtgttgtcctcctggagcttctaaccaggaagaaggcactctacttcggcggatcagaggaagacaggagcctcgtgtcttgcttcatgacggctgtgagagatggccgccatgaggaacttattgacagccaggtgaggaatgagatgacagaggaggtgctccaagagattacacacctcgtgatgcgatgtgtgagcatgagtggtgaggaacgaccgatgatgaaggaggtcgctgagaagctggagatgctgaggagataccagctacacccttgggataaaggtgatgccaatccggaggagaagcagagcttgcttgacatggaacagagaaatgtggatcagaagttcagacaccaccatgactatgatcctgaaaatccagcttgcagatcctagtatttgtgccattcgggtatgacctgtgttttggggtagaaataaaatagacatattgttaccttgaatgtgcgttggtactaatcatcactatgctttctccaaaacacactcaggaaatattgctgtctctccgttgtccattcagttgcaagaaatcaacctatcagaatagaactttcagtcacaataacgttgtgaaataaccccaataaactggtggatcgcacaatcgcactggttttatttttgtcataattcttcttgtggtgttgtcataattgtctctatagcaaaataacattcgattaaggtctttatagcaagagacaaaatcaaaatttaaaattaacatgtactttacatactactagaatggaatgtttacttagctagattacatgtcgctaaacaactggacttacaggattgtttatgggcaaaaactgtgccttgtatttagatagctgatgatgtaccatgcagtccccagagaaatgcatcattcacagcttcctaataacggaataagcctcccaatgtaggtcgtagcactcagcatcccatgataaaacttttgacatcgcatccttaatacgccaatcccactgggaagggttgttcttctgcacattcaagaagcaaaaaatttgatatagcttattcggggaggctattttagcttcctataagccttctttcttgcagatttggcatgtcctaatgattcaacagcttccaaaggataagtgttaactaagtagtgtcctagagattgtgaacttacaatgccatcgagagcttgagaaagggacatgtccccatatgttgagatgatgtactgagagagggctgtgctagggtagtcatgccactcagtttgcctggttacaagtaaatttaaacacagtgccataagtacacataaacacatatttgccacttcttagtaaacttgacaacacataattgccaattggcacatcaaacatctataaaatattttgcagttttcacctggatccattactgggaaagtttatctgtactggtgcagatccatattttaatgctctaatctgcccacaaagataagagtcgccttgctatgagacaaagtagtgagattgcaacttgtaagctaactttcattgcagaattaatttcattttcatgtgtcaaaaatcagaatata

SEQ ID NO: 53705 - DNA, 12509 bp, Oryza sativa
  unsure (1)..(12509): unsure at all n locations
aatatcctggtatggagtagtatcggagtattagccgatacatgctagatttatctgatcggctatgctataaacatatatagtcctgttattgatatatatttcgatctaagtgatttatactgtctcggcatgatgaccgatctatcccaatcacttgatttaagtatacatcgatataaggagtatatatcattaatatctacagccgatcgagtagatttagttcttttttacttattcatgaccgccgatcgatacacagatgacatcggctcaaagataaatgatatgtcatcggcatctagccgattggctatcatttatagatttaaccacggcttctttgcttctatttcttgttgattacaggatcaaatcaactggcacgctaacacatgcgaaggcgagctttggacctgcactggagttaagcagacctcccaggccacatgttttctatcaacagtggcatagttcagaaattctattcccgactccaatggtaaagagaaacgctttcctttagtaattattatcatgcaagaaacacttgtctgttatgagagaagggaaccattactttgtatacttaaatactctctccccattttatgggaaggaatcatatcataatttatcactgttctagacacaagtagtttaagacaaaacatatttggcatttgagttttgcatgcacctcatatttagcaaaatgtatatgaattgaaaaatgggaactcaggtgttcccccatttatgcaattagtataaaataatatgttattgtttttatggcattgcatagtcaagtgtagtcttcaaggctccaattgcacaataaatttaagttattaactagcatgtttttttaatatgacctgtgttaatctgttattgactagcacatatccttcagagatggaaaggcattacaacaaattatcaattttttgtagcttggtatgaactgttagaaattcccaagccaataaagtaagcttcaaatgtaatgggacgaataattacttggctgagggataccaaaaaaaaaaggaacatcaatgtcaggacaaaaaggaaacaacaccataagtagaatggatatggtaaacaggctttggaaaagtgagtgaatgcatttaaggtgcaaagaataagcaaaccatttatatcttgcagttgcatatgtgtatatgtgttagcaatcttataaggtgtttgaagaaaataaaggtataccttctctgcttgagaggccctcttctgggaagatagtctgccaccgtgtctactgtaagaatgccagctatggaggccttactgagaccgtgtttttcttggaagtcagcatctcttaaatctccacattcaatgctgatacttctactaagcgaattactgttaacggcgacaaggcaagttctcatgcagccaggtggaaccgaaaaaccggataggagggcaatgtaacgatcaatacgtagaacaaggtccagtggaaaagtgtaatctggaaagaacgagctgcaatgagtatcagctacttcccagcaatcctctagccgcgcatctcgaaccaggatgtctgggctcaaagatggcaacaattcaaccgccgggctggcacagcaaactcctgaaaacaaagtagacattctcatgggcacatgccaaccatgtgaaataaacccagataaatttacagttagctcatacaagaccaacatataaaacactgaatgtttagtgtagtaagttcaaattatcgcgatatattcattttgaggtagcatggtaccctttctaatgacaacactctaagccaaatgccccagttggagcaaggtattcaccaaatactaattcagtcgatttgctaaacgacactcccatcctttggggagaaccaaaccgattgcgtgctgtcaaattaatcttccccggataatccaatactacccaattgtaaagaggattacgattataacctcaattacttatcaatgccaagaaaattggagcggtagataagacctgcagcgggtttggtggcgaaggacgggcagcggtggtgccggacggcgactgcggcggatcggcggacggggtagagaggagaagcggaggcggacgacgtcggagagcgagccaagcttatcgccggcggcatcatggcctccctccccccgcctcggctcctccgctccttcgctgtctctctcctccgatttttaatctactactgtttgcccccacactttccgccttccaaactcgtttacgtaaaataaaattacgccttattagggtgtagcccacggcccacctttccgtcttcgaaaagagtttacgtaaaattaaagtgcgccttgtgaactgtgcagcaactaacaaggcagtggattccggaggcgagcgagagagggagagaggaggggtgggagcgggggcggcgcggcggcggcggtggatggcgatggcgggcggcggggggctcaaccggtcgtcgtcgagggggcagctgccgccgcaggagcttctcgacgatctctgcaggtagcccccatcccaaaccctcgatcccatccatctcgcgagtttcttctcggcttttgctcagatcaaaccccccggaaaaaaactgaatcgaatcgccggtggaaacggaaaaatcgcagccgcttcgtgctcaacgtgcccaaggaggatttggagtcgttcgagcggatcctgttcttgctggagcaggcgcactggttctacgaggacaactccgtcgagcacaacccctccctcaagtcgctctccttcaaggacttcactacgctcagtaagctccggccgaactccaccttggattcatcggtggcgcttccgccgttggtttgatcgctgacaccgttattgttgttgtggtggtgtatgtgtgcagtgttcaatagctgtgctgcgctcaggccataccgcgcgcaccttgatgacatttacaaggatttcactcactataagttccgtgtccctgtctgcggcgccatcatcctcgatgacacctacgagaaggtaactacacccctaccccgatcaccttgtaccatattactttctacctagattaagtttagctgagtagctgcttatgttgcacaatgtgtgggtgtggcagcttggaaacaatgctaaagtaattctggtattttgtctgttgctgcaaataccttgtagatggtttattgtatagtcgcttcaatgcgtatagtttcaagctctatactgcaatgcactaggcacaaataaaaattacatctttggatctttaacccttgtagacctcaattcgcgcattctttttcactttgtcatcacatactcacaccccaagtttcattcactttttctccttctgtgcagtgcttgcttgtgaagggatggaagtctagcgccagctggagttttcctcgtggaaagaggagtaaagatgaagaagatcatacatgtgctgttagagaagtaaacttctgggctgaatcgatgttgttctttgcagttttatcaattaaattagacttataaaggatagaaatttgtataagtcactgaacaatagttttacatttctctagatcatcaagatgcttttttctacaattcaaatatcaaagttctagatattctaccatgctccaacacttactgttttcatttagtgtttgcattttaatccattgcatacaccatttgttgtttcttctctaaaaatgaattgcattgcctatctcatgtttaaaaaggaacaaaaaaagcttagcattggttagctaaatattgtcagctggtcctgtgcataattttttttaaagacatgcagtgatcacgtcttagctttcgtgaactagtttccatgttttgcacttccctttgcttattgcattactagtctatgtaagtgacatttatttacataacaatgcaggttctagaggaaactgggtgtgatgtttcgaagcttttaaaattggaagattatattgaagtttcaatgtggcagcaaagagtccgcctttatattataactggtgttaagggggatactgtttttgcgcctcaaactaagaaggagatcagtgtacgcaaatgttcagtgtttttatcatatttctttttgctcaactacattcagaatattttggactcgctatctgaaaacgaaaaggggaattgcgtgacatgattgcaaaatgatacaatatgactttgattgtttgattaatggccataatccttcgtgtgtgcttagcttatagtaaggaatagctcctttccgattaacaagctgttctacagatttttttttccataatgatctgctaaatttcaactcagttgagaagagactcaatttgaagcattctgtaatcactttattgttacttaactgacaagttagtacatgttcagccacatatttttgcttgctgactgaggtactttatctttttatgctggtgtatgaatcacttgcaatgctagctgtcttgtgtggttgtgtttactaccttgtgtctacttgaagactgtagttactgtaactacaatttattgtttttttcgttgtagtttatccattgacccttttgagttttgaacctctctttggttaaagagagttaaataggcattactgagtcgtgatcctctgaaattgacaggagatctcatggcacaacatcgatgaactccttcctgctggtgatgacgcaatatctcgtggagtgaatgggatgaagctctatatggtcgcaccatttttgcagtcagtacctttttgacccactttagtttttttttcttggtgcagacagtcatcatgagcatgttggtttaatggcttctaaaatatttaacccgcatccacatttcctgagtgtgaatttgtttctacattgtttaattcctttacattttacttcttcatccaggggtctaaaagcctggatagccacacatcgtcacccacagtatcagaaatcagacacgtctgctagaggtttcttctgatcctccctttgcccatttatgttaggacctaaaaatgttaaattatttgtcaattatttttagcagttctgcttcaagtttcgcttgttgttttctaagttaatctgcagaagtagttctcaactgagcaaaatatcagctagtacataattaaagcaggtctgatcctggcatagtcatgaactcatggctatacttatgatcaacttttagtacatagtgtgtgtagtaccattggtgaacctggtgcaatgtactcctagtatgtaatttgtgataaaattggtgaacctctggtgctacatataccgtttgcctctataattgtgataacatctatggtaccacacatcatttgacaggtactgtgtggaaagcgaagaattcctcaactggagcggcgcctgttgagaaccccgttattactagaacaggatctgacccacaaactcttgacagccgcccaggtaaaagcttccgaaacttcaggttcgacacagcgagtatcctgcagtccatggaagctttcttcctacgtacctaggagcctgacaaagcatcaccccatgtgtgtatgcttgatgtgtatagactatgtaagccaagggcgtgtcttctgttgttaactcagctttttcttcacttttctagttgtatctgtaatcctgaatgcaacagatgcttctaccattgtgataatatccctacatttcgtgcacatgaatgttttttcttctgtccattcagatttgtgtttgaaatgttgctcaaaatggagtaagaattcctctgcattttgcatgatcttgttccgttattcttacattgtggttgagaactgagaactgataagcatccttccttagacaatgtagcgggctgtgcatggcccgaatgtgtagaattatgatgggcctagccttttgagtacggagtttgggccgatccaaccatttgtagtgatgggccgtgggccttggcgacaagcgaagctgaatgggctttgttcttttgctatctgtggagacgagtgatgcgccgatgacgtgtgcggagcgtgtggccaggcatcttctccttcacgctttcgctgtaccaccaccaccgctgctagtgctcgcgcgctctcctgctgctgctagaagcttctggaatctggagccgagccgatgccatggcggcgctcgtgcggcccgccgtgctgcccgtctgcgccatgacgggcggcggcggtaacgacaagcggtcgccgccgcagcagcggtcgtggtggggcgggaacaagcagagattgccgcaccagccgcggcggcagccgggcgggaatggtggccgaggaggaggaggaggggcgctggaccaggtgctcggagtgctccgccgcgacggcgagttcctccaggcggcagccggcgcccccctccgcgacatcttctggctccgcttcctcgagaagaagaagcagcagcggcggcggaagcaaccaaaacctaaacccaaacctccggagcagcagcagcagcaagaggaagcggcggcggctatccaagccccatccttcccacctccctcctaccagccaggtttgtcgccgcgcggcagagaagcatctcgattgggctccgttgcgcacgcattgttcctgttgctgatggggattctcccaattggtaggattatcatgcctggatcttatgactgctgatttcgaagccctgaagctgtatatcagctactcgaagcatgcaatcgagcagcaatttctcaaaggcaagcggcaacctcagcatcagcaaactcctaaaccaaaactccagcaacagcagcagcagcagaagaagaagcagcagcaacaagagcagcagaatcagacacttcaacctccggccttccctcccccatcgtaccctccaggttgcttacaccaagcagtgcccaattagctgttgcttaatcatttaagtttcatcgattgcattattaacttgttttatgatttttgctagggctgtcttgtatggagctgatgatggctgatatcgaagctctcaagttgtacatcaactactatgtagccattctcaccactcctctaccccagcattacgatccggagatactgtcccgttacttcacctcgcgtcctcatattctcgcatttcgcaccattcaggtaaaagctgtaattactgttcatctttgctcttactaagcttcaactgataaatctaatagttcagtgtgccatgcttctgtatctgtagataatcttcgcatttgtctcggctgcagtaaagatgcaaatttctaaaagaacaaacttgatcacagatgccacctacagctgtaatagcaccggaagcaaaggtttcaatgcttcacaatacatggttggccagcttctcaaagagacatttctagatcttgggcctacttttgttaaaggtcaggttttcaggttcgatagctttaagccatggtagtggccactcggttcggattaatgttgacttgcttgtcttctgtgtgcagttggacagtccctctcaacaaggcctgatatcacaggctcggagatttctgaggttaggtaaaattactgcaggatacaataacatttctgcatttctttaatgcttcatcatcttcagaagtgttttgttgatcattaaacaatctccatagtctttctcaaaattaactggcgcacaccccaatcataggcactcgccgagttacatgaaaaggttcctcccttcccgagaaaagatgcaatgaagattattgagggagaatttgagctccctgtatcacacattttcagttacatttctgatgagcctgttgctgcagcttcctttggacaggtaatcatatcttgcaaaacttttcccgttcttttttaaatattagagacaggagctttgtagtttctgattaagccttattatatttttctgtactatctctttcaatttttctgttatgctcagtgtactcttgtttgttgtactttaggtttatcagggacgtacagttgatggtgctcttgtggccataaaggttcaacggcctaaccttcttccttcagtattgagggacatttatattctacggcttggggtacgtatgcaactatatctccattaaatatataagctcatctgtttttgagtgtttttaattctgccaagtgctaatgcccacatcttgttcatagaagatatatacaccataggttcttcgcctactgtttgacaaaaaagaaagttcatcttctgatcctcagcatgagcataatacctgatgccttctattttgttgtccctaaacaagctttaccgtttccctgattttgtgtttaattaagagtgttaatgtgactatgataacctgtgctgacacaagaaacattgtacagtactttctttcaatacagatggaccttgtctcatttaagtttatctgtatttagattaaatgttcttgcacttcattttatttctttattttgcttacaaaattatagcattgcagcatttttccactatagtcctagcaacttgatgtcttttctaccatatatgtttcagctttcttttgtgaggaaggtagcaaagaggaaaagcaacattgccctctatgctgatgagttgggtaaaggtttggttggcgagttggactacaatattgaagctgctaatgctaccaaattcctggtgctttggtcttgtctcctacctatactttactaacatatgcctattcctgttttggcgttttatctcataatttgtacttctgtaggaatatcattccagatattcatttatgctggttccaaaggttctcaagcaacttacgaggagaagagttttgacaatggagtgggtatctggtgaaaatcccacagatttgctttccttatctaaaggaatttcatcagaaattgctgaatcgtcagagaagcagaagatcgaagcaacagcccgtcttcttgacctggtatttatgttcgtcacaagttatttctaaattatctgcttcatttgtaaaaagatgagcaccataaataaattaatccacaacaatcagtgctcccgggtagcaaatatttggaattgaagtcgtgctcagtgaatagggcttttttgtcagttagaaactgcagtttacatggttctttgcaatattgtgtttgtttcagaaacacgcagcttaattttataaatatctatcacttcaatattgatgttcttttctctctgctgtggtagaaatataaacattataacaacaattactacatttcaataaacatttttcccctctggacaaaatgttttaacatcttgttaattactatgatgataaggtcaacaaaggtgtcgaagcatcattagtgcagctcctcgagactggtttgttgcatgctgatcctcatcctgggaatttgcgttatacacctgaaggtcgtgtcgggttagtggtaatttatctttttatgtacgctctataagaaaatgtcttcttactataatcagcagaatcatgttatacagtgggtctgatgtttttgtaatggttttcctctgtcattctccctttgagcaatagtaacaccttcctaattatgttaggtttcttgattttggtttgctttgtatgatggagaagaaacatcagcatgctatgcttgcaagtatcgntcacatagtaaatggagattgggcttctcttgtttatgatttgactgcaatggatgttgttccaccaagaactaatctacgccgagtgacaatggtaattcatcaaaatgcagaatatttatttatttatggctattacaagatggaaaaaaacaaaggttcttatctcatactccctccgtcccagaatataagggattttggatggatgggacacatcctagtnttacanatctggaaagggagcttgtagtgttatttaagttggtattccattattatttttaatggttggtgattggtatgtcttgtttgatgccttgggtgaggtgacctttgaagatggaattccagatatcaagtttagcagggtgtgtacctttccctctttaagttcagttataaactgcggcatgtctctttctttatcggcatcttcctgaactgttaaaaacatcctttaggtgcttggaaaaatatggtctgtggcatttaaataccacttccgtatgccgccgtactacacgctcgttctgaggtcacttgcctctttggaaggttagtttgtttagatgaaattcagtactgaactagctcaattataagtatgtgttgctcttttggttctgacttgtacatatttgagcatgtgtttttttttggaggcttaccagcgtccccttttgtgtaatctggtaggctggccattgcagcagatggaacttttaaaacattttaagcagcatatccatatgttgtgcggaagcttctatcggataattcagttgcaacatggagactcttgcatcaggtattattattttacctcatttgtttacctgtatagtatatatgttaagttgatttaattaattgattcacttttcttatattttgtgcaacctggacaatatgtgctctttgaaacagtcaactcacccattttcgtttgtacgagatgtacagaaatcctgcaataaaatttgaaattctgagttttgttagttcacgatatcaaacgtcaaacacccaagggaaatggcatcgatgataatagagttctgacaccaattattaatacacaggctcttttcaacaaaaggaaagagtttcagtggaacaagattacagtatttctaaaattagcatcagcaaggtcagttctctagttctgagcagaattgtgtgtaaacatcatgtttttttcactaaactgtatgaacagaatttcttctactatgatgcttacttgcttagttttcacgagatgcatctgatgatgttttcgtatgtgaaggggtaacttcaggtataatactggcgttttgcctgagaggaagggtttggatgttgcaaaacttgtagagatcagtgatgcatcttcttcactccatcttaaccgtgctacaccagaaagagcactacatactgcaaatctgtgcttgcggcttttactatcgaaggagagcattgtgataaggagacttgtaatgacagcggtatgtacttttccttgtttcccctctttacctgaatcgactggcccttttggctggatttctgaacgcataaaacacactaaactagaaatcaactgagctcaccatacttcctgttgcacagaacgcgaagtcacttgctcgtgacctgatctccaaagatgcatcgatttaccgggtgctcttaagtcgggtacttgccgatgtcatcttccagtggatggtgaaggcaactggttttaaacgagccggacagctcgagcctcacccacgcgtgacagcaggaaagaacgatgaagacctggggctgtccaaagaagcaccagccttggtgacattccagacagcagtaagagatcgcaggctgaaggtgatattctccaagttcgtcagggacataagagaggaccccatcctgatggtcagagtgagctggaacatgtttgctatctcggtggtctccgctgcaattggcgttcaccgtttcatcgtcgtcttgtcggaggaatttctgtctacattaccaccgcctgtgcctccgccgcggctagttcagattcagagcatatgaagagcagcaactatgccttggtgcatgaagtaacttttttactgggtatcccgtagctgtatataaacgttttcaggagcagaatcagccatcctgtagctgacagtagctcgatcagagttctccatggctagttctccgtaaatttgtcttctactattacaggcttcctttgaaaagggaattttgtgggaattaaactgatttttgtgaaagtactgtaaaattcttgtcatcgtgtcgcaaaggagcgaaaaagcttactaactcgtaacgactgaaggctgagatcgtgtacaggctaaacatttgcacacaaagcgaaaagtctaattaacacatgattagttaagtattaaataatataaatttaaaacccatatatttatttgtttttaaaaaaaacttgtatgtggaattttttttaaaacgcgcgcgcgcacacagtttataatagttcggtagagaaagtaaccgtagaaactgggccttagccaattgggccgataaatgggccgtgcgagcgtcgtgtaccggtcgacgagacagaagcagctgatgcgccttgtgacctgacctgacagagagagcaggtggagctgtgtgtgtgtgtccgtgtgatccagagcgggagggaggaggaagcggagggggatggtggggggaaga

SEQ ID NO: 53706 - DNA, 1799 bp, Oryza sativa
cttgcttttgaaatacgaattgacagggtaaattggtgcttgttgggcgtttggcactggctaaaccttcgatttagtcatttagaccttgtggcatcattgtcacggccctgtgaattgcattcttatcttccatgatagggatgagatcagctcctgaaatggcttgtccctgcttagtggtaacgcagagacaaaaaggagttcctaacgtagaatggttttttttactgttattgtctatctgcaattaaccattcaccctagatgctttgataactaaaaagtgcgaaactgccattgctcgtaggtttatcaaggggaagtttctggaggcttttgtcttctatttttgtttcctgtcaagtgtcaatatgtctctgccctttttgactgaaatgtgttcttgccaaaatactcctggctggcataggttaagctgttacccggtcctcattctccttccacattggtagcttgacagccccatcttttcgcttatgcttatgcttacgacttttttttacttaaaatctatacagcttattagtaacccaaaaaataatttatggataaaacttttatatacgtgtctttagttgttattttgtaaataaactatgatagaaaacccacaaaattgagttttaaaattcaaaatgttattagcataaacataagcaaaacggttgggctgtgaaatatcaacccatgcctgtccaatttgttcgaggctgactgatagtttcaattgcacttttttttctgcatcaatcttttgcaggaggcaatttgagcgtgccaacctagaagcaatggatgaatctgctgaatggagaatgaaatatgacacagagtttgcgaaaaacaaacagatgcaagatgaacttttaaaggtctggtctatttatattatgtacttgtacacagctttcctcagtttccttctgcagtgctcatttgagaatcttgtttacaggctaaggcctcactctctgcttcaactaagagatttagcctattgaaaaaggtaaccttttgggggcaaactttgatgcttctcgttgtaacaccctaacataatattagctctatgcttcctcagtaatattgagcgctttctcctggtttctccatatatttcactctcttaggtgttaccatgcttatgctcattttttttcaactcttttgagatgctcgttttcacaactgcaggataatgaggtgttgaagaggcagattcagatcatgaaacagcaatgcaattgcactgttacatcgaaccttacacaagaataatgacattactacatacttcttttgtagtttagcattcatcttccttaaaatttgacatatgaactagcgggaggcctagtagagtggtgaagtatgaagtaggagaaatagctactgtagcaagaatattactttgcttgcaattgttagtgagttttacacatgccattttgaagtggttgctcctgactagcaaactaccagtgcaaatagaagatttttggttcatttgagtggtgtattcagttataagttatccttgactggcccttacaaggctgtttggtatttgtaaatatacgttgtcttaatggccatatccagttcctttcttgtttggtccgtgcccacatttggccatgcgttgacatcaagtggtgcagtaatatattcaaatgtctgaagtaacattatgaaaacatcatgcatcatcatttgatgctaatcatgtttcttaaacatctactagctgcaccatcatgacatcaagttgtgca

SEQ ID NO: 53707 - DNA, 4225 bp, Oryza sativa
agagagcatgagtacataactttcttcatgtatggggacacataattttctgacatagtacgtccactcttgtcaacatgcaagatcaaaggacaaaccaaatatacagtgtttaaagtggctccgatagtgagagcacaaacaagataccaatacattcatggaatcaatagtatcttgccaatgtgggaactttcttccatcaacttgtgagcttcagcagcttctgacagaggaaacgtcttgtatattactggtttcaccttgccttgcacaacggcaggccatacatttttctccacctcactgacaatcagagctttattatcaaggcttctgttgcgtagtccagcagctgcacagaatcataccattttcacacatgctaaaatcagcgatatcgtttaggtatcatccaatcacataattgtgattctcagtaaggcaacaaccagcagtggtataagatcgtaaataacaaaactagaaacacaaaaatctagtatgagggacattgttgcctatagatcaacgttaccttgtatggtcaatcgtcgagcaagcatgggttgcaggttcacttcagttacagcgcctccttggaaaccaatgatgaaaagtctaccatcaacagctaagctgttcaggttacgctgaagatacaatccaccgatgttgtccagaatgacatcaacacctggtaaatatacttccatgtcaagagtcactaaagcatatgcaaacttggcaggtatcaaacattatagacagttccatggagaaatgccgttataagaaatccatctgcatataagtaccaattggctggggaaaataatatgaacatgaacacacaaaaatggtgaacgcgtgcgatataccctttccatttgtttcttctttgacacgtgcaacgaaatcttcagttttgtagtttatgcatacatcggcacccaaacctttgcaggcagctagtttttcctcactacctacaaacacatagtgtaacagcatttacttgagcgatctctgcaacatcctattatatactccctactgtatctattcttgttctactataaacaaacctgcagtaacaaaaaccttaattccaaggtgctttgcaatctgtatagcaaatgtaccaattccactcgatccaccatggatctgcaaacaccaaggatgcaccgtgctcaggaatgaatcatggagtcaatgggggattgaaaaggagagaagttatcttacgaggaacgattcgctgggggagaggtggctggtcacgaagacggtcgaccagacggtgcaggccacctcgggcaagccggcggcgtccgtcagagacaccccctccggcaccgggagcagctgccccgccggcaccaccaccttctccgcatacccgccgctgctgagcagcgcgcacacctgcaaggggaaaaacaaatctcccaaaattttacatcctatcacatagaacgtttgaacatctgcatgaagtattaaatatatgctaaaagaataactaattacatagattacgactaatttgcgagacaaatcttttgagtctaatttctccatgatttgacaatgtggtactaccgtaaacatttgctaatgatggattcattaggcttaataaattcgtctcgcagtctaccgacggattctgtaattagtttttttattagtgcgacggattttgtaattaatttttttattagtgcctaaacacctcatgtgacaccctatataatatccgatgtaacacgctaaaactttaaaccctagatctaaacaccccctaacctaacgtcctaatccaaacggcagcggcggcggcggcaatcaccgattcacctggtcaccgacggcccaccggaaggtttcgttagggccaagggcgaggatggtgccggagcactccaggcccgggtaaggggacgcgccgggcggcgcggggtaccggccctggcgctggacggtgtcggcgcggttgacgccggcggcggacaccccgacgagcacctcgccttcccccggcggcgggaggccctcccagacgtcccgctcctccagcacctccggcccgccggcgcgcgcgatcaccaccgccctcatctctccccctacctcgtcggggctcagctgctcgctttgctttgctcctctcgatgagtccacgcacgcgctgacactctgcgtctctgctgctgactcgtcgactggatattgagatgggccttgggcctggttgagtaaaattggcccagatagctgaaatctggtccagccttctaaaaaaagataagtacttcctaagtgctagtccttccgtttcatattttaagccgtttaactttttttcattcaaactttgttttgattgatcaagtttatagaaaaatattactaacatattaaaatagttttattgaatctaacattgaatatattttgataatttgtttgttttgtgttgaaaatactactatatttttatataaatttaattatactttaaaaggtttaactatgaaaaaaagtcaaacaactaaataataaataatatgaatgaaaagaagggagtaatacggtataaacgttgtttgctacattgtctatatattttgaaaatgaatcgattcggggcgagttggtattgactggagaatagaaagtctatatatctgtgtaattgaacatttggagaatactctcacattaattaaaaagatataatcattaatttggtggatcatacttgtactaaaacggataccttctgaggtatggcctgatatagacttccattaaaatgctattctcttacaacatttgagaggacaaatgactatactaattaatgcacaattttttttctaccacatgtctttctttttttttctctatccatatatactaaagttttcctctataaacgcctagagtcgacgaccattgtcacatttaacaagtatatttctctctttttttttcatttctcttatatgtcagcaacttaaaagtctgtttattaattgtctttgtatctgccctaattaactcttacattcaccagaaaaatgttcatacatcaggttgatatgacctaccgtaaatagtagtttaaagtttgtgtgtcaataataatgcaatttataaaaactatggacttattaattgtattttattattttaataattttaatgttagaattatgaatacgaagtctatacatcctatgctctcaatttagttttaactttttattttaatttcaaattaaagacttgcatgatgtaaccaatatgtacaacaactaacatattcagtcatcgtctcgagtggcaacgaatagagtgttaaatcatcaaattttgcttgtactccgtgcaaacatcccaaaaaaagaaaaaaaaagactggataattctctagtgatgatataaagttacaaactcgtgcaacacatggattgatggctacttaatgatattccatgcatatttatgaggttgtcaattttaattgtattttagtgtaacgaactactatacctaatcttgttttgcttttagtatgactagttactatacctcatcttgttttgtttggtattgcagaagaattgtttttatcttctttgttaagctacgcgttatttaaggcatcagaagtactatacagttggaagagaatcaaccagtaaccatgacaaaaatatcagttgagtggcggcaaatcatgtcatgctcgtgtgggacatagtactagtactactaatgggcgatagcaactcagcaaggcgaaagaaaagaaaagaaatgaaagtgaaaaagactgtgttctttatagatgagacggatattttgtacgtaaaacgaaatgatcactaatccataattaattaaatattagtaaaagatatatttaaggtaaatttaatatatctttttaagaaatattttttaaaaaaaatatattatttcaaaatttaaaaaacatgtgcacggaaaaataaggaataacgtgcgcactagaaatgacaagtgttgcaaagaaagctttccagattgagatggattcccacggtgcgggggcttcacccgcacgcgcgctctctttcgccaccgttgccggctaaccaaaaaagtggaacacgaagaagaagcagcagaagaggaggagcatctcgcaaccaccggatcgattcat

SEQ ID NO: 53708 - DNA, 1284 bp, Oryza sativa
gggcgggagtgactacgttagggagatggaggtcacggtgcgcgtcgtgcagaccgcctgcaccctctgccagcgcgtgcagagctcgctcctcctccccgcctccgcctccgcctccgtcagagtccactccaagatcgaccgctcccccgtcaccgtcgcaggttggtcttgttgccttcactcctgagcgagctcgtagcactggtcagttcgtcgccgcaatttagtatgcctccaaaatccatagcgagagattagtcaaactggagctccatcatattagaatattcagattgatactgattcattgttcttaattcagtccgaattcctaaatggaatggttgcttaattagttattgttgttgactttgaaattgagcgaccgtgtgcgtagtggtcttatactcttatgttctgtgatttcctaaggaagagaattgaatacttgcacttgacttgttggcctgttagaacactactaaataataatggtccactaccaggttcagtatgagtacaatggtagtgggtagctcatgctccatgttgccaacataccagataccagatagctcataataccacatggtcatatgtcaaatcaaatctgatctgatgcaatgttatttggcccacaaatttaagaagatctttgtgttaaatgccatcaagaattgtgactttgtggttggtatcttttggatgcaataaatttatgcttttgtggtaattggttaccagtagtaatctttccttcaaacgttattccagattggggcgtccaagcgatagtaagctggctactctcggattgctttcaagatgaaaacatatctatagtagccgaagaagatgatgagacgctatctagtagcgatggtgcagctttgcttgaatctgtcgttgctgctgtcaatggttgcttgattgaagctccgaagtatgggctgaggtccccagagaaagagctcaaagctcatgatattcttcaagctattaggaggtgcagctctatcggaggtccaaaaggaaggttttgggtgcttgatcctgtggatggcacgcttgggtttgtacgtggggaccaatacgctgttgctctcgcgctaattgaagatggggaagttgtattgggagttcttgggtgcccaaattatccaatgaagaaggagtggctcaactaccaccaacgatattacaggttgatgtctaaggtttctcctcccacatcaggatcctggcataagggttgtgtgatgtatgctcaccgaggatgtg

SEQ ID NO: 53709 - DNA, 1861 bp, Oryza sativa
atacaaggcggggttgctacattcacatggcttgatgctcatgtccacagaggagtacaatatggcatataatcaatggaatgcgtagctatgcatgtccttgtttatttcctttcattcgaactagaattgtaatcgtggacattatactgtggactctattgttattgtggactatattgttattctggactgtattgttattctggacctacatgtggatatcgttatgctttgaaatgtgagattgatgattgttattgttgttataatgttatgaattattgtattgatttgaactccacaatatagagtaggtcatgccgaatttttctgttgtataaccacatcttaattaactaaaatactcacattttagtttttttctattatttttttcatttttcttatttcagttccaacatatcgcggttaccgtcctcttatcgcggttaccgtaccaaaccgtgcggttaccgtgtctataccgtggattttgaattcaaaaatttggaaacgaaatttgtgcggtttttcgcggtaaccgcacggttaccgcggtaaccaccataccgcggggggtcggtaaccccccaaaacggtaaggtgaaccctggtctcaaccagatatatttatcaaagaattcagagtagtatttatcaaagaaaacaatccaggtttattatttggagtcactatctagaaatgaagagtggtacataagtttagggtgtgtatttggactggattaaattgaattagcttgttgtctcaaaccgatgcatgtattcatcagagaatccacactagtatttattaaaggaaacaatcatggtttattacttggagtcactctctagaaatgaagactagcacttcatccatcccaaaatataaacatttaaaatattattttaaatagtgtcaagtcaaatatttttaattttaactattaatagaaaaaaataaaaaaattaatcatttaaaattgatgttactagatttatcattacaaattatcataatatgcaattttttatttaaaacatcttatttttatagatattgttagtcaaagtagcccctcgaagactgtgtcgaagtctaaaaatgcttatattttagaacagggagagtacttgtgttttgtttgactgaattaaattgaattagctagttaattgtctcacccgatgaatttgctccatctgtcaatgagttaattatctctttctacatcttctctctcaccgatagtcatatcctatgttggttttttcttctcaaggtgtggtctccatcctcttatctgcacactgtgtgcaggttttagcagtgtagctatcgctgtgtgtcgattccatctcgagctacagttgaagccataactttttttgatgcttgcatttactaagacgaattattgatcgatatggcgattaataacctggttaaacttcgttccagctagctcaatcctgaccacgacagggtgcctctcgatcaggcagttcagctagctgccgactgatgtcgttttgataggattacaagtcgatcgcttgactcgttcagatcgatctgacgaccacacagtaattcgactagtcatgtggtcgtgtagtatttagggcgggtggttttggctgattagctatacgcaaatagatttatttgattttctcaaaatcatgttctatacagaaagttttcatacgaatgtaccctttagcactttaaaaagtatattaacggtaaacgagaagtaaccaagatcaattaactctctacactattcacttgatcgtcgaaacggattatttgctatatgattcaaaacatacatttcttaaagaaaaa

SEQ ID NO: 53710 - DNA, 2407 bp, Oryza sativa
cagaagaagaggttattgatgaagattgcgatcttctctagcacattctgatttactactaaagattgcaatctttttttacatagcagaccgtgatagattgatagtagtccgatactcagtggcggatctagaaaaaaatagtagtgggggctgaataaactacatcagcataaatcgaaccttcagtccccacatcctatggatctatggaaaaaaaaatttagtgggggcttaggggggtctccactgtcccggggtggtagtggggtctcgagacccctccgcccccattgtgaatccgccctgctgatacttactaattaatcctattactacctgcttaaaaatgggtagtgaaaagggaattgcagaaatgcagtgatccactggattggcgccggcaccagcgaagactaaagcttgaatgattgcaggcaagaacacacatcataaaaatggccagcaggttgccaaattgttgcatccgattcccaatttccaatggacgcatacatcacatcttcttttttctgtgcacttctttccttctgttcttgccttgatccatcctgggagagaataattctcatatgccaacaaatatcatgagagaatcctatggatgtccactgttcgattgtgccagtgctttatgtggtatctgactggcgtatgcttttcaggtggggtgttggtgatgttgcatttgcagttggagaatatatgtagtgtttttttttcatcataaagtgcatttctaacatacaaaatactataaacatataatctcctttcaaatatattagttcgaagccattgttctattagatgatagatacataaacctatgcctaatgatgatgtgcagctcatctccttgctttttgaagagttctgaatcatgtttaattcctttttaccagaagaatatagaattagtaccccactttatcagctaagtatgcttctctttttaacaagtgcatcctggacttcattaaaaaaaccagtcattgagtgagttaattggggccagaaccaaagataagatgccattacccgtgtgatgatgcagcatgtgcttgtcaggagaagagcttagccatgactcaactttgtagcgaccactaaataaaaattaggtattggtctggttagagactaatcagtgtgatgtgtaaagcaatatagtttgtcggacagtagcaaaatccctgacgttttctatttcaccaaacaactgtagaacggaagccaaagcagataaaaagttctgtttgatatactcagaatatatgccattagacatgggaacaatttcaaatatgcaactttgaccattatttttgaacatgaacatgcttgtaagaaatagataagtagtaaatcctccccgtttttaaattgccgtcactggtgactatcattgttttagctttgaccactaatttactcttaaaagataaaagtagtacgacagatacatgatttatgattatatttaagatgctttaattacaattcggtgacaaggtataattttttagcatttcagactttcttaaaataattttaaattcaaagtttgaaaattaataaatagtgcctaatgtcagttatttaaaaaataaaattttttaaactagttttcaagctaatttatgagcttatataatttttctgactgatctaattagttttcgagctagaacattgttgtcacaactcgcaaggtttgtaaaatttcacttcaaacagtttagaaaagttttccgagaattttacatgaaacatatagtttaggagcttggaaatcgtgaaatgaaaaatccaagataagaaaagaagagggctatagtactatattattattattattattggacagagaatgggtgaatggctagtcaaattatggatgaactgtctctcttacactatacatgagctattggagttggggagcaaccacatactctgaatggagtcggcggtcaggacacaattatcagagtcagacagacagctaagagagaatatgagagataatgatgcattgatgctttgtccttttgcggtctggttactcaaagtgtgattacgtcgtgcattaccctctaagtggtgacataattaatggatggattatcaaaatgcacaaactccaatcttatttttgacgactgcataaaagtaaaaaaagagatagaaccagtcagacaaaagtataactgagagatagtggcctggaaaactttggggaaatgagatggcgaggcccatatcatgtaagctcaaggtctggcctgccattcaggaggtaaggcctaatatagcccattgcatccatgccaatgcgagccgaggtcgtccttttttttgtttggggggggggggggggggg

SEQ ID NO: 53711 - DNA, 3514 bp, Oryza sativa
tacaatcacgagctaagagctcggtaacaccctcaggcgcctggaagcgcaaacctacagactctttcgaacgtagcgcatagtgtatgagaccatgatcgagccactttattttcaaccctatctctccgacttaaaaaaattttcaatcctaactatatgtgtctaggttcgtagttacgagttgattttttatggaaagtagtactaattagagcagatcgaggaccatgaataacatgcagccctgctctagctttctgaattacgaagtatatgccagacctgagatttatcacacccagccgatcttagggctgcttctacgttagcacaatcggctccaaggatgaaaggccccttaactcactcatttaccaggcggatcccaccacggcaagccacctgcttctgcttcttcagccgatgcacagcctctgatcagcttccaagatgaaagcagtaactttccctcctgattgcgaaccacaatgcccacactcccttccttggtttgttgcacaaaagcaccatctacatttacctttacccatcctgggccacacatgacatgtcggagagaagggagagagagaggggggcaggaagaagaaagagatagaggatgacatgtgggtctcataattttttttagtgataaataggacccacatatatgtttttaactctaatgtcaccaaagtgccacatccgcagaccaagtcaacactgctacgtgaacaccacatcattgaacttgtcctccgaaaccatcgagggagtcaaattacaccggtattaatagttggagggtctagatatccggtcctgcggttcaaggatacgaatcagattccgtcactagttaagggactaacagtgaacttattcctttcctttttctgttagggccgtagtctaccagcctggtccggcccacctccaccctgggccgtgcctgggcttaggccacggcaacatagccgtcctacgttgaacccatgcaaactgacaaatctattctattttactttatttttttatttttcataaaaaaaaagatagccaaagctgaccatgagctccgccgcgccgccgatgcggaatcgcggatgcggtccacccgcagatctccgaccatcagcccaacccacggtttccccgccctccacaccccaacctcgtccgctccgtcgccgacgacgactgcctcctaccccatgtatataacccccgccactcctctcgatgttgaggtaaatcgagtgagtccgcaagtcgttcgcgattcttgatcgagatctgtcagggtgataaaggtaacggtctttcggctgtgtcttaggattagatccaactgtttctgtgcttggaacagttgcagagaaactgtagtttcttggatcagtttgtcgagtttgttttggtggatttagcatctcgttcttttgtttttttgtacaggtttagaacggtgctgagtttgttaatcttgggagaaaagggaaactgctctcgagtatggagatggtgttgccagtcgcgaacgcgactgctgcagcacttgcgcgggtttctgctatgttcaatgccccgcttgctcgtgctgttgtctttgggattcatatcgatggtaaatgatatttattttctccagcagctaagaaattctggagttgtatcgtgtttcatttaaattatgcgctatgcgctgattctgtgattttcagggcacttggtcgtcgaagggcttctcattgccgcaatactcttccagctctccaggaagagctacaagcctccaaagaagccactcactgagagggtgagctacactttgctcaataatttggaattagtagttttttctgttcctttccatttcttaatgcttcatcaattgtgttaatcaggtgttttttttttggctcaacaggaggttgatgagctctgtgatgagtggcaaccagagcctctctgcccacccatcaaggagggagctcggattgaggctcctacattagaaaggttcgtctcaattctcaagccccatcccctcccaacaaagtagacatttctaattagtccttcatgtcaccagtaaagtgttttatgtgcttcaccaaaggctctatgttgcaatgtacttctttctttcttttttttttaaaaaaaaaagattgcatgggttcagtttgtagccatttcatttagtaaggattagggaagtcggtatataagcattgttgtacacttatactatgatactatgacctagtgagcatggaatatgggtgttgatctccagagcttgttagttctagaattacaaccaaactatgatttagagttcacacaattatagctatggttccccactatctttgtaccaagaccgagaggattgaatactgatattctattgtttgatcagtgctgctggaccgcatacaattgttgatggaaaagaagttgtaaactttgcgtcagcaaactaccttggtttgattggcaatgaaaagatactcgtaagaacctcatgcttttgctaatattctttagtactcttttagaacatttgagtgatgtaaggaaattgcaggattcctgtattggttcggtggagaaatatggcgttggatcatgcggacctcgtggcttttatggaacgattggttcgtaatgttctgttacaacttatattcaatactttgtatcttgtggccaaaagcctaatgcaaattcaggggaggaacttagccattttgttgttttcagatgttcaccttgactgtgagactaaaattgcaaagttcctgggaacgcaagattcaatcttgtactcctatgggatatcaaccatcttcagtgtgattcctgccttttgtaagaaaggagatataattgtagcgtaagtgaacctttttcctcctgtttacaacaatttagtaacatattattcaacattttctaatgaattgagtcgtgccataccatctgatgtaaaatgaacatagatattttattgtagttctggaaattcgtagaattggtaatatggtatcatggacctcgctaatccttctgtgttattgacaaacctacttgaccttctagccatcatgcatttttgaaactcataatttcgaaatggtgaattctttttttttatgcgtgctttcagtccttatatatctcttttcattgttcatatttaaaattattagctagtttttgcatccagaaaaaaaataattcagtatggccacgttcttcataaaaataaatcttgatattcatatgcaatgcagtgatgagggtgttcattgggcagtacaaaatggtttgcagctttcaagaagcactgttgtttatttcaagcacaatgacatggcttcacttgcgagcactctggaaaaactaactcatggaaacaaacgtacagaaaagattaggcgatatattgttgtggaagctatttaccaggtttgtagcttactcatgaattcttttt

SEQ ID NO: 53712 - DNA, 12776 bp, Oryza sativa
  unsure (1)..(12776): unsure at all n locations
acagtagctcatgcattactcatgaattcttttttgctgagaaatacattgactgaatttgtttctaaagtctgtctgctgttctggatacagaattctggccaaattgcacccttggatgagatagttcgattgaaggagaaataccggtttcgtgttattttggaggagagtcattcttttggcgttcttggcaagtctggacgtggccttgctgaacattatggagttcctgtgagtgctccctctcatttcttttcatatatttccacaacagcgaatctgaaacaacaaataaagaactgggcaggcataatcagtggctcagtagacaaagtgcaatttgtattaagaaaatcttccttgttgactagcttagtttgctgcacaattgagttctactagttttctaagtattctttaccgattgcagattgaaaaaatagacattatcactgctggaatgggaaatgcattagctactgatggtggtttctgtacaggaagtatcagagtggttgatcatcaggtaggtgccacatcagatcgatagcatattgatgatggtatagaaatacctgcatcttcagtatttttaactggctgtactgttgtcatcttgcagcgtctaagcagctccggttatgttttctctgcctcgttaccaccatatcttgctagtgcagcaatttctgctgtggaccacctggaggagaacccatcggttcttgccaatctaagatcaaacatcactcttctgcataaaggtcactaattctcttggcacctttatttcttgcttccattaatttaccgaacatagtgcactggtaatatgttactaacctagtttataaaactgtgatgtacttactatgggctatagtcaaagtaccgaaaatacacaatgtttagcatccttacaagtattttgatgtacttgtgatatcaaaattttaggaaacgtctggcatatttcgctgtatatttgtccatccactcatcttttcatttgcatttgatgcgcagagttgtcagatgtacaggggcttgaaattgctagtaatatattgtcacctattgtcttcctcaaattgaagacatcaacaggttctgctgttgctgacctggagctccttgaggttatttcagagaaggtatttagtggtggattcaacaaattcgtgaaaagcacttgagatttgatttttggagttaagccaataatgtattttacgtaattgtaatttcacaggtattgaaggaagattcagtcttcattgcagcgacgaaacgatcgagtttggacaagtgtcgtcttccggttggaatccgcctattcgtatcagctggtcacactgaatctgatatcctcaaagtatctgaatccctgaaaagggttgcagcatcagtgctctagtgacaaactgacaaccttgcatctggcatgatgtgttctacagttacgtacaaatctgtatgctcgttgatctggctcaatttgctgtcgtgtctagcagaattacaaataaaattttgtaaaacagtttgaattaaaatatctggtagtattgttcttctatagtctctgtacatcggctgattcttcaacagtctgtcagttctggcattgttagcacattggtcaacaactcaacatatgcaattcattaattaatagaacaaggaaaaaaaagttcagcccagtaattcccgtgccatacaaagnnnnnnnnnnnnnnnnnnnnnnnnncatgcggatttgggccgatgcgtgtatgggattttcacacggagcatttcaattcccacaggaaaggtgaaattttcctccatttcgaagttcacacggagactcagatttgtctttttagtcatggctatttgcactgaacataacttactcctatctatcatgcggaaaacaatgatcaaatttaagaaccaagcagctttaaaaagccagagcccacatattagtagtaagaatgaagctagccgatttttttaaaatattcttttttttcttctcaattttacagaaaccgaggggaaaagaatatttcgaaaaaaccgaggggggtaataaataaatcaaagttgaactgttcaagccaacaagggcaaggcaggggggagtggggggactgtacctggacaccatgacgctgagcaagtgaggcaggtagtcaggttgtccgtcgtgtgtggttagcagatgttaaagttgacatttcgacaataatgttgtgcacgaaatgacgactgtgacaaagcattcctccatccaagtcgccatccaagggcagcagctgcatgggcctgggcgccgcgcccgccccaactcggtgctttaatctccttcctcctttctaggagtactccttcgtaaaaaaaaatctaaataagaatatgatatcttttaagacaataaatttgaatatgagataatatgaaattatccacgtagattcatcatcatccacatataaattaaaggatgtacattagtccggattttcatcctttaacaaatttagcagaatccctaattaatactcctagttatgctccctttcagcagcaatcaatcccaaatactactttctttagttagttgcaagagcagttgcaactttgcaagtgtaggtgatcatgaaacaaaagcagtttttttccaaaggcgtcacggggaagcaaatcttccgctgctttttctgcttgctgctctgctgctgcacggtgccgccagtcgtgcaggacggaggagggggggagagcggttgctttgcgagcagggtgcagaacgtgattggagccagaggctgcggttgggcttcgctttgctttcacccggttttaccggcagaaatgggcatcgatcaccggtacgacacgcgacgggatcctctgacgtactgccctctaactttgagaggatgacatgtgggacccacagctagcggacccacatgtcggccacccatgttagagggcagtacgttagaggagcagcttccgtaggacaccgggtgcggctacttgcgccaacagacggcccagaatccccaccacgccaccactcacagatctgccagccggtcaggcactcaggctgcttctgttcttcagttttaattcaacgcccaagattatgatactagtagtatctgaatctaaccactaccactaccaacagaacagccgcctcaatttttccaaatccatgagcaccactgcgccagtcaccattgaccatcacagcacatacattggatcatgggaagcatcgaaaaaaatgacaagtgaatcacactccagatggaaatatgcataggtgaactgcagcaattcacagaaattttctcatgtttttggattcaattttcatctgaacaagcctgctacgcactaagagagactaccctcttcttcagttcagccaaaaggtgatcaactgatcactgtatgtacatcggacaaactcgggtagaaagatatagctagctcccaaattccagccaattcaccagagctcgtcatggtcctaactcctactggacacaaacactaataatacgctactaccactgaaccctgccactaatccaagccaaaattcacagctagcagacgagtccttcgcctgaagaaaagctatctacacatggatggagttcatcatcatcctcgatcgaacgaactagcccatcaccgcggctcccccacggctcacgatccaaggatgccctgcaacacgaacaccgaacgatccaatcgttagcaaaaacacctcacattttctggggaatcatgaactgaaattacaaagtggagcaaaatttaaacgaaggaagagggttagtgcgtactcaggacttggtcggcggagaaccttctggagacgtccttgcagagcatgcggcgcatcaggtccttggcctccggcgagacggaggcgaacgcgcgcggcgggaagcggaggttgccgcggagcacgcactggaagacctccgcggcggtggcgccgtagaagggcagggtcccggagagcatcatgtagagcaccaccccggcgctccacacgtccaccttctcgccgtactccctcccggccaccacctccggcgccacgtagtagggcgtcccgaccagccccgtcatcggcctcccgtccccgaaccaccccgccgacccgaagtcgccgagcttgagcacgccgccgccgtcgaacaggaggttgtcgggcttcacgtcgcggtgcgctaccccgcggcggtggcaggacgcgagcgcggaggccagttgcgccacgaggtccgcggcctcgtgctccgggaggcggccgcgggaggagacgagggagaggaggtccccgcccgcgcagaggtcgaccacgaggtgcaccgcggcgtcgtcctcgaaggcggcgtggagcgcgacgacgtgcgggctggccccgggccccggcgccgacgcgacgaggtgcaccttgggctcctgctccgcgagcgcgaggtcgagcgcgtccgccgcctccgcctcccgcagcggcgccttgggcgtggacttgaccgcgaacgcctcccccgtggcgacggcgtagcagcggcggacggtgccgaagcggccgcgcccgatctcgtcgccgatgacgtactcctgcctcagcgcgagctcgccgccgctgctcatgctatctccgcgattctcttctccccccttcttctgtctccgctggtctccgacgccgcggccgcctcgcctataaatgcagccgggaaacgcagcggccaaggagacgaaatggaatatccgcctcgccttttttttctttggctcctagcgaacccttttcttttcttagagaatggtatttttaaaccgatctctaaacttaaccgggatataagtaatcattttaaattgagaacttagccacttaacaattcaatatgaaattagctcttataaaaatttaaactcaggattttggaaggctactcagggcattataatcactaggctacatactctttcgcacctagcggacctacctggtgatgtgtatcgtctcgtattttttccttctctattttccatttaattacgcattagcatagggattaataagctttattagttattactaccgactcatgatttaacaaggaaataaatttgagcaaaataaaaatgagatacgcatctccccagatggatattatctactaaaaaaaatctccccaagatggatgaagtgtattatgttgtcttactcctaataatgtctttcttttaaagtttggagatttgtatttatttgttgaggggattataaaacgggagcagtggacgggttgggtttggttgtttgggcaggccaatggatgttttttgttctaattttttgggataaacaagtgcagaaaccgatgtaagcacgggacaagtgtctgtatggtcggtggggcccaaagaacagcgaattattggggcccatgaaacgtggcctccttggagcgtgatgacgaggatactgtgccactacagtgtccgcatgttatacacatctgcagcgttggacctggccatctttccattctgcccatgattatattgctttttgaaagggaaaaaggtaaagaggagaggaaatggactaccgtctcttctttgtttaagctcaattaatcccccttggttttacaaactgtgatcaaacacaaagttcactattttttatttttattttttgcgaaacagtgaacaaatggtagcactgtctcgttgttggctcgtttaattttcagataggatcgttttgatcgcatcgagctcgagcgatccgatggcctcgtcgacgaatatatatggaattaatgccgccattttgttgttttgtggtgcggtgttgtcgtgattacgattaaacagcttatccatatttggtttttatgacgaacgaggagaggatatgtagggattatatatctgcatcttcatgcattccttgtgcgatcgacacctgatctgcatgcgtaatgaaaacctgccacgattggtacccgtctcgttcgttcttatcaactggactagccaacaaggcccacgacgaatgcatgcgtgcctaagcaggatttacgcatgcatgcaggcatgttgtataaatctttttaccgtagagagattgtctcgattaattacctggtctagatatttacgcggaaaaaaaaggcatcgaaatgtgttcagtggtgaaatgggccattggtattttttttttcttttggcacgagggagaaattaatatacggtcgatcgatcgcctgaagtcctgaactgtagcgtactccctccgaaaaaaaaataaattatgggtttccgtgtccaacgtttgaccgtgtgtcttatttaaaaaaaattatgaaaaaaattaaaaagacaagtcacgcataaagtattaatcatgttttatcatttaacaacaatgaaaatactaattataaaaaaattcatataagacggacagtcaaacgttagatacgaaaacacaaggttcgtcttttttttttatttggaacggagggagtacgcagataccagctgcagaaactcgatcgagaacttacgtcgctgcttcggaatcgccgtagaattccacctacggacgcgctcgatctactgtcagtatcaactgcgcatgcgacgtttcatcgttgatcgttcacgacgcaatgtgtacagtggcttaaaccaacgacaagtggatcgcgaacgctgctgctagcgaacagcccccgacagtgaagccgcgagcaagtcccaccaccgatcgatcgtttcatcgttcgttgcgtttccgccgttgaattgaccgcgcgcgcgggcgctgccgccgctgccgctgcttgacaagaatccgcgcgcgtgctgcactgcagccgcgcgcccacttggacgacgcggtgaatccggctgcgacttcttcccaattcccaactcccaagccggcaaaccgcgcgtttcgaacggacggcgacgacgacgaagctaagctagctccacgttttccaaactggacgcgccggcttcgcaaccggcaactcgatcgtatcgcgcttacttttctcgcattcgcagcctagctaccaacctaaaccgtatattctgcttcaattcagacgtcaacgaacacacagttccggaatctcatcgctcgatccatcgatcggctgcgcttgaacgatagtgagttagtgacagaaagctactactatatgataacaaaagcggaaagtgtgtatatatagatgtacatgcatgatgaatcaaacgaatcatgatcaccaacttgataacaaacgattattatcaaatttatcatgttaacaacgaaaaggcaggcaacggaaatggaccagctttttcatcagcagttgaggccaggaagaaaagaaatggaatatgggttggactctgcatttagaattgctctgcaaacctggctgtgggggctgaccaggcaagtggattaattgaaaaatattaattatttctatagttgcatctccatctccaatctcctcctctcgatcaaaggaccaaatacaaatgctcgtggttggttggtcactgactttagcttagatccaatgaccgcagtcttaattagctggcttgatatatcatttgtgctgtttttttttatctgggtgatagacacctcgcacctaattggaattgtttttacaccactaactaagggaggttatatatatctcatctcaacgtttattttatactggccatataggttagctagcgccatatctaatctaaattcattggctttagtttatatcaatgaatgaatgattctgacaaaaacaaatggtcgtgttcagtgtttgcgcatgatgcaagctgactccgatgaaatgtttgtttctgtacgcatgttgccgaagctagcaggctaggatcaaatctatatgtttgtttctgtacaagttgccaactactgtacgcattctacctcttgtaaattaactactttgtgcacataaacaagtgctccatacctccatacatatacgataaaaacatatatcactgtcaatctgtcatctattctgaagaggtaagccacatattttggaagtctagaatcgacgccggctgacactgcatgctgtgtataatattcttggagcatacataatacaatacgtgtacgtggaaagataaacaaaaatacacgtaaatatcgatcacaagttcacaaccaagttgttatccatatttcgacaagtacattatcccatatgtaaaaaaataaataaattaacttgcatgtttaaaatgatttatcacatattaatttaccatgttgattttttaaaatatttttataactatttgaatgacacgtaaacaacgaatgaatatacattccaggtagctgtacatcataaccggctattaaacaccaatcagttctggtcgtgctactcgtggttaatcagtcattcatttttcttgaatcgtaccaccgctcataataatgatatctttctaccacatcaacaattaaccggttattaccaatcagttcttggcgtacgtacgcgtggttaatgggttgactacgacattttgaaggtatggaaatgtggtgaaacattaattttttttacgctaactcttacacggacgacgagtcatcacgcgagatgagatgtggacgtgagaggaattgaaccgggcgcggccaggtgcaatcgcacgcatgcatgcacctgtgccgagtcgattggatgaacggcgcggtcgccatgtcatgggtgacgtacgccaccttcgatggacttcgaatgcaagaaatttacggcatgaatggaatgaaccaagaatgcacgcgcgcgtgcatgcttcttgattatgtcatcgacgacacaccacatactctatccggatctttggttattaattcctgcagctatctatctagcaatatatattttctgctatgtgtaccatataaattaagatcatctctctctcttaaaaaaacagtagtacgtgttcctgggctccttgcaaaaacagaagaagtacttcttccgtttcacaatgtaagtcattctagcatttccgacattcatattaatgttaatgaatctatacatatatatccatctagattcattaacatccatatgaatatgggtaatgctagaatgacttacattgtgaaacggaggaagtatattgttaataccggtcagggtcagcgacatatattgcctggtgaaatagtcgtgcaggtccttgggagaaatgaatcctacgagactaaaagtggataaattgatgtgtgttctgttttcataaatttgtcaattcatctgtaattttatactcccttcattctgaaatgtaaggcataaccacccttaacctaaagactaagaaaataattattatcatcttatagtttggatcatcctaacaaatacaatgcatgcatccaatagaattagagaacatgagagtggaggatttaaaaaagtactccctcctttcctaaatgtttgacgttgttgatttttttaacatgtttgaccgttcgtcttattcaaaaacttttgtgaatattattcaaaaacttgagtagtagtagtatatttaaccatgaatcaaatgatagaaaaagaattaataattacttaaattttttaaataagacaaacggtcaaatatatttaaaaaaatcaacggcgttaaatatttagggacggagggagtaataatttaatagagaaggggccatagttaattgtctatatgcatgtatgccttatagtattatggaacatctgaaaaagtggctgtgcaatggatggagtaagtatgttagttatcctaagacctaagcctatcatctactacgtgcatgcacgagaccactggtctggtctcgtatgattattttccgttcttgacagagcggcggcttcacgcaaccaattggagacggcaaaggccgtttgttgggcctcatcgattcgtccaaaatgggccaacacagataatcgtccgaaatgggctggccttcaagctcactggtgggctgggggagatgcacgtgatgggctggctcctcggctcgctcgctcccaccgaaccagtaaaacgccaaaaaaaaaaaaacagaaacggaaaaggctaatacgccattaaccacccggcgcccgcgccgcttaattccaaaaccctcctgataaaccaaacctggcgcggtacgcaccacaccatcgctacctcatcacgctcacgcgtctccctttgtccgcactcctcttcgctctctctcgggatctcgtctgatcagctccgcctccgcctcagaattcagaaatccccaaaccccaatgctgctgctgcctcgcagtcgcacggcgaatcggggataagcaccggaggagggatcggagatggaggcgccggggctcgtcgtcggatcggcgctgcgagccgcgcaaccgccaccgccacctcctctcccgcgctccccgcgtggcgctgcggatcgcctcctcatcttctcgcgggagcctcgacctcgactcgcccctctcacccggtgctactgttccaggtacttgcttgcttgcgaagttgcggttccactgcgctggcgctcacgcacccgcgcgcactcgtaacatgtggatgtgggtattcgtcaccgtggctttgtttgggcgtttgatcctcaaatcggtgtgtattccagggaggggaagggcaatgctcgcagcaaaccccatcgcgagggctccaattccgttcggtgtgtgctccgccgctcgtattatctctagattctttttttcagttttattttcactatttgacgcagcgagtggttaatttttgtgagtttgtctaggctgaacgtgaaagcaaacaatgaccaggtatgcattaaaacttcgaatctgtaacacgtttccccacatattttacctcatgtacctgcattctcttatggtttaagaggatcatgaatttagagctgatgtcgcaggaaacatatttggctgatgaacgacacgaaggggttgacatctgggagctattcagccaggctcagagaagtaataactacttttttttttttttaaatctgagcttaccattgaaccacaccagagcagtatcatttgatatttggcgtggcatgcttatggcacttttcaattagagtgaaccatttgcatcactttgttgtttgctaaaagaaaagcgttatctgttctgatggcttcaatttcacagatatcctacaccttaacaagcagcggcttgtggccatggaagagctcaagaaactgcaggatgaaaataaatcgcttctgcaggacatagaagtactggaaacagaaaggcaaggtgtggcggtgataccatcctaatgccaagatacttttgtgaattaactgtgaagatagaatgcgagatgtgtaacatcgagcaattcaatcctgtgtttgatgtgatacttctattttctctttatcattgttagcttaagagaataagaggtaaacgacagacctaaaatttgacgctgcattctccttttacatatttcaggtttttccatagaaatagcagaatcatcaaggttctctgagttgcttctgcgtatagatacaatgaccatttctggtatggttggcatgacagaagcgtctgatttaagaaagaaagttattgacaaccgatacatgatacatagcgtcttttctgatattcatcataaacaagatactgaactactttcagaattgagactctttctgcgtaaaccagcagagtatgtaccactacctcattacatctctcctccaggttccagctttactattgccatattatattcaaagatcctactgcattatacatacatctttcaatctgaataagcatgaaaaattgaaaatgcactacaattttttcgtatatatgccttctgcttatattttgtgctgtataattctaaaactgcatgttttctatatgatgcacaaactacctgtttaatctgagtttctgccatcataactgctacttacaaattttgcatagctacgttaatttaaattactgttttgcaggaaacctctacacgttgtgcacatctgcagtgaaatggatccaataacatcacgtggatcattagcaacctatgttactggattatcttccgcacttcaaagaaagggtaacttggtggaggtcatactgcccaagtatgcaatttctttgtgacaagcaagtgatcaccagtgaactaataattttgtccattttcaaatgtttgcaataattccaattatatttataaatggactaggcataaaaaagtgaaccatttcttgtgggttttcagcaacgtagagctataatacatactacaatgatcattattctaaaaggagagatgttttgtttttgataaatttgttggatttgggattgagctttgtatgtagtctgattttggttgtgtcatatttatgcctcaagtattgcaagcaaagctattgtgttaattgcactggtataacccaaaaacaggtaggctggcataaatgaagatgtaattcatttcctgaggaaagctgaagcagactatgaatcttattatggtggttgttggcataaaaacagaatatggacagggtaaatatatactcagtata

SEQ ID NO: 53713 - DNA, 2251 bp, Oryza sativa
  unsure (1)..(2251): unsure at all n locations
tttcaccaaatgttgtaaatatcccggtatagaatgaaagagtggtggcgggtatatcgaactcaaaaggagtggcgtcttttatttttcgtttttaagggggaatcggtatctatatcgaacttttttttccgtttttgagagggaatcggataggagtcgaacttttttttattatttttttcgctttttttttctttcatccgtttttttgatcggacaattatttttgggaatcagacaaattcattttttccccgatttttcttttaccgcgtcatatttggtttttcttttcttttttcgcacgttttcttccgcccggtttttttggatcggacaattttagtttttttcgccggtcttttctcgcccctttttctggataggacagatttgcagatttagtttttctttttttcgcacgttttcttttgcccggtttttttatcggacaattttggttttttttcgccggtttttttgcctcttttttctggacgttttctttcgctcagttttttagatcggataaatttggtttttttcgcccgatttttttgacggacaatggaagcacctcttatgttttaagtagtagagatagagatatgttaattttgattaatccagatcgaattaattaacatatttaaatatatgtaatgcatgccacgtactgcagattatnggacggtttggattatcatcagcacaaaaaaatgcctactgcagctctacttctccacaacaacgaaagcatgcgaatacactactgcgtcgatttagggacaaaattatccaaacctggaggtaacaagttttttttttcactattcaaattaagatgaaaattgagggtgacacttaatttgcacgtttacttcaagcaaatgtttatatatatgtaactaccccatctacacattatatatagttacttataatatgtgtttacgtcacttataaacattgttacatttacttttaaagaattatatatatatatatatatatatatatatatatatatatatatatatatatatatatatatataagatgaatacaatgaaaaaagacaatactagtaactattcaaatggagttgaaaaaaacaatgcaagcatcatctacacctgatcatcgacatgaaaggaacggccgtgaaacaggaaactaacatgactatagaattaacatactttagagcaacttgcatgttttgtgttctgaggaagaattaagtagtcactcgaattgttaattaatttttctagtaataaatagaaattaatccggtatgtagacaactaaagtttaaggaaaaaaatttaaattccagtcctcacaactgagaaaaattacagataatttatttagagtgtatatgcacttgtactagtaattaatttgcgtctgtcttttttttttttgaattgaaggcatgaagaaacacgtgagatgatactgaatgtctctgcaatgctgggtttggttgctgtcgtcgccgtcgtcggatgcattatgaagccccactttgaggcccagctagagaagcttgcccaagcttttgttttgttgtttctactggctctacttcaagcaatggtagaaatgcaaaaggaacgacggcaaaagagcctagaagatgatcatgctgatgattctgaagagagcaagaagaagctgaagccaacaaaaacttagaaacttttagtagaacaagttttacattgtgcaaccatgcatgcacataggatcaaaataattatgtatacaggccggggagtagtggattattccagcaatctacatttttgttttgagaaacacagtataaatataggcgctcacaacatgtataagttcacatctataaacatacacatatatacacaccataccccgttacaagatatacaactttttaccaacagtgattaagtaataaacccacggtttcaaaaacattgtaggtgattgtcaagttgatgataatgtagttggttattttatagtctcctatagtctttttctgatctccaataatataggttgttccgttacttgttgaaaacggaatacctaagtgcaacggattagttgacagacaaattttgattagctcgtattatatcatacactttccgttatcggtnnnnnnnnnnnnnnnnnnnnnnnnnnnnnnnnnnnnnnnnnnnnnnnnnnnnnnnnnnnncatnagttacgttcaatttnnnagacagtc

SEQ ID NO: 53714 - DNA, 826 bp, Oryza sativa
  unsure (1)..(826): unsure at all n locations
ncatctagggtttctaggggagccatctatttctttttctctatttctctcactctattagggatccaacgtgtttggaactggtgagtttatatatgtccttggctaaaaattttccccgcactctgatctgtagtgcatacctcatgacaccacaacaacgacacggggtcgcttttacccttaaggcggacgccataggctcgagactgaggcggcgggacaccctaaaagtcgctgaccgccacattgttttcgcgacgccacggttaataaccatggtgcaacatcctccaatgtaataacaagattaacactgaattgactccacaatgctactatttgttttaaccattcaaaactgaaaaaaaaaacgttgtgccagaggcagtaaatatttacctcctcaatccaagttccaaactcggatcatgcctgatctttgaatactgtgcagaataggcagaagagctacaattccttttatgtgttagtccaaaccgttgaagaacatccctcacatataatcccctctttgcgaccggattgtagccttctccaatctgtcatttaaaacatcatgcacgtatatacgatcaaagggagtgtaatttgggcttattattaatttgatttgggatcgtatataccaatatatgtagttaaaattagggtataatttgttagcagtaatcttgtgtgccacggttagttagttgattagttatctgcatgtttccgttttttttctgaataaacgcatggggtaccgagctagaattcgccctatagtgaatcgantagttcatcaaanggggggcccacg

SEQ ID NO: 53715 - DNA, 1020 bp, Oryza sativa
  unsure (1)..(1020): unsure at all n locations
cgcagcgaatagatggttttatggnnnnnnnnnnnnnnnnnnnnnnnnnnnnnnnnnnnnnnnnnnnnnnnnnnnnnnnnnnncttgaggatctccaccttggactcacgaacactattcgtgccttcatgcaagttccgaagcatgtcccaaatcactttggcactctcaatgccatccacacggttgaactcacttccactcaaggcgctaagtattgcattagcggcttgagcgttcttgtgcttgttctcgtcgtcctccttggtgggatcttcgggattctgcaacacatagcctttttcgactattctccaaataaatgggttaatagacttcaaatgcatattcatcttatgcttccaagcggcatagtccgtaccattgaagtacggagctttgccgctataggtactcacataagatgtagatataggtggatagtcataaggaaatatagctcccttatcaccatctttgccttcccccgtttggcccgacatgatctctttaagcggttaagcctaattaggagattaggctctgataccaattgaaagtgtcaattaggcctagaggggggtgaataggctaattcaaaaatccaattaaaagcggaagcagtaattttcggatatttccgaaatttttggatatatctgaaaattttcggagtcagcacaagtagcaaagtaaatcctagatctagttgcctacaacaagaatatgctagcacaaacagcaactatacctatagcggctcaagaaagctaagctagtggagagggaggaagtaaagtcaccaaagatgaagctcacaaagatgttcccgaagttttttggacatgtccgaaaattccagctcagcaccaacagcaaagtcaacgagagatttttcggacattccgaaaacttttcggacaagtccgaaannnnnnnnnnnnnnnnnnnnnnnnnnnnnnnnnnnnnnnnnnnnnnnnnnnnnnnnnnnnnnnnnnggtcctaactttnncaacggcg

SEQ ID NO: 53716 - DNA, 1257 bp, Oryza sativa
  unsure (1)..(1257): unsure at all n locations
cgccggcagggttggacagccctcatnnnnnnnnnnnnnnnnnnnnnnnnnnnnnnnnnnnnnnnnnnnnnnnnnnnnnnnnncctcggcccatcagggcccgatagtgaacgcgatatataataacaccttctcccacgcggctcactcctcacccttctcgcgaaaaccctaaccccgccgccgccgccgctcttggccacaaggtaggcggcgccgccgttgctcttcttgttcctccgcgtcagtgcgccggcggtcgctaatcgtgctgagaacgcttgttttccttgttgcagatcgtttcgtcgcagtcggtgttccggtcttttgagcgcggagatggcgtaagttcttgcaaccaacttcttcttggcctctgctagttccatgttttttctctctctatcctcgtagcattttggatctagcctgttcttgctgttgctgctgttggtagaacactgttattactgtgtaattgttgctgagccttggctgcgctactgctcgctcaagaatcgtttggtcttatcatgtttgagttgtccttgattggggaaattgtcatttggtttccatttcgatgggatcattgagtgaaaggatgtgggagtcatgagtgcgattgctcggatttctgctgtactggtatggggtcttggtgatttagaatttggcagctggtagtatagttggtggattcgttgtatgtgagccgtctagtttagcaaatacaatcatgattcatatcagatgatatgtgcctgttctgtactagcaccaaggagtgtagacggtaaattcacagccagattgaaaaaaaaagctcaattgcttatcaaactatgtttatatggaattgaattatccaacttaattgtcttgtttgcatccaagaagtactgaatttgtacagtgtcaccagtagtgagaaacaatgcattttttatattatgggtgctcaattcttgtataaatgtaacaccacgtacatgccaaagtatttggacctccattattgaaagagcagtcaaattagaagagaactaaaaataccttgtaaagtgtattactagtaattgttaatagatgggtatcctgcntctcggtctaaaaaacatctcacgtatttgtagcgagcctattcataaaaaaaagaggtctnncctcttttacagaaggtccctctnnngtcgncctgcgnccggtctttctcnncattnttggtgtgctaacaaaggggggtactttacc

SEQ ID NO: 53717 - DNA, 1356 bp, Oryza sativa
  unsure (1)..(1356): unsure at all n locations
aggggttgattagggtgtgaccaccccccaaaagggggaaaattgtggcacgacaaactcccaatttttccatcccagtgttccattttcaatcaaacttccaattgaagcgtaacttaacacaccggtacccaaagcataccacagattaattcctaaagattggacagacacgagcaactcagtcatacgcaaaccacaccaaatggcaaacagatcctcagcttcggatgatgatttgtattaaaagcagacgattttcagcacggtaaacataaatccagaggttcaattttgctcatatctcaatggctcgcacttaaaagaattcttatctcctagcaagacctagtctcaagcataaattaaagcaaaaggtacagaatgtcgagcacacgttctgggataaacaaaataagcccttgtttagttctagctttttcgtcacatcaaacgtttctacacacacaaacttataacttttccggcacatcattccaatttttttgaactttcaattttagcgtggaactaaacatagcctaactatttatgtgaataaaacagaaagaaacgcaagaatttataggcctggtttagttcttactcctgctgaatgaagaggactttcattgccttatgatatcgttgtctgcgtacacacccaggtctccagctccatccttcacagccttgctggccttcacagtgagcacgcgagggcgaagaagaagatgaaggcgcctccacgacggacatgtcggcgggggtggccacccgcggcatggtggaaccatcgccccggtagatccttgccaggcgagccaaagcgatgtgggccctttgggatcccaccatgacgcgtcgaagcgccacggccaccccgacgatcttggcgcgcacggcggcgaggacggtcgacttgccggtggcggtggcgaggcccctgctgcaaacggcagcgagggcggtccactttgcggcggtggcggaggcggcggttgcgaggcccctgctgcagacggcggcgagggcggtcgactttgggccggttgcggcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatn

SEQ ID NO: 53718 - DNA, 1472 bp, Oryza sativa
  unsure (1)..(1472): unsure at all n locations
cgctgtcnnaaggtacgaccgcttccttnnnnnnnnnnnnnnnnnnnnnnnnnnnnnnnnnnnnnnnnnnnnnnnnnnnnnnnnnattctaaaatttttctttcggtcactactgcaataacaactttttctcacagccaaaacaggtttttttgggcagtcagcggcgccgccaacgacctaagattagtgaaaataataaacttttgctgatgagcagccggccgccagcgaaaatcaactttgacaagtggctaagggaaaaaggtcgcatatgaaaaagtgattttcgctgatggtagctagagagacccaccatcgagaatgtttttaggagaaaaaatattaaaaatcaggatccactatcactgtctcaaattcccaatccccaaatccacacgtcttggtcgatgaaaaagtcgacgtcgtcgatggcggtgtcgccaaatgggtggaagacgccctttcgggagccgccgagatcaccgctgccggttcaaagaaaggaggtcaggccagctcagatctggtcgggaaagatgaggaaggaggtcttggtcgatttctctaagccatttgtcttattatcgctaacctgtagccaccagcagattcagagatcccaaagaccagcaccactggaactagagctctcgatgcctaccaccactggatccacaagctagggactcccttgctctactactaccgccctcccctttcgccgtgtggttgagctcttctcgagtagggattgatggtggaggcagcactccccttcaaccgccatagacgaacttgtcatcaccggatcaggtgtcntgctcctccaccatcactactttctccttgccaccgctgagcccgccacggttcccctttccactgcgaagcctggccgttgttggtccttcctccaccatgaagtctcctccctatgctgccaccaccgagcccagccatggcttttcttgccgccgtcgccgccatcaagccatcgaagcaagagagggagaggagaggaaatggatgagggaggggatatctaggaagtggttgaggaagtggctgatggaaaagaaaaagagatagttgagggatgggataaggacgacttgatccacacgcccttctcctatgatctttttgttggtggtaacccttagactccgctagtaaaaatggattttcatatgtggggttatttttttcaagtagtgctcttaagactctgcttgtggaaatccatttttattggtgggaccaagttttcaggtctgtttttattttacaagcgaggttttttatggccgctagtgaaaataaatcttaagggtcatgaaagatccttattttttttaagtagtagtggctgcacacgtgcatnnnnnnnnnnnnnnnnnnnnnnnnnnnnnnnnnnnnnnnnnnnnnnnnnnnnnnnnnnnnnnnnnnnnngcattcactggggggca

SEQ ID NO: 53719 - DNA, 1674 bp, Oryza sativa
  unsure (1)..(1674): unsure at all n locations
cgcnccgtnnnaagtggacttcagcttcnnnnnnnnnnnnnnnnnnnnnnnnnnnnnnnnnnnnnnnnnnnnnnnnnnnnnnnnnnnncccttggcttgctctctctctaacacttttgagccttgctttcttgtttcccctctcacccgtgttcgattcggatttggtgtgtgtgtgagagttgtggattcgagtttgggtgagtgcttgtttgttgacttcgtgaagatttgtgagcacttgcatcatctccgggagttctttgcttcatttgttactcttggaggttgaggactccaaagtggctaggtgtcgcccccgagccaccgatctacttgtggttggccgggaaaagtttgtgaaagtcggatctcacctncgaaagggaagagatacccttagtggaaggaagagtgcttagtgcaacctctagaggaaaagggttagctaagacccggctcttagtgagctcctcaacggagtgtagaatcccctcaaggattcaaactntgggaacatcttcgtgagcttcatctttggtgactttacttcctncctctccactagcttagcttgcttaagccgctataggtatagttgctgtttgtgctagcatattcttgtggtaggcaactagatctatgatttactttgctacttgggctgactccgaaaatttttggatatatccgaaaatttcggaaatatctgaaaaatactgcttccgcttttaattgaatttttgaattagcttattcaccccccctctaggcctaattgacactttcaatgtgtattgaactctagccttagtatccggcatgatctctgaacaccctgnacgttgtcttatctccaagcgnactcccggtccatcacggcaaatactctcccggtatcaattcacctacacatgaaacaaacaaagaaccatattctgagaccaagctatccccaacttgactcattgttagcaaacaacagtattacatacggatagtatccatctagaagtcatattcatgagataaactcagatatccaaacaaacaatccgaaaacgaaaccgacatagtgtcggccggtcagaccgcgggctggccggtctgaccacgcgtataccaccggtctgaccggcaaccactacccggtctgaccggtcacataaaataacaacacctgtaatttacctgcaaatgcaatcatctacaaaaccacttcgagaataatattccaaatatcaaaaccaataatctccaatgccaattgttcatcacaaaataataatcaaaaacacctttgattttacaagttcgtggcgccgctgccacccaccccagcacccgacgtcgctgctctccccaagcgccgacgcagcgtngncaccacccacccccagtggccgacgtcggtggtcttccccagcggtcgaccacaacggttgacgccaccggccggcaacaaccccaagccggcaactaacgaaccacctatggcgccggccagcaatgagcatgaactccttcccatggtgctggtgagctcaagcttcgtttcttcggccggaagcttcttcttcgggttgcaggactggcgtgggcgagcttggtccattcaccggcgagctccttcgggtcttccccgtgttacacggggagctcaatccccatggg

SEQ ID NO: 53720 - DNA, 2107 bp, Oryza sativa
  unsure (1)..(2107): unsure at all n locations
cgccgcgcatgaagtgacgcactnnnnnnnnnnnnnnnnnnnnnnnnnnnnnnnnnnnnnnnnnnnnnnnnnnnnnnnnnnnnnnnnncaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcgattttggaaattcatttagttcgcaagcaccgacccaggtgtcgggttttccaagtcttttgtaaaacccaagttttacccaagatgtttttttcagattttaagtttgaaggcggccgtcgatactcgtgcagagtgcacgatttccgaggcgcaactgggtggttacaagggaacatggtataacaattaacaaaggaaggatcaaatgcaacaaattaggtaggtccgtcaatctgccttgcagacgggacaagcagattaagtgcgatcctatcaatgcataataatctttcaagcaacataattaagttcaaatataggctcaagatattcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcgtgccattagatagatctcgagatttgaggaattttggaagttgaacggagtcaaacggacttacggttgggaagatattgaatttataagattattggatttttggtctaaaggaaaaggatttacttaaatcctttttttgaaaaagaaaagaaaagaaaagaaggagggggaaaattagacttccctcgggaggctagggcgcggcccgagagaaaaggggcggctcggccgagctaaatgggccggccggcccaacaaggcggcccaaagcgcgcgcgcggcgggggagaaaagagggagccggtggaccgggctcacctcgcgtggtcccgagtgggacccgcttgttggtgacacggttcaccgtgcggaacgcgcacgcggcgcccgctagggtttgggggaggnacccggtgcacgcgcgcggttcgcggaggacgcggatgcggcgggcccacgcgcagcctcacggctcgcggtggaccgcgcccgcgagtggggccgaggggagcggctgaccggggtcggctcgacccggtcttggccgagctggcgccgacgtggctgccacacgggccggcgggaggtagacgacgacgccggccggaacggacggcggacgacagcggcgagcggcggagcgaaccacggcgatacaggcgaaaacgagcacaccgggtggttgcacgggacgagagaagtcgagccaacggctcggattcgccgaagggagctcgacggcggcggattgcggcggcggcaaccggcggagagaaaagggtaaaacgtcgacgaggtcacgaggggccgattcctggcggcgagagcttctacgcggctacgggaatccgtcccttgcgccggattaggaggaaacgcatcgagggaggccggcgacgagaggcgcttccgagcttgggcggcgacggcggcgagcacacggcgagcggcggcaacggtcggggcggcgccggctagctacggggaggctactcgtgctactacccgagtctaaggggaggaggtggaacgaggaggaagaacggagggaggcactaccgtgcgggtgggcgcagtgacgagagccgacggcacgaaacgtgatcgtttcggcctctggccgaggaagaggagggggagggnnnnnnnnnnnnnnnnnnnnnnnnnnnnnnnnnnnnnnnnnnnnnnnnnnnnnnnnnngtgcgtcaagccttcatgngcgcg

SEQ ID NO: 53721 - DNA, 817 bp, Oryza sativa
  unsure (1)..(817): unsure at all n locations
cgcatgtgnnnaaggatagaatatcaatcctttgaggccgccactatagnaatacctgaagcgttggctgcgctgcaggatcgacttctaggatggactccccttagcttcagcgccaatacgggcccatttgtgtgcatggcttttctagtttggggccacatttttcatcttctgtgtcacatattggaacctttcgttttgatatcgctccttaagaaaatactccagagtttttgcagaggtcccatttgaatcacacaatcacgactttctaattagaaattttacagtacttaagaaaatacatgagatacctaaattttacactaaaagatttggtacctcgagatacctagcacgtaaaggtatgaaattttatactttaaaatatggtatttccctgcactttttaaaggatgataaaattacccttctaatcaacttagctcgatcattttctgttaaaaacgtagctgtatcattaattatttagctcaacacaacctattgctctccatataaagtatattctctgcgtcaaaaataattaaatgacgttagttttcttttactatttctaggtgcaaatttaatcatgacttttttggaataaactcataaaatctaattatcttatgagattacgaaaatacctggnagtctatattttttatgttttcaaactaaagggatttaaaagatttgttgatcgtcaaactctggaaagtttggcttaaataaaaaattaaaaagagttatttttacctggaggaagatactcctgcctttttaaaaatttgagattctttgaact

SEQ ID NO: 53722 - DNA, 1525 bp, Oryza sativa
  unsure (1)..(1525): unsure at all n locations
caaaataatttcccaaggtcaatcaaagggtcttttttggtgcttntgtcacatgcctggcaggatttatatcaagccagggaagaanatnttcccattaaactgcaggccctatttgttcacatgtatgatggtcatcnccatgtaacaaagagccatctgaaggctgcagctgaactcatccaatcagtctctgtttatgggcaactagtattaatttgcacaataatcttgtgaacgatgctaaacaattaattagtaaattaatttggatcggatagggcgcaaatatgttccccatttcaaagtacactactgtcgagtattaggagcttagtgtgacgcccccacactcttccgaggcctcctacatctggcagctttcataggatatagactattcctcacagaccaacactagtcttttctgcacactttgtcctcactcgtgcgcacccgaaaagaatttcccgatcggtcacccatcccgacattgctctagggcaagcacgcttaaccttagagttttttcgagatcggctttcggaaaagaagttgcaacttgttgatagcttaaccttagagttttttcgagatcggctttcggaaaagaagttgcaacttgttgatagcttaacgcttccggaaaagaagttgcaacttgccgatatgagtattttattaatcatattaggatatcacattctcaccccccttaagataccgacgtcctcgtcggtcaacccaggccaggaacgtcccctattagcaccacgtatatacaagacaattttcggcgcacatacgtcatgccatacgaccacttcgtggatcatcccgtatgcaccgtatgcccgcgtacatgttcatatatatacgtatagctgcaagggtcgcgtacatgttcatatatacgtatagctgcaagggtcggctctgataccaacactagtcttttctgcacactttttcctcactcgtgcgcacctgtgaagaatttcccaatcggtcacccatcccgaaattgctccagggcaagcacgcttaaccttagagttcgagatcggcttccgaaaaagaagttacaacttgttgatatgagtattctattaattctattaagccctgagccaggatatcacacttagctagtataaactcatcgacaacagacaatgttctatatatatatataactaattaattaacaggatcatgttagagctcataataatactagtaatcaaagcaaaggactaactaatcaatcatatactccatccataggcacaaccacccttaacaacctaaagatcaagaaataattattactagttaatgacatgcatgtatgcacgccttatattataaataacttaaaaattagttgtgcctagtatgttatggaatggagagagtataagcatgagnnnnnnnnnnnnnnnnnnnnnnnnnnnnnnnnnnnnnnnnnnnnnnnnnnnnnnnngcttaagacgacgngcgtataatgaaantcaagggcgcg

SEQ ID NO: 53723 - DNA, 1511 bp, Oryza sativa
  unsure (1)..(1511): unsure at all n locations
nagtcaatagatcgcgggtaaaatacattcactcaggacatacctccagctggggaccaagatgtcaatcccgtaaatataagatgtgctccacatgactcgcatgcaattttgtccatttcaatgttcacccagcctcttcgagcacaagccagtgaactagcagcctgtaaaaattaagctattagtttcttctaaaacaaactggatttgtcattttcagtagcatttttttcctctttgcaatacgagacatcaaaatggccgaaaataactttatctaggtaccataaggtacatgctaagctggacatttcagaaagtgatgtactggttcaaaaattatcaaacatatgcctgatctggatttcagctgggcatttgggcaaacatgtcatttgccctatacattgtaattcttcatttagacatggatatgtaagcagctaggtataaagaacacatctaagttacaagatgtctcctgagcattaccaatatgcaaaaaaggactaaagagaaaatatatgagacaaaacttagtgttgtatgtggcatatggataaaaattatactccctccatttttatttacatgacattggttatttctattttgaactaagcgtcaaataaaaaaaacagaggtagtatatctttagcttcagacttccattaccaaccttatcatgtttctcagcattcacttatatacatcctctgagcgaaaaatgttattcttaattctaaactggtataaatgcaaaagggtaagattgagcggcttgccaattacaaattacaatcacagaaaataacaaaaaaggaccaactagagaagagaaatgacctttggcttagaagcccatgttgaagacttgaatgtggccagtcgccgaagcaagtctcctcgttcccatggtctacaagatggttgagagaaatccacggcagctccagcagcattagtactaagagaaggccgaggagcatgtggagcaatctgggatgatgattccactttggatattggctcaccacctaaccaatctatgctagctgcatttgtttgtgcaggtggtgatgatgcaccagccgaactgtaaataagagaggaatgagcttcagcatgcacatacaccagaatctatgtggagagcatacactgaaaacgctatactgttctgaaacaaatcctatcaatatatatcattggaacattttaattacaacccaaccatagtaaccaaataacgataaaaaatgatagtacaacagtttattctatctaaaaatggtaagcattccaaatttggcaaatatccaactagttgggctcaagatgagactacgtaagtaaatgaccacaaaaacatgtattttgacaccagtaaaaagaacatgtcatcagtgtgaagaaccacaacaggtgcaannnnnnnnnnnnnnnnnnnnnnnnnnnnnnnnnnnnnnnnnnnnnnnnnnnnnaagggaaaaagaaatcatggccgg

SEQ ID NO: 53724 - DNA, 783 bp, Oryza sativa
  unsure (1)..(783): unsure at all n locations
ccgcgcaatttgagtgcattcttccacnnnnnnnnnnnnnnnnnnnnnnnnnnnnnnnnnnnnnnnnnnnnnnnnnnnnnnnnnctgattgttaattttgtttcgctgccctcgcaaaaaaaaaaaaaatttgtttcgctgcttttgctgctggaaagaagcagtagggccttcttttttgacttcacgggtggagtgaccggtttaccctttgaagccgtgtccttggcgatggagagtgatcgaggttgacaggtggtgaaaatacggggagtgtttgggatgtattaaaaaatggtgttcaatttatggaaagattaaagtatttatcaagtgtattaagtgtgacaagtaagaaaaacacgcaataagttatttagataaatagtacaaactacatgtttaagtatgaactccctccatctcaaaataaaagaaactggatgaggcattttctagtagtacgaatatggatagcttattttttaatcctagattcttatattttgggatggaaaagtatagggttaagaaaatttaagtatgtatccgtttaaattaatacacatttataattataaatgatgaccgaagtgtaaactttttttttgaagcggggagaagatgaatttcactaaatatgtactactatatattacatttatgtagaaccattcgacatcgtgatattaaactttattaaaaaaaaataaaagggggagggggacgaacttcagtaacatgtactaatagtttattacattcgtatagaacaattcaaca

SEQ ID NO: 53725 - DNA, 1018 bp, Oryza sativa
  unsure (1)..(1018): unsure at all n locations
cgccttcnnnnggatgaactcccgtctnnnnnnnnnnnnnnnnnnnnnnnnnnnnnnnnnnnnnnnnnnnnnnnnnnnnnnnnnnnnnntgttttgtttgttcacgtttagctgaggagggttcatgtgtatgtggaaaaggttgggttggttgaaaattcgcatgtgagcaatgccctgattgatctgtatgccataataattaaatccacccgagagataatctcgatatcctcatatacatgacatattattaatatacgaagtacacgtacgtactctttgaaagtctccatttattaatatgtgcatatgttagaataaattaccttgcaaggatacccggataagttatgcataactaatcaacaaataattgcacatatatattagtaagagatattattttggggatctttgatgatcgtcgatcacaccatcatgttagcttttatatatacatggactggaggtagctgcatatatagatcgtgtatgaataattaagatgaataatatttgttttagaagactagaagtagcagctaattaagatgactaattaattgctgatcgagattttgcagctgcagttcttgacttgctcttcttttttttttctctgaaacaaaaattaaaagcaggcagtcaggtcaggtctttgccgtgcttggacaggttacgagtgtacaaacacgtctagattcagacgaatgtttggatctcctatatccgcaggttgtttccgtataggacatggtatgtggtggatcctgccgagatttagtcaactactattaggtacagggtatctataaccctgacaattagggtttttatccatgagtaaacgggcaaacaagttaaattgccatccctagttccgacacatgcataaagtattaaatatagaaataacaataattacacagattacgtgtaaaattacaaatcttttaaggggtaccgagctcgaattcgcgcttagatgagagatgctcatccnngggggcccatc

SEQ ID NO: 53726 - DNA, 764 bp, Oryza sativa
ccggcatgattgcactcgattgacacaacaaactaagctttttgcctgcaggtcgactctagaggatccccttttgcgtgggaactacacacaggggtgtgcctacgttatactaccggtgtcacaggacaccgggtagattattcaaatcctatataaattacactatattaattaatatattagtcaataattagatagttagtatgtattggacccccggtaatttttgttctgggttcgccactgactacacaggcctaagttttctcgtgaagcaacaaatcctgaattcctgtattacttaatccaagagatctccacgtaaatatgtctatcttttttaactcaccatgttgatcagccgccattcttgatctatcaagaaccttgtcatcaggatgtcctacttggagctcttgacgattgtttgccataccaccttagtacagtacaggtccttgaggtgtctttgtactgaacattacccagtacagatgcatgatcttcctagctacacggaccctgcagcctgtatcccggtcatgtcgtcgatcttgtatttgctttcaaaaaactgtatatacatacatgcatgcacagacttacattgtgaatatactgtgcatgatcttgtatctttgtattggagaagactgccataccatgcacaggattgattgattagcttggttttttttttcctagcttaattgccattgaattaatttcaccatattattgcaataaatccgatcttctga

SEQ ID NO: 53727 - DNA, 1973 bp, Oryza sativa
  unsure (1)..(1973): unsure at all n locations
cgatgggnnnanggaataggcacgctcnnnnnnnnnnnnnnnnnnnnnnnnnnnnnnnnnnnnnnnnnnnnnnnnnnnnnnnnnnnnnnnnnnnccgccgcccaccgtgccatcgnctatacatacccaccccccacccacctccttgtaagttgcaacctcccgcctcacccgccgccattgacgaccaccgcgctcgtcccatcccatgcctgcggccgtgaccgcgaggttgtgaggagaagagagtcccaagagaggaggatcgatgcggcagcggcaggccggcgagcaggaggcggagctgttcgtccagtggaggccctgcgacaagaagcggtcctagtcgcccgccgccgctcgcccactcggcggcgtcgtcgatctgagagggacaggggaagaggaagaagcagaggaggaggaggatgagcgtgtcgggcgggaggacgcgggtggggaggtacgagctcgggaggacgctcggcgagggcaccttcgccaaggtcaagttcgcccgcaacgcggactccggcgagaatgtcgccatcaagatcctcgacaaggacaaggtcctcaagcacaagatgatcgcccaggtcagctcacccatactattttctatccccccaatcgattctcgatttggagaggtctccatggatttcttcccatgatgatagtactggtcgaatttctcgccttcttgtttttttttaatcatatcatacgctgttcttgagtgaatttcgtggacaatttcaattcctatacgtacgagtcccaaatcatgaacagtttgtactactgctgttttgtttcctctcacgacaagacgtgatgattttgttttaaccagaaacagtaaacattactaattactactagcgttcttgctgcaaaaaaaaaaaggtttggtatcgttccaaaattgcgttcttactttcaaaattgcaacagcctagactttgacgtgaggttagcacgggcgcctcgtgcagtgttcgttggaacttgtgctgagttagttattattaatgtgcatcaactttggcttagcttctgactttttgtgggggagttctgactttgatgtgtgtttgtggtttgtgtggtggtgtttgcagataaagcgcgagatctccaccatgaagctcatcaggcaccccaacgtcatccggatgcatgaggtttactaatctccaatcattaatctcagctcatcttgcccatggaaaaattttgtaactgatgataagtccaccaatgaaatcgactaatcataagcagagctcgtgattttggttcgaaattttcgaaatttcgggtctaccagtgggtcctggttggatgtgattcccagtcttgaattgtggattttttttttaattttgtaaaatttgttcgaattcagctagagcctgttcaaaattcattttttttctggtttgaaacttctgaaaaattttggtcccccccagattttttttttctaggccgagattgtgaaccctgctaattaagttaagatatggttctcaaggctttgagcaatctgaaattatgaaaaaccagggtaaattaaattggtcaaggatgacataatgaacaagttgttccttcacatgaaaagttgcaattagagatcgttctggaaggaaattcctgtgacactaaactatgtgttatctgaaactttcctagctcttgctttctgatattttccttttgttgtcttggctttatgtcgatctccacttagtggttttgttttcttctctgaaggtgatggccagcaagaccaaaatatacatagtgatggagcttgtcacccgtggtgaacttttcgacaagattgtgagtgcttggccttttctatcgacatctgaattactccttatgctatgcacacatgttcaattngccataaatcctcgtataggctttcgcgtgggaaggctgaaagaggattn

SEQ ID NO: 53728 - DNA, 2529 bp, Oryza sativa
  unsure (1)..(2529): unsure at all n locations
naaaaccagtgattgaatccacaaattcatttccagccgaaaattttcgtgctggaaggaagtgccactcccaaagtaccattttttggatgagggccctgtccaacaggtaaaagtaagtattttgcctctcccaattaatccttaaataacctttggagaagagtttcctttattcaaaagtaataaaaagccgagagttgttagtcgtaaaaaaataagcatttcaattgctttctgtagattccatttgttttctacatcttttcacatggtaatacagatagtttcagatccatctgaataaagttcttacattagtgctgcatatctttctgtttactctgcaggaggatggtctgttgcacactacctgtggaactcctaattatgttgctcccgaggtaccttcttacactcatacattaaactagtatatagttattatcatcgttggattgaatatttgttttcatgttacttatctaaaaaaatatttgttctcatgtttcaataatattgtctgtgcaggttatcaacaacaaaggatatgatggagccaaggctgatctgtggtcatgtggagtgattctctttgtcctcatggcaggctaccttccatttgaagactcaaacctcatgtcactttacaagaaggttggtccctcttaaccatgtcaaaggattgttggtttatgaaccctaaacaaagtttttgtttggaagattaatgtgattattgctcatccagatcttcaaagcagacttcagttgcccgtcttggttctctacaagtgcgaagaagctcatcaagaaaatactagatcctaatcctagcaccggtatgttttgcagcattttacccttcatttctttgaagcattcttatacataagtagcttatcccatcgttatctccttgtgcagaggattaccatcgcagagcttatcaacaatgagtggttcaagaagggatatcagcctccaaggtttgagacagcagatgttaacctggatgatatcaactctatttttaatgaatctggggtaagctctcacaccattcagctcatagcattacattcttcataatgcactggatgggcttggtaacatctattctaactaacgcaggaccaaacacagcttgttgtcgagaggcgagaagagaggccatcagtgatgaatgcttttgagttgatctctacatctcagggtctcaatcttggcacactctttgaaaagcaatcggtacgatcacattcttaaattggtcattctgaagtctgaactaaacatgttcaagtacacttacagtcatgagttataatctaaaatgctaaaccaattttctttctacttttagcagggttctgtgaagcgagaaacaagatttgcatcaaggctgcctgcaaacgagatattgtcgaaaattgaagcagctgctggacccatgggctttaatgtacagaagcgcaactacaaggtaactaatccaaaattccacaacttgtttctaccatttttatctgaaacaattaacattctgatgacacttttatggattggaatcagctgaagttgcaaggagagaatccaggaaggaaaggtcagcttgcaattgcaacagaggtacaccaatgatacaacatcactatttactatgttctgtcattctatatgctgtgcagcttgtgctactactctttcctgggtttatagactgaaatcagttcatccatttctaaaggtttttgaagtcacgccctcgctgtacatggttgagctccgcaaatctaacggcgacactcttgaattccataaggtacacataacagtaaaattactgcaggacctcacagttcatacttcagactgggattcggctaactcatggtgtaattttttacgcgtttcgcagttctaccacaacatctccaatggcctgaaagatgtgatgtggaagccggagagtagcataatcgcaggcgatgagatccagcatcggaggtcaccgtgattggcagtttggcaccaaaagttcagtgatagtataaagtagataaccagccaggaaaacctactaaggaatggcctgtggctgtttttttttttttggttctttttaccttttaagttgagttactatctaatctagacatggttgtaaacaaagtttgtatggagatggaatgtgaatgaagaatgtgcatagttttgcttccttgacttattttaaaagcagtaacctgtgaaatccgatgaatgaaattgaaatctgcagcaggatgcctgacgatcgtagaagacttgcagcagatatgagattacatatatcctctttatttcagttttgatgcaattcgtaaatcgcaaggctcccatcggatggcctattcagccaaagaaaaagccaaaatttaaattttcaaacttaattttgannnnnnnnnnnnnnnnnnnnnnnnnnnnnnnnnnnnnnnnnnnnnnnnnnnnnnnnnnnnnnnnnnnnnnnnnnnnnnnnnacgg

SEQ ID NO: 53729 - DNA, 1449 bp, Oryza sativa
  unsure (1)..(1449): unsure at all n locations
nagggtacaggcttgcaccnctgtatggataacaaaaagtacgtatcttagcactgtcgaaaggtgtgtacatgggtcatcatcgattcctgcaagcaanacacccaagtacggaagaaaggcaagcactttgaacatacggcggaccaccgtacgaagccaaaacatcgcagcggtaaaacagtgtttgctatggtgaaagatcttaaagtggtgtttggaaaggggcctggcagccagcctatagaacctttgtaagtttttaaagtatacgaacacgtagactaataataaaacaaattacaattacagattccacgttgtaaactgcgagatgaatttattaagcctaattaatctgtcattagtaaatgtttactagagcatcatattatcaaatcatggtgtgattaggcttaaaagattcgtctctcaatttacacatacaaactgtgcaattagttttttttttccacatttaataccctatgcatgtgtccaaacatttgatgtgacgtttttgcctaaaattttttaagatctaaagaagggatacactcaacttctaccctcacctcacttttatacctcccacgttagttttaaacaaaacggtacatttttctttcaacaaaatatttacataaaatttgattttaaaaaaatcacaccaacctatttttaagttttctttacagataatacttcttccatccaaattcaaatggaacttatcctaataggttttaacattttggaacggaaagaatactaaattaattatgcgccaacgagccacccagttttgtgggtgtggctcctaaattcacccttggtatttttacaaacatggatacatctatatatataataataaaaataaatattttttttaaagaaaatagtactaacagaaagaagaaaaagattaaggtttgaaatataaagcaggaattcgatcgatacgacaatagcacatcttccctccgtcccgtcccaaaaatatatcaagtgtattagtttacgtacgatctttgtttgttgtactttgaccaatttctcaccttccattaattatacttataacattaatataacatcacttgaaggtattctctaatatatgaatttaatgtccttacttactcgtgtgtcactacacacttgcctcaaggagtcaagggctcctttagaaccaacaaaaagaataggaattatgaatgcgctagaaaatattccagaatggctcattggaacaaaggaagactaggataacctatgaaatggcttattccaatgaaattttggagggcaactaacatggctcctttagatcgatctcatgttttttnnnnnnnnnnnnnnnnnnnnnnnnnnnnnnnnnnnnnnnnnnnnnnnnnnnnnnnnnnnnnnnnnnnnnnnnnnnnnnnntcagggttcatggccagg

SEQ ID NO: 53730 - DNA, 786 bp, Oryza sativa
  unsure (1)..(786): unsure at all n locations
ggctggcagttactgcagctnnnnnnnnnnnnnnnnnnnnnnnnnnnnnnnnnnnnnnnnnnnnnnnnnnnnnnnnnnnnnncttgcctcttgaagcctatgtgaaagctcatgtaattttgcagttgcaaaaatgtacaactttcaggtgacaaaaaatggcatagggatgtacaaaataaacattaagaggaaaaggtttcgtgtttagaactttaaaaccaagcaatcaaaaacattttcttcctcgaagatccaacaacaaagctctgcatcaagaaacattccattggttgacagaaacaaaattaagctagataagcactgattccacgcacaatttacatgatcattacatcgtccatcacacaggcactcatgcatcgattacacataggagtattgattcgtgtgactagcttaatgaatttgattagccgatgatctggtccaggacgccgatgttcttgaggccgaggacgacgccgacgcccatgatgtggccgacggcgccgcaagccagcgtgtcggcgagcgtgaacccggcggggcataactgcgataaaaagtataagctccagggacctgggcagaattctcaaaaaaatttggaccatttctcgattgtgcgtgtcatccttgtttcatatggcttangatggaggtattgtgtgcgtatgggatgccgagtcgcatttggaaggagttcaaatttggtggaatttgttttgtaaatttgtttcttgtcgagaaggttnctagggtgataggacttctagatgaggt

SEQ ID NO: 53731 - DNA, 785 bp, Oryza sativa
  unsure (1)..(785): unsure at all n locations
cactggccangtagaaacncctcatgtaagcnnnnnnnnnnnnnnnnnnnnnnnnnnnnnnnnnnnnnnnnnnnnnnnnnnnnnnnaaaataattaataatcacttaaatttttctgtataagatgaacggtcaaacatgtttaattataaaagtcaacggcgtcaaatatttagggacggagggagtatataagaagacaaaataaaatctgtccttcttcgatcacttttggtgcaaattgggcccctgtcgaaatcaaatcaacctatatggagaaccaaataaatttgtctacaaggcatcgcatatcttcgctgtctagccatttgcagctataaaacagctcgatatcagctgaacagatatctgcattcattcactgaatttcgtagggtttcagtattctcatgtgcaaaaacgcatagtacagatatcatcgtatcgaatgtaccaaacaaaacgtgtcgccacatttttggaagacgacgatgcagcgtagttcgtcacgcaaaggtttgcagattaaggtggtgattgaatatcctgaagatgaacattaagcatttcacgtaaaacgtggagttaataacgtgtgattaattaagttttaattattacaaacttgaaaaatggattaatatgatattttagaacaactttcatatagaaagttttcgcacggaacacacttgttagcagtttgaaaagcgtgccattttatttcaaaggtaatcacctactttcatcacatatctgtgcagacaccttgtcaccatgtgcaga

SEQ ID NO: 53732 - DNA, 1234 bp, Oryza sativa
  unsure (1)..(1234): unsure at all n locations
ctgccccctgaannatgaacttnnnnnnnnnnnnnnnnnnnnnnnnnnnnnnnnnnnnnnnnnnnnnnnnnnnnnnnnnnnnnnnnnnnnnctaaaaaataactaattacataaattgcgactaatttacgagacgaatcttttaagcctaattgtttcatgatttgataatatggtgctacagtaaacatttgctaataacgaattaattaggcttaatatattcatctcacaatttacagacagattatgtaatttgttttattattagactacgtttaatactttaaatatgtgcccgtatatctgatgtgatactccaaaactttccacccctaatctaaacacccctctattactccagtcaccatgcagggcatggggcagctgctcaaggtatgcatgtctgactagattactgtgcgtgtgatgagtataaacttgacatgaacattcatgcaatattttattgctactgtgagcatttgaaatgaaagatttggcaaaggtcctgatttcaacttttttttcttcaaacttttatttttttcatcacatcgaactttctacgcacacaaacttctaacttttccgtcacatcatttcaatttctttaaactttcaattttgatgtgtaactaaacacagccaaaggattttgagtagatttaaattttctggtcttttttctagatacacctaagattcatagaaaacatgcatgacagaaaattttttattggatcgtgttcctactcaaattcatagaaaaataagcaagagattaaacccttatgaaaactttcttctaattcaatttgtcagtgatgcaaccaaggcacctcttctcgttttttctgtgtttttaattaatattgtagagttgatgaaacacactcatgctagtacttcaactctgtgtgttttcggtgttttgatatggataaaagaaaatttacgataatagtgtgggttacacatctttttcctattgggaatgattacttcaattcgattttatatgtcccatgtccttgtgggctcttaggtgctgattcttgccattggtgtccttgcgggcacatgtttaggacgaaggttataccatttccatcacctatagtgccgacttaattatatnnnnnnnnnnnnnnnnnnnnnnnnnnnnnnnnnnnnnnnnnnnnnnnnnnnnnnnnnnnnnnnnnnnagttgatccatcattngncgaccgagg

SEQ ID NO: 53733 - DNA, 1269 bp, Oryza sativa
  unsure (1)..(1269): unsure at all n locations
cgctgcgccangatgaagcgacagccttgtaannnnnnnnnnnnnnnnnnnnnnnnnnnnnnnnnnnnnnnnnnnnnnnnnnnnnnnnntgcgttatttccgagacaaataagcttctcgtcgacttgttaattaattagatctcgatcttgatttggagtggatcgatcatatcatggcgctactacgctgcatgctcacgaggacgaggtttattatccccaaatcgtcagccaccctccgaccagcgccgccgccgccggccgggctcctcgccgccctcggctgctctccggcggcggccggtcctctccgcggtctcgccactctctcgggtcatcagctgtacgtacgtacgtagaacgtagttcgatcatcaccggcctaaaattactatcgcttaaaaaaacgtgaatattaaagaataacctaatatcaaataatttaaaatgggtgaggcttcaaactcaggtcatctagcccaccaccttatggagctagctgaaagatccatgggtctcaattctaccgcttgatctgcagtttacatgcaattatattcatgcaagctagcttgattgattattactccacgcgttataagtgtctgcgcgtttgtactgtgtttctgaaaacataacaatgtaagacgcaactattattcttcatgtttggtaatacaagacgtgcatttatacatcaaaataattatcatatcttcttctaaatttggtttttttaatccttcaccctcaagataattttattggatacatacatcgtatttagtaattatttcttggtttttacgttagaggtagttacaccttatatttaggattgagtgagtacatacttccttcatttcatattataagactttctagcattgtccatattcatatatatatatatatatatatatatatatatatatatatatatatatatatatatatatatatatatatatgttaatgaatctagacatatatgtgtccctagattcattaatatctatagaaatatgggcaatgctagaaagtcttataacctgaaatggaggcagtacaagccatcgatcgacgattttatcatatcttttggtatatggtatatgaatatagtatatctcattttataatgggttatttagattcatgccactattaattttacagnnnnnnnnnnnnnnnnnnnnnnnnnnnnnnnnnnnnnnnnnnnnnnnnnnnnnnnnnnnnnnnnnnagcacgtncatccatggccatg

SEQ ID NO: 53734 - DNA, 2819 bp, Oryza sativa
  unsure (1)..(2819): unsure at all n locations
cgctgtgnaaagttggagcagcttctatnnnnnnnnnnnnnnnnnnnnnnnnnnnnnnnnnnnnnnnnnnnnnnnnnnnnnnnncgagggcgcccctggcaaccagactggggccctttgattcgcaggatagaaaaaacacagggaataaaaaaaacacagaattaaagtagtaggtttctcaaatcctataggaattagcgaacacaagaaaaacaataggagtctttgatagtgctataggaaaaataaagaaaagttcacaaagaggcacatctcttgctatttttcctatgaaatggaaagcataggattggagtttcctttcttttctataaatcaaagggacatgtagaaaaaagatccatagaaatttgaatcctatgaaaatccttttccaattctatgaatcaaagggagtttgatcatcaagtaatttgacgaacgaactagactttcatctgatctcatcttatctagtcatctctgattctctaatcaagtgtgtatactgtatgtatgtatgtatgtatgtatgtatgtatacgacatatgtctttttctttattttgtttataaaacaggaactcaggaaggcttttatttcctcaattgctttaattcctcatcacttcatcacttctagaaacagaaagtatgattcaggtgctgaaaaacgtaggaagagacaggctagatgcagcagctcaatctcgatattaattatgaagatataatttaagatttcattccaagaaacactagaaggatgatgcttttcacttttcagtacaacatgagatcagtagtactaccttttctcttttagcattaatatttgtataaaataacacatattaaagttatatagttgattgaaagtatgctttgtttatattagttatataaaattttcaaaatttaggatccaattagcatttcgttcggtggccccaaatatctggagacggccttgccgccgatcgatatatcgtcgcggatggcactatggcagagacgtcggtcagctcggcaaggggcgattcaattcaacaaaataaccgncggcaccccgtacgcgtgcacggtgcacatgcacgagatcatctactactagctgtttgcaccgggtccgactttgatcgacgtcccctgacatactccatccgtcctataatataagaaattttaattttttttcttgcactgtttgaccaaattatgcaaatataaaaaataaaaagttgtgcttaaaatactttggataataaataagtcccaaataaaataaacaataattctaaattttttttaataagacgaatggtcaaacagtataaacaaaaagtcaaaataccttacattatgagacgaagggagaatatatgagcggcttgcacagccgcaccagccggcatctcagcgaattgcatcgcattggttcacctccatcggcacacatccacacgaccaaaaaatagcacatcatccgccgcccacgacccgagctctgctaccgccaactgtgggagaaactctgcccacgggctccccttgccgcggccgctacccctcccgtcgaattgaaagaggaagaagatgttgagggagaggggagaactggatctaggaggaggggagagctaggacatgagataagaaagaaaaagagagaggtattcctctattcctctcacgctagttcggctccatgtgtgacctcgctcccgcctcgctgtctctgctggagaagtcccaggggcagaccgcagaccgcgacgagaagcaatggcagggcggcgagaacgtggcgagccacccgacgtagcggcagttgcaggactcgcctgaggcgtgtgcgcccgccgtgccggcggccgtcgaaagaaccgttccttgggccccgtcgtggtcgcacaccttcaccaccatcaccgccgccgctgccgccgccgtctccgtcggagcagcatcatcacgaactgggggaaaaagcgggggattgggagatgaagtgggtggggaggcgatgcgtcgaggagaacaaaggggtagttggggaacatattccttggcctgggatatcaatgctaactcttggtaacttgcattgtgccaaaacagataacgcccactgtgtataagctgtgtttagattccaactttttcatcacatcaaatgtttggacacatgtatggagcatcaaatgtgaacaaaaagaaaaattaattgcacagtccaactataaatcgtgagacgaatcttttaagtctaattacatcgtgattaaccataagtgctacagtaacatacatgtgctaatgacggatcaattacgctcaaaagattcatctcacagtttacagtcgaaatcagtaatttgttttgttattagtctacgtttaatacttaaaatatgtgtctgtgtacataaaagaaaattagccaaatttttacagcatctaaacacggcgatagtagggaataacagaagacacagaaggatggctttgcattgctactgccctaagcggagtaggcggagagcgaaagaggaaagggtgggtggagacggagcaagcactggtggagaaaccatctttggtcggtcggccgaaatccacaataatcccggatccatttaaaaccggatctttagtcctgattggtgctacaacggtcatatgtgatctttaatcccaggtggtataaatcatccttaggtccaggtgtagagatgtcagacgttgcaagggcccccggaatttaaatnnngnnnnnnnnnaaangnagaaagagtgagcgttcgagggttttt

SEQ ID NO: 53735 - DNA, 1330 bp, Oryza sativa
  unsure (1)..(1330): unsure at all n locations
gngggnngggannaaagatccccccctttataaaagccttcttcctccctccagcccgagagcaaggcttcaaaatttctcaaaaaaagaggggaaggtcatgcaaaaatatgttgtgaaattctttttagtgattatatacaaatcggaggtgtctaaaaggttagtaacttcatcatccaagatttttttttgttgttatataacttttggagctatgtttcacacattttttttctccaaaactttgttgtaagttgatgagagagaaaatttgtgtggggaagaagaatatatagaaattttattctcatagtttaaaatatgatgaaaattacttaaaaaatagaaaacaaactaaattgaaaattaagagaagtacaacattaatattagtttagaacttcaaaaattgttaataagaattgcttgtcgaaagagtttttaattattttatcattactgtttgactgtcattattgtacgaaaatttatttatgtacaattttttttcatttcatgtagatggatcggcaatggatgtacgttgaccggcggtccaaagagtttatcgagggcgtgcattattttttgagagtggccgaagctaacaagcgtaacggttttatttgttgtccatgcaataagtgtaagaaccagaaggaatattctgcatccaggactattcatttccacttgtttgagttggggttcatgccaagctataattgttggacatcccacagtgagcaagaggttgaaatggaagaaggtgaagcggaggacgagaacattcccgactgggctcagtacgctggatttgaagaaaatcaaacggacgaggtggacagggatgctggcgataatgacgctgcagatgatcttggtcagatgttgcaggacgcaaaggaggactgtgaaagtgaaaaggggtcccataaattggagcggatgttagaggaccacagaacgtcgttgtacccaggttgcgagcaggggcacaaaaagttggataccactctgaagttcttacaatagaaggcaaaagatggtgttagtgacaaggcatttggcgatttattgaaactcgtcaagaacattcttccggaggaaaacaaattacccgggacaacgtacgaggctaagaagatagtctgccctctaggactggaagttcagaagattcacgcatgtccgaatgattgtatcctatatcgcggtgaggagtacgagagcctagaagcatgccctatttgtaaagcactnnnnnnnnnnnnnnnnnnnnnnnnnnnnnnnnnnnggaaactgcactctcaaannnnttgccgca

SEQ ID NO: 53736 - DNA, 1316 bp, Oryza sativa
  unsure (1)..(1316): unsure at all n locations
cgcggacnnnnntttgaagtgcgtttcnnnnnnnnnnnnnnnnnnnnnnnnnnnnnnnnnntacactaaaatcctacattaatattttttaaaaaaatttttagtgaaaacattaaaatcctacactaaaaaaatatagcatcagcatgagctatgtgctcaattaattacaattataaaagtcctactatttcttcttcgcacatcataaaccaccacacaatgttattttcatgtgtggttgtatattattcgttgaaaaatgtttcatgcacctaatatagccaataatagtgccttcatttttctacattgtccttacatatttctaatcaataacgatgcttaatccttgacttttcattgaaatatgaaagatcataatagctatatgccaacgttatacgactgctataaaagtcacattggcaacagatacactgagctatcttaagatcagatttgagatgttagtatccatagcattttcatatgaggtggtcatgcattcagacttgagatctcagagtgtctaatcggctgccacgtgcaccttctagatgctaaactttttttttttgcaccactactcctaccgacacctcatgtacgtatgtgtacaaattaagtactcccttcgtatttagggtaggacgcaattgactttttaaccaacgtttaaccattcatcttatttaaaatttttgtgtaaatataaaaatatttatgttatgcttaaagaacattggataataaatcaagtcacaataaataaatgataataatatatttttttaataagacgaataacagcgttatattaaaacacggatgaagtataaaatactagtattccgtactatgcacagtagctaaatacagtattgttttgtccagcagtctagcttgtgttttaatttcttccatgtgcataacttaattggtataatgccattaattatattactttggtttatgttcattacttaattgatataacggcatcaattatattactcttgtttgttaagcatattggtgactacgacttgcataatatatagttgcaaacgcatatatgcatgggttaatcagattattaatttagagcaaagcatctaccttggcaatttgctttggtgttgttattatcagtaaccgcgatggatcgatctcgagcatctgatctgattttgtttcgattgggggtagttagagcgatagtagccagcccatcttgatcgaatttattccatatgcatcgatctaaaatatatattcatatcattatgtgaaatgtggggtctttaagatag

SEQ ID NO: 53737 - DNA, 1320 bp, Oryza sativa
  unsure (1)..(1320): unsure at all n locations
aaaacngtttcactcttcatctccagcaaccgatcttcgttcccccaccaaattggtgaccgacctgttggttgattttatcggctaaataccaattagctaaggaaagaataaattccacttgtccgattcctaaagagatagagttagtttttgtgattggtaaaaactaatttctaacaaaatttcgagataacccccgagcccccaccaatgcgcctatataaagagatgaagggcagaggagggacgccgagctctctacctaaaccctaaatcgcctgatcagcttagcgttggaaggggttcgtgaggtgatgacggtgaaagaattggcgtatcaagaagaaaaggagaaaaaaaatcgaagaagaagaaagaggaaaaacactgatggcatctcaagtagtagattaagtttccgcattgaagcagaggtgattaactgattatgtataggctaaatcattgagatgtaatttagatctccaacacaaccatgaggaagagcatgtccgaatctgcgaggcaaggcttcgattcacttgttatctcttgttgcctggaacctcttaaagaagcggaaatgcccacgtattcgacggtattttcgtgtcatttcaagcccactcgatcagcactatccttcaagagaggctctcatctttttggatcgaagctagggctcgacacctcggcgtcctcttggccctagctcctggtggaccctacttggcctctttctgctttggagttcattttcactaagtatccctccttgcttttgtgtttagcttggtttatatttttcgtttttgtctttgctgctagtaagaggccagatgcatgtaaactatattgtttccttcgtctaatatatcgacgcgcaagtgtttaggaaaaaaaagttaggattagaaggttttatgtgtaaaatgaaaaggtttctaaatgtcgttacctttcggattatacaatgttcgggttatattaacatttcaatggatgagttcttattggatattagtcaatatttttcttcccatcatgacattttttaagatccggtatatcagttagatgacatgagatgattgctctttagtctttaatttgttcccaatgcaaatgtgacaagtctacggacaacgatggcgtgtccgctgagttctttatacaaaagaagcagagctctattattattagagttattttatatctcaagtgccgtgataattggtattaacataacctacgtaccaatcgaatggtggagatattacagttaaaaaattaaaattaacattagaagacgcctgg

SEQ ID NO: 53738 - DNA, 1381 bp, Oryza sativa
  unsure (1)..(1381): unsure at all n locations
cgcgcgccatgattgaccnnnnnnnnnnnnnnnnnnnnnnnnnnnnnnnnnnnnnnnnnnnnnnnnnnnnnnnnnnnnnnnnnnncatatgccgcgctaacaaagagccatacttggcatgaaaaagaaaaaggaaaaaagagtagtcataacagaaagagatttgaaggaaaaacctaggatccaacgggcaacgggcaacggcaacggtgctgtatctgtgggtgcaccggcccacgtgcagttgcagcggggcgctaaatggcacagcaggggggcaatttggtcacgagaataataataaaattgtaaaaggaattaaagaaagcccagtggatatgaaaggacctggcttgttgtggggcccattcgtgtggttctactagtacttctcctgggcctttcgctttgcgagagagaaagccacgtggcgggggaagcctgggctgccgacaccccgcccacatgtcgtncaaccgcccgctcacacgcgccgcgcatgtgcctgcctacgctacgtgacggcgacgtcgacgacggcgaggcggaagggaaaacgcttgggacgcgctgcgcacacgcagtcacgcacaaaattcaggccttgttcttggtacgttgtcacattggatatacatatacacatttaaaatattaaatgtattctactaacaaaataaattagatttctaaaagaaccagattaagctaattaattcgtcattctcaaatgtttactgtagcaccacattgtcaaatcatggtgcaattaggcttaaaagattcgtatcgcaatttacacttaatctatgtaatttgtttttttctatatttaatactccatatatgtgtctaaacattcaatctgacagcgtgaaattttttattttgagaactaaacacggcctcaatcgtgcactcgtatatatccgtccttaaaaataactcaaccataggtgcttgtccggacttcttttttcttttttctttgaaacacacatgcacgcctacaatacgcacacacttgtttttatgaacgtacacacatgtacgtcctatttttagaatattttctaaaggctgaattggtatatattgagatttgacaaaatcatcgtggacatctcattattaatggatatgtcttatatcactgaaagaataattattgccatgaatatgtcatagtctagactcgaaatcatgctccattagctatagtctaatgaatacatccttccttgtgttactccctccgttgaaaattagttttgttctttagtcaaactatcatgagcttagccaaaatctttagaaaaatatttatgggtaccgagctcgaattcgcccatagtaagtcgaactcaaaanntcgnccacg

SEQ ID NO: 53739 - DNA, 1236 bp, Oryza sativa
  unsure (1)..(1236): unsure at all n locations
catggcattgattgtacgcctnnnnnnnnnnnnnnnnnnnnnnnnnnnnnnnnnnnnnnnnnnnnnnnnnnnnnnnnnnnnnnnnnntcccccgtttgctgctgccaacaaacaaatggaataacataaaaacggagtattcgaattaacttgcaacagcaaatgcatttatgtcggattcctctctaattgttgtgtaggcatatcagatgacagcctgacagctgttttatttaagcataggatgccaaaattgctactgtgaaattattatcaacactttgctgattaataaagttaagtttgacaaatgaaggttcttggagcttacagcccaatccctctgttgataaacatataaaagatttgataaatatagttcaatgaaaggatgtggtgcagaatagttagattctgaagtaccaagatcatctcctggatcatagtcgtcatttgctggcaatttagcaatctgtgtcacctcatctttagacagatcaatgccagaataaactctagcattgcgagaaagggaatgctgtagttactctcatgacttatgccatggctcatcttctctccactctcaacagaatcagctttagttaacccacaaatctttgagccactgtcagctctacccactaaccgagatgccacatcttggctatcacctgaggttctttctcggccaacatcttcagggacaaactcatccatcattccaggtccagggcttgactcaccagtattgcccatattttcagtaagctcgggagctggttccacatctccaacaacactatcagttttatgctcagaaacatcaactccatgaatttcggcttcatgactagcacccataccaacactccctccactaactcccaggcttagttggtccctagcaaaagcaggagcagtttctgcattgaggacttcctcccctccattcatactactacctcctatctcccttgcattactttcagcagcaggctgtacaaaactgctttgcggtgcttggttgctatagttaagatccaatgcctcactcattccaccactcctgacagcactagacggcttgtgaacgtcatcaacatcacatggatggtattcaacactctctgttgaattttcctctgcactgtggactgtgtccatcgnnnnnnnnnnnnnnnnnnnnnnnnnnnnnnnnacgggttacttcgatccacaaaannnnngnnccac

SEQ ID NO: 53740 - DNA, 1655 bp, Oryza sativa
  unsure (1)..(1655): unsure at all n locations
gaaaatttcctcagagaatagtacgcgctaatggttgagaaaattgggggtaaatttttttcaaacaagctgatagttcaacagttgcccgaattgtcaaaagtgaggtattatccagaaaagcatcccatataggttgcactatagttcagatgcaaccaaagcgccaagtatagaacggagctaacgaacaaaggttgtaaccctttaataaaggagatgacccgagacatgccgttacccataatcaatttatttagggtcagggggccggaagcaagtaattgcgtacttaaggataggccctaatcaaaatttgtaggggaaatatatgnntgtgtgcttgcacacacaaacttccaacttttccatcacattgttccaatttcaatcaaacttccaattgtagcgttaactaaacacacccgtacacaaagcatagcaacagattaaattcctaaaagattggacaggacacgagcaactgcagtcatacacaaaccacaacaaatgggcaaacagatcctcagcttcggatgatgatttgtattaaaagcagacgattttcagcacggtaaacataaattcagaggttcaaattttgctcatatctccctggctcgcacttgaaaagaattcttatctcctagcaagccctagaaccaagcataaattaaaacaaaaggtacagaatgtcgagcacacgttctggatataagaatgctatatctagtgcgatttgacatagtcctgcactatgttaaggccctcagactcttcaccatagtcctgggaaatgaaaatgaacagccaaacattacaaattgccatcttcaaaggaataattccaagtgttaaggtgagggatcgattagttaccttgacaacgacgcaggagcagcccacaaccttccttgccttgccctcagagtcaatcttgcaaagctgcaaatgacaatatgtattgttaaaaccaggacaagaaggcttttcatataactgtnaattaaaagaaatacacagaacaaaggaaggtggacaatgataaatcataaatatacgtgccacagaaatgttcaaagtttccccacaaataaaacgaatatactacctccatccctaaatatatgacggtggttagttgaaaaatgaactaaccaacgtcatatagaaaagaacagagtataagaatatcaatattaacatatagtaggcacattctcctttaaacactggtgaaagaatgtctactcatcaattgaacctacatcctatatggccctcagtgacagagacaagagacaagagggccagtggcctggccccctccaacaattttttttcacataatcatttaagtagttaggtaattaagctaagtgacagtgtattcggccccctccaagagtcttaggcccctcccatgtttaaatcctgactccgccactgatgggtgatggccatataggcaccagttaacacaaacaaaggacaacaattaacaaggtatagctattaggacataggcagcagactaacacatatcaagaaaaacaattgacaaagtacttagaagaatcctgtaactcacccctggggtacgagctgaattcgccctaagtagatggaaaagaaaatcaaannnnngggcgcat

SEQ ID NO: 53741 - DNA, 769 bp, Oryza sativa
  unsure (1)..(769): unsure at all n locations
cgcgtgtacgtaatgacgactacttagggccaacncgagctcggtacccaaacaaaatcctagtccaaatctaaatcggaatcatcaaaaaacatccagaatattaacacgagatgacgagaggagagggaggggcgagccagaggccgccacgcgctgctccttgccacctcaccttcggccgaatctggtaaggagtggggcggcgaccactgcccgatgaggagagaaggagccgacgccggatctggcaaggagccaccaccaccgccgctcgtggtgggggagggcgccgccacagccactcgccgcgagggaggctgccgcgtccgccgcttgcgggagggcaaggcattgctgccgccgtcgccgatgctcgcaggaggaagggcgctgccgttgctcgggggagaaggttgccgtcaccactgccgctgctcggtggggaaggctgctaccgtcgccatccgttgggcaccgccggtggggaggggcacgaagaggtgcgccggtggggagagaggcggcctgcgtggaggggaggaaggggaaaactggaattaggattagggcttatttggtccgggggttttgatggattaggagccgatctgagccgtccataacaatgaacggcttaaaaccgctccccggtcggggccagaatccattaattgggccgaataactgcttaggccgggcctcgttcaattagccgcatgtatgtttggtgttaacgcccccgaacctagtcctgacccggaactat

SEQ ID NO: 53742 - DNA, 732 bp, Oryza sativa
  unsure (1)..(732): unsure at all n locations
gtggtcntgcnttttgatgaccacttcgattactacanggcgaattctagctcggtacccagctgatccagatcagatccattcccgtttacccgagcataagcaaaattcgtactctgcatcagttaagaaagataagggcaaaggaaaaattcatgtaaaagactctggatgcagcatgaggtcacctttgcttgattgcagcttatgtggagcaacagtgagaatatgggatttcagatcggtgcctcgtccttctcatcttagtatcaataatattgacgcacctgatatgcggaagggggtgctgacacgtggaattagtgctacaagtggcatcaatggatgggttgctgaaggaacagaaagagagaatgttgaaggacgtggtgaggcaggtaccgatgagggaaaatcactgtcaaatgctcaggttgacctaaatcttacaatggcaggtggtttgccatctacgcattctgtgatgccctctatgcatgatcatttcaatgatggagggatgggaagagatctgatgattgggcagcctacttgaagtgagctaggtggcttttgcagctcatttgagtctaggggttcctagtcaagaaagccgcatcttgaggaaagtgggagcacaacttgataagccgttaataagcttcattctgctgacagcataagaagaacttgtattgaccgtgaccgtgattaagttgatgatgggcaccn

SEQ ID NO: 53743 - DNA, 997 bp, Oryza sativa
  unsure (1)..(997): unsure at all n locations
cgctgcgcacgtaggacttctgctcatacgggcgaattcgagctcggtacccaggtgttgttccgagctgataaatcgacacttttatgcggattgagccaatcttatccaatcgaatcaaacgaaccttttttttcgccacccttactttttttgtctcccttatctcctccttttcttcacccacacatctttgtcttttcgcctctctttttctccgccttctctctctccaccggcatggaggcggcggctgctccccctacccggtgttgcggcagcggctgctgctgctccccctccctggcgtggcggtggctggtgctgcttcctccctccccctccccccagcgtggcgatggcagctgctactgctctcccttcccggcggtgctgctcccccccttccctgacatggagccgacggtggttctcaccagcatggcaacaatttgatttgtgaatattttgtggggattttatgatttgggatgttgattcagtaaccactgaaggaaaggaattgcttcctatgatttgcctatggccaattcctgcatccaaaggcatgaacagtaaaacatcctatgggatttgcaatcctatcttgttccatcaaaaaaggaccttggttgaaaatggcatcttaattctccattctctggctctatatttgtgaagtcacgtattcacgaaaatgtcatcaggggcttcttttgaacaatgggaaactaaggaattttggagaactagattcctatggaaaaatttggtatgtgctcctttggaacaaaagaatatgtcttccaaatcatttaaagtccctatgaaatgggccatttcatatgtaggaatttcgaaagaaaactagcattatcatattttcttattcctatggcacaaagttaannnnnnnnnnnnnnnnnnnnnnnnnnnnnnnnnnnnnnnnnnnnnnnnnnnnngcgcnacaaagaagctgttctatcttnnaacagcg

SEQ ID NO: 53744 - DNA, 1087 bp, Oryza sativa
  unsure (1)..(1087): unsure at all n locations
ncaagattccagcccggtctgaaggagtgtcaccttgtggccatgaagagaattcttagatatttagtgcacactcctaaccttggtctttggtatcctaagggagctaggtttgatctcattggctatgccgatgcggattatgccgggtgcaaagtggataggaaaaacacatcgggtacttgccaattcttgggtaggtcccttgtttcttggtcttccaagaagcaaaactccgtcgccctatccaccgccgaagcggaatatgtttcggcggggagttgttgtgctcaacttctttggatgaagcaaaccttgagagattatggcctcaatgtatccaaaatcccactcctatgtgacaatgagagcgccattaagatagccaacaaccccgtccaacactcccgaaccaaacatatagatattcgccatcatttcttgagagatcattccacaagaggcgacatagacattcaacatgtgagaaccaacaaacaattggaggatatctttaccaagcctctagatgaagctaggttttgtgagttgaggagtgaactaaatattttggattctcggaatgtggattgatctattgtatgcatgtttgcttggtataataggttttgcatagcaccttgtgacaaaatggtcattcaactcatggatgggcactggtcacttttgtggagaacttgaatctatgtgtatggggatctcatttttcaatgaattttggtcctagcacaacttgaaatagattcacacattccctatctcgagggtgaattatcttgtctcatggtaattccctctcttttgatccctcggatcatccatttgacttgtggctattgttttgtgtgattgattgtgtgctagtcacaagttcaattggagcatatagtgctcgaccatccctccattcctaaatcctatccaaatctttgcgaaatgtgtttttgtcaaaaatttcccggagctagtcccctgcaaaattcctttaaaaagtttggaaaactgtttcttcaaaattccttgcaaaatgngttttcagaaattttcgctttctgaaaatttttga

SEQ ID NO: 53745 - DNA, 1651 bp, Oryza sativa
  unsure (1)..(1651): unsure at all n locations
gaccatcaatttttaacggtattggggtnacaatggtggggtggtaattaaatggtnccaatgatatatattgatagatnntgtttcagancagtatagcgtttccagtgtatgctctccacatagattctggtgtatgtgcatgctgaagctcattcctctcttattacaagttcggctggtgcatcatcaccacttgcacaaacaaatgcagctagcatagattggttaggtggtgagccaatatccaaagtggaatcatcatcccagattgctccacatgctcctcggccttctcttagtactaatgctgctggagctgccgtggcaatagcagattcacacttcacaggggttcatttcaacgtggaaattcatcagaaattcgtttgcagtgatgatgagtaatactctccggtctcgacacaagcaaccagcacttgcattagatggatggggctctggaggtggtgtgcaactgggcgtcttcgaagatatccacatcctctagcttctcaggcttcaggcaagccgggatgtaggaggtgtagacggcatccatgttcggcgtgtctttcacgttgtgctgaaccacctcgagaggggtcttggcgaacgccgggtagaaccgcatatggcaaatgtaggcgaagatgaagcttattgggatgaggggcacaagaacaggggagtacaagaacttcttcagcaggatgacaccaaccatggtgatctggtaaatcagtagagctgcaatgatccttgtgtgcatatgtggccacattcgcccgttgctctcgtagctgggaacataaactcggagaaccttgcgtaaaagaaaggttaccccgtcacaaagtttatctagcaatggctatcatcagagactcaagagtattaaaaaggattgaaagcggatttcagaagttcatgctgaagtaggtttcataacctacattcgacaatgggaaactactaattaatttgtcctttccaattcagtttcaatattagtgtgttaaaacttcggttaaagcaagtaactcttggctcacctgatttttcactataatccatccaagagcaaagtaagcaacaccaaatggaataatcagaggtgcaatgacagagtagcacagcactattgtaactatgagcatgtcattcggaaccctggtgttatatcctaggtcgcctggagcccaagctgctctcacttcatcctcggtcttgcataggtacttcctcttcaggtggaaaatgataagagggaccaagcgagagagctcaagcccataaccaacaaagaatctggcaacaaaaacaaatgaaaagttactttctgaattgtacagacgtgtaggatggaaatagctgacaataccaggtacataatgtgagaagaaagcattgcttacttcagtgcaacaaatgtaaggaagaaagttgcacttcctggaaagctgctggcaagcatgttcacaatcccaggagggttattgattatggttgtcaaagcactgaacaatgtggaactaatagtaaccccaaagaagacattgaacacaatgaagtagaagtactttccttgttgttgcctaactgtatgaccctgtgaagggaatcccctccagcttgagaggaacattan

SEQ ID NO: 53746 - DNA, 764 bp, Oryza sativa
  unsure (1)..(764): unsure at all n locations
gctggctttgatgacgtggnnnnnnnnnnnnnnnnnnnnnnnnnnnnnnnnnnnnnnnnnnagtttttgtgggtaaacgggtgaaccatgcccgtatacccgttgggtataggttttgacccaataaaaaacccatgggtactaaatggagaacaaatccaactctattagtgtcgacgttttatgtcgtgattccggtatttgcatagtatggggatcgttggtactaggatatacgcgagactgaggtaaaagagatggagacggggatttttatacaggttcgggctcctgaattgtcaggtaataaccctacatcctgttggccgaagccggtattgctcttattcaccataatcataccagtacaatatttggggtagcctatctaactgttgtcgacatggcggtttgaaggtctgactcatagtcgacaatagggtagtcttcctcctcgagtttgtgctcggcgagatcagagatagcgcctttcgtctctcctgacagtatccggaagacaccgtaggggactagccgtgcctatctctgaagtcaatatccggcgtcttgtctttgcgtatgttagcttgtatgttgaatctttggcttgacctattgttcccgtgtatgttgattgtgggtggctttcatggggggtggtctcccctcttctcctagggggcccttgttttatacccataggtgttccctttgtccagttggaattagggaaaccaaatatggatccaatccgagtagtcctg

SEQ ID NO: 53747 - DNA, 774 bp, Oryza sativa
  unsure (1)..(774): unsure at all n locations
gtgaccccnnttggattgtatacgactcactatagggcgaattcgttctgttacccacacatttgcataaaatttttgaataagatgaatggtcaaacatgtgagaaaaagtcaacttttattgtctattaaaaaacgaaggtaggtaatcacaggttttcgcatcatggtctagcttgccacaactagatatagaagtgagtcgaatcaataaacccatttataaaccaaattacccgcgagacaatctgcagattatccactaattttacctatataacgggttggcccgcttgcattcctaattgggcctgcctgacccaacgagtagagcccgtccagtgccctgacagataccgcagcccaagtagggcccataaaacaacccgtgggcccgtctcttgtccgaccgttgctgcgttgctggcaggtggggcccacaaccagcagcggcccaactcccaaccccgttccgttccgttccccatctgctcctccttccttccgttccagcttgaccccgacgcgtacccgacccattcactctctctcctctctctctctcctctcgcccgcatcggccgccatgcgcgaggaggtgcggagctcgtcggcggcgccgcccgacccgccgccgcgctcggcctcgccgcccgccacccccgtcgccaggtaacctcccctccctctcgctgctctctccgtctctgtgcgggggactcccgctgtgctgctggtgatgatggtgcgcttccgaatcgaatcgggggggag

SEQ ID NO: 53748 - DNA, 2742 bp, Oryza sativa
  unsure (1)..(2742): unsure at all n locations
cggcnntttatgtactcctatattcagcccactnaggtaaattaaaccngctccctgcaggtcgactctagaggatccccgacagtttgtttacatttttacaattcagcattgttcagtgacatctgtaattgtaatttacatctgttctttgtgttcttgataggttttggatcatgcaagttcctggcatccgagtaagttcagtccataattgtttcagatgttcttctttctccttattacatatgactggtaaattaattaaattttgctggattggtgcaggacatctgctgcatcagcactgactcgaggaagcatgtggatgatcttcgcagctgcgtctatgatgtttcttcatctgagagttttccaatccgtgtgaattgggtcgatgctaccaaagtaattagtacctgtggtggtttggttctctttgtagtatattacttatgtaagaagcaaggaacagtgctagttttttcgtgtaaaattgtgaagattatatattactacctccatcccaaaatgtttgacgccgttgacttttttttaaaatgtttgactgttcgtcttattcaaaaaatttaagtaattgttaattctttttctatcatttgatttattgttaaatatacttttatgtatacatatagttttacacatatcacaaaagtttttgaataaaacgaacggtcaaacatgtttaaaaaagtcaacggtgtcaaacatttagggaaggagggagtatgatttaggtcgtgtttttcactctgtaataataatgaagtaaatagttagcaagagtttgtggagggttaatgcatggttaattctttgaattttgtttcagaaagctctcgcttgcatagccgtagaggtggagtaggtcacaagcgtacacaaacacaatagccaattacgagccatatggcccaatatggtgaggcccacaaggcccaaggtgacaaagccccgcatagtcagatccgatccgtaggttgaaatctggacggtcggcacgtcacgcacggacgcgcgcgcttattttagtaccacctcgagaattcgatcggagaagcaccagcttatatacccgcccgcgctagcctggtcatctcttcggagacatccgataaaattggaacgatacagagaagattagcatggcccctgcgcaaggatgacacgcacaaatcgagaaatggtccaaatttttttgagaattctgcccaggtccctggagcttatactttttatcgcagttatgccctcggttctttctttctgccccttctgctgaatctttttcttccgttctcgtccttcgtgtatgaaggcatagttaagttgtctgcacttcagcccctgaagattttttatcttataaatagaccctcatctgtttccttctttagtgctgcccattgttttcttagcagttatgccctcggctctttctttttgccccttccaagttttttcttgcgctatcgtcgtccatggcttcatcgatggaggctcatacttaagttgtctgcacttcacttcagcccctgagattgttttctcttacaaacaagttgctgtatatttcttctctgcttcactttttaataccaatcaggtcctattatatattgtgcattgctgataataatttgtttagtgcacctctttttttgttaggcaccctgtaatctactagtagtactttggagccataaggccaatcttataacagctcatatcaacatcacgtcctctcttttaactatttctttggctccaacaaacgccaatcatatcgtccacaaccacaagcatacgcagtgacgaaccaataacaaaagctaccaacattctatacatattaattatctaattattggttaatatattaattattaacatgatataaattagctggaactaaataatctacccggggtccgtgaccccgagatagtgaacgtagccacgtctgtacgccactaagcatatgctaaaactcagttcaagattttttaattaattaacaataagaatgcatttaaatgcaattaagaatctttcacccttgtattttcaccaattagacctcacatacgcggcataacttttttacattcctattttaaactgaattaatgccactagttatgcttaaaacatacatgtttttttaaggaaagctttttagtgccttttttatggcacttttttaatctacgatccttctacctaataacaatcaagcatatcatcacaatttaggatctccagagagctcgagacaggacgctgttcgctctagcgtccgcgcctggacgttagtcctagtagcgtccttactattttcataatttgcactagtacctctcacttactaaatatttaatttcaggataattaattattataggattaaaaacccggtatattcttagataaaaagaaataaaattcagcttactctattttagatccaactttcaaattatgcaactgcatgtcgcgtgaatattaattcctggtggcgatgacggacacattcagccccttttttcttgttcggaggtttgatccaactcatacctacgttgaggactttgtgtcacacacgaaccagggatgacgagcgtattaacagattctgaacacatcacgacgtgataataatgggcatacgactaacattattggtaggctagagaagagtgtttgggccttttcggc

SEQ ID NO: 53749 - DNA, 846 bp, Oryza sativa
  unsure (1)..(846): unsure at all n locations
agtttggggcgtgttccgggcttaaaggaatgactgggacgatagcagattgcctgatgacgggcaacgagatgccagctgacatcactgccggagccatgaggttaggagaggatggagaaaagggttgatagtgggggtaaaattgtcgactagttaggatgggtggggtagagnacgatggtggagaaagtagacaatgaagtggtggcagcggcaactctaaccactagaggtgagggagaggttggggatggggccaatagaggagacagtaatgcggcaaaaatctaacatggtcagcggttgaatcggagaggtcaactgtgggattgtcagagaggagtataaggcttgtttggttgataccctgataggggcggacgaaaagctcgaggctcgttagctcgctcgactcggctcgtttcattttcctaacgagccgagctggcattttagctcgttagagataacgagccagctcgcgagctgcttgtgagccttaacgagccctcagcaatctgccaggccacaaagcccataggcccatttatttagaaggcccaatagacaatagtgagcactaaaagtgaaaaccctaggtcattcccttatcccttcccttccctgttccctttggctggcggctgagttctgtaggatcgaaacgcaagaactaagccaaccagaggggggggggagggtgaatggttggtatgcccaaaaacaaaaacttttagcagaaataaaagttaccctcaaattcacgagattggtctgaccgaagatgggtaccgagctcgaattcgcctatagtagtcgatgccaaaagacggtgcaagccgg

SEQ ID NO: 53750 - DNA, 1143 bp, Oryza sativa
ttatttaagcacttcttaaaaaccgatctatacattatgttctagtgttctcaaactaaatattttaaagatcactattagttaaagtctaaattgtttgaccttaattttatccaaaacgttgaaaattatagaaccgaagagactatatgacatgtagaattatgacacacgcataccatattctggagtctaatgtatagttgcagttggtgaccatctgtttggcggcttgggcgaggcaggcgtcgcagtcgccgccggagacgtcgccgcggcactgcgcgaggccgtagaaggcgtcgatgcccctgccggcggaggaggtggcgaatccgccgccggcgcgcgccttggcggcgaggtcggagacgacggagttgatgctgcgccgcctggcgatggcctcgccgctgctcatctcgttgtagctcggattccagcagaaggtgccaatgggagacatcgatatcgtagtagccatggccattgggagcaacattgcagccaacgagagagcaactagtaccaggcagcaatggtgcgatcttctgcttggtgacgccatggatgctagctccaattacttctcacactctcacttcaccttcttgccagctactggagtagtagctagagatgtgagcagatgtgtgtggctggcttgggttcaatcgggagcagtggttggagcttataaattaagacgatcgatcaagcgcgcgcactggattggatgggaaattaattaagagagatcgatatcatgtgcttgcgatgcagggaatagtacaggacatagtatcataatccttattgcagacttgttttgactattctaatggtttctaatgtcgagtcagccatgagccatgctcgtccatgcactggcagcgtgtgggcacgaatgttactcttgcagacttgcgtcgcggatatcgtggactagctcgctgccgacctgcttttcagggactacttttgccacagggttttgaatagaaatttcggatatttctaacgattattttttaaaaaaattaatacatttttactgaatttgaataaattatgatcaaattctcacaatatttgaaaaaaattgaatatttgccggaccgcggggggggggggggggggggg

SEQ ID NO: 53751 - DNA, 41986 bp, Oryza sativa
  unsure (1)..(41986): unsure at all n locations
gggtggggggcgaaaatttctaaaattttgacccgaaattttcatccatgttcagatgtacccggaggccagagacaaatccattcccggtccataggaccaacaccagttgatgcctgctccatctagaataggaatattttgactaagcttatgcatatcacctcacttatgctgtcccccttgccctcggctcaccctagccccgggtacatactattgagggatgaggttaattaggggtagtaagaaagctcaaagttagtggaacgagcttagttccgatcggcttgaactcaaactctaatgatttatgattcaaaccatgctatatttttaggctcatgagttaatcagtcagttcacgatcgtcttgtttaactcgttagtagaagagatcgtcatatttttatatacttagtgcatctttacgagtgtttaaacttctagttatatccaaactatttgtacatttgtatgtatagtaagttattcataagttagttttaattattatgttaacatataatataataaaatagtaaatttaaaattacaaagctaagctagacttaacaaagttaacgagtcaactcacgagcaaagctaagctacgatttcagctcattatgctcaatgagccgagtcaagatggctcgtcgagataagaagatcaaatgaaccaagtcttagcgagccaagctgacttgttatccaccatatagatgaggtgatgggtggatgaagcctatccttattaaatcagactaaccatctagaattaagtgctcaattgcctattacagtactcaatctatccaaacaaaacaacctattagtgaataaagttgaaaagctaaaaatctattcggtttgcacaggagtaccgtataaccttcttgccttcgagatccgattggaattgagttttattgaagttgttttcggtgaatttggttggatgaaaggcaaatgcactatccaaaattttgccagttagtcattttagtggtactcctaaggcaaaacatagaaggaaggtacaattaatctcatgtttccgcaaccaagtgcccaaaacccggtagcccatgagaatcgtattgtgcaaacgtgcaaccaagtacccaatgccccgtgcaagcattgggcttgtttgggggagcttctagctgctgcagcttctcccaaaatcagaagctccctcaaacaatcaacttttgatccagattctgagaagaagatgtagttgtagaatctagaagataaactagaacccagaagttggctaccaatcagttgtttcttaaaattttaagctccccaaatagaattattttcatccacacctccacctccacctccatattcacatccacatctatgtcaaactcaaacatacacattcacattactgtggcgctcattaagaatggccgctaaacttgcccaattaatttattgcgagaaaatatgagaacataagtttctgatattgtacaacatgcccaatacacatctttattaatttattccaaacaaactgcagctagcatgataaataagggtgatacaactttatacatatataaccttttacatatgatttattcgttgcatacatattcctgaaattaaacataaacataaatactattattgggattgatctcacatctgcatatactgctacacggtacgacgtatatatgtatgtatgcattatcgcattgtacgcatagcctatgtatatgctagatttatttagtgcatggtgaccttggtgtacttggacatgtcgatagtggcacgactgcctgcctcgagtgggaagtagaaggggtagatctcgtagcgcgcccaacagctgctgtaatcaatctggcatccttgagcgctgttgcaagttttgtcaaacttggacactatctccgataggcaccgtgcgcacgctggcggcgctaggtctcgcgtgcactgtgctaacgcgtaaacactcacaaacggcgtgtactgctccttcgccctgcctagcccactcctacccactgcaacagcttgtgctgtcgcctttcccatagctttccccgctgccttctggaatgccttggggttgtccatgttctgccaatttatcatggtcacgcttgcatccctcctcgtatccacttccccgatgaagtcgtagttgtagtaccgcatgaagcagtattcgtacctgtaagtacatatgcacatcacccgcgcgcacaagcacataaataaggagaaaattaaacaatcgacgtgaaatcatgtgtactctcttatgttccatcattcttaatgtttgggacaataatatggtccttaatacgacttctacaatgatttttacatattataatataaaaaaaagtaaaattttaatttttttaaaagtaattttaaagaataatgtatatatcatgttctaatatttgctttcaaactaaatattataaaaatcatagatagttaaagtttcaattattagcttgtcaaaccgttggaactagatcgagatacaatatactagcatgtagaattaggatccataataatagcataccatattctggagtctgatgtgtagttgcagttggagacaatctgcttggcggcttgagcgaggcaggcgtcgcagtcgccgccggagacgtcgccgcggcactgcgcgaggtcgaacaaggcgtcgtaccccctgccggctctggaggtggcgaatccgtcgccggtgcgcgccttggcgacgaggtcggagaccaccaatttaagtctgcgccggctgacaacggcctaactgctgttaagatcgccgtagttcatcccggactccgagcagaagctcccgatgggatacgtcgtcgccgccatgcccagtgggagcaatgcagcggccaaaaaggctgtaactagtaccagctggcttaatgccgccatggatggcgccaaattactctcactggtcacttgtatgtagagatgtgatgagctatagaagatgtgtgtttaatcgggaagaatggttggagcttataaagacgagaatttgatgggaaggagagtgagatcgatcgatgtgcttgcatgcatttcaggggaacagagtatcaaaatccttgttcttgcttgcagactattttgactattctagtggtttgcatgcagtgatcagactatgggcaaactattccatgcagtgtagaaaaagggggccgtacgtccagttgagtacttcaaatttcttgctcgttctttccaggctagtaggattagattctcctcgttttccgttagcacgtttttcaaactactaaacggtatatttttttacgaaaagtttctatacgaaagttgcttaaaaaatcatattgatccatttttgaaaaaaaaaaattaacagatacttaattaattatgtgctaatggaccgctccgttttccgtgaacactgttgagagtggggagaatctgaaaagaacgcagcctaagataaggctaataaaattggagccatattttttttgcatgatattgcatgcttgtatgaggttaaatatgtactaactattattagtggatgaactttatacgaagtatatatagatatgattctcggccggctactagtttctgggctgtttggctgcagaaacaggagatcgactacattcctgctggtttttgcctaggaatgaatcaattagtatttgctaattggcaaaattattggatagtttatttgcccttcatatccaaccagattcagcgaacgcaaactcaatcaaactatatatgcagtgctcctgcaaccgaatagcttttcatcttcactcatcactaatgtgctgttttgtttggattgagcaatgtcgtaataatgaattgaccacttaatccatgatggcttgcttggtttccgtccatcaccagggttttcaatttcgtttggaccaatattttaaatagcgggccaaggcatttagcggttagcttctcaaacagctatagcggcagctatagcgggctaaatagagctatagcgactaaattgtacatgtgaacaaatagctagaacccttctcaaacaactagagcgggagatttaaaactctggtttagaccgaaagtttcgggattttggtgtcactgtaatttccgaaaatttcaggaattttcatactttttgcatgaaattatttagaaaataaactgaatttaaataattttttaccaaattaaccaaaattttggaaaaactgaattttcggtcgatacatttgcttgttggagggggtgaaattgcggaaatttcgaaccgaaatcgtaaaccctgtccatcacctatcgatcacctcatccctcaaaactagtcatagccccccggaagcccacaagaaatggtagaaagcaggtagttagccactagccagctagctagtccgtgatatccgcaagagtatcattcattcataggtgcaaatgcaatagctttgcccacagtctgactcgatctgatcatcactgcatgcaaaccattagaacagtcaaaacaaatctgcaagcaagaacaagggttgtgatactatgtctgtctactatgttcccctgcaatatactgcaagcacatcgatctctctctcctttccttccaatcctcgcctttataagctccagccattgctcccgatcgaacacacaacccagctatagccacctacatctgctgatcgacatcgatcgatctctactactccagtagctagcaagaattgaatctaggtgaagtgagagtgtgagagtacataattggcgccatccatggcggcattaagccagctggtactggtcgccgtcgtctcattggttgccttgctcccactgggcatggcggcgacgacgtatgatcccatcggcagcttctgctcggagacgtggatgaactacggcgatnncnncagnagagaggnngtcanaacgattgcgcnccnncccctggnngtaagggacccnnncactaanncgcgcnccgncgccgnactcgccactcacaagagcggcaagaggctcnnaggtttttnnacggcctcgcgcagttgccgcggcgacgttctccggcggcgactgcgacgcctgcctcgcccaatccgccaaaaagggggccccccccaaaaaaggggaaaaaattttgggggggggttttcccccttncccccaaaaatcctggccaaactacccaccatccagaacttcccagaatttggtatctatggattctaattctacatgtcatctacacacatgagtgacactgtatcattctagtagatttcaggccggttgtttaatatatttctttcgtttatgtgtgcttgtggcatgtaggtacgagtactgcttcatgcggtactacagcagctacaacttcatcggggatgtggacacgagggaggacgcaagcgtgaccttgaggagatggccggacatggacaacccaaaggcgttccaaaaggtggtggggaaggcgatggtaaaagcaacaacacaggctgtctcggtgggtggcaacggtctgggcagggcgaaggagcagtacacgccgttcgtgagcgtctacgcgctggcccagtgcacacgagaccttgcaccgcctgcgtgtgctcagtgcctatcttcgacagtgtccaagtttgacaaggcttgtggcgctgcgcaggggtgccaaatcgactatagcagctgttgggcacgctacgaaatctaccccttctatttcccactcgaagccaacggccgtgccactattgatatgaacaagtacactaaagttaccatgcactgaataaatctagcatacatatgctacgcatatagtacggtaagcatgcgtacatacatcgcgtagcactttaatttcacgaatatgcactagctgcagtttgtttggaatgaataaagatgtgtactgagtatgttgtacacttaagtgaatcgaatatctctttatcattattttgccacaatatattaattggccaagttcgtcaaccattcataatgagcgccgcaatagtgtgaatgggaatatttggtcgagttaatttgatatagatgtgaacagtgacggacgtaggaattcatggccggatattcacactttaaaaaaatgttttatacaaaacacaaatgttgaggaggataatacatattaaattacaatagtgacataaatcatataggaataatatattataaaaatctcgagaatttgagcacactataaaataacaaaatggcccaatcttgagaacaaactcaagaacaggagacaaaaaaagcatacataaataacaatatatctatatataatttattttttcatgaaaaatgggtattcttgggagtactcaggacctactccccccatcacataaaaaaacaacctatagaataaaatgtgatagtacaataaatctagccaggaatatgggacagagagagtacgtgggatccatccatggatgtgaatatagaggtgaaggtggaggtggaggtgaatgagaatgtttgttgttgtgttagaatgtgaatgccagattcgcacgggcatttggtgcgaatgttcgcgcaatacgattcttgacgggctaccagccgggttttgggctgctagctgcagaaatcggagattgtcccttcctgatggtctttttgcctaggagtactccctccgttctaaaataaaccaacctcatattaggatgtgatatattctaatacagtaaatttggacagtatatccagattcgttgtactaggatgtgtcacgttttagtacaatgctagcttattttgggatggagggagtactactgaaatgaccaaattcacataattattggatagagtatttaatatgccttttttcagtgtaaaaataaatatttgccttccatccaaccagattcagcgaaaacaacgtcaatcaaactcaattccaatcggatactaattaggtttatacagtgctcctgcaaaccctataatatgataaatatttcaagacactaattagggatgagcgctatcctctcttaacaattagttaatgactaactagtaattaatagtccgaagccaatgacaggctaatctacgacaaccactacgacaagctctatacctccataaattattcaccagtaatccaccactagtccatcataatcttgatatattaattagtttattacatgccattgttgtttatagacctatgactttatccttttaaactctcttcaacacatcccttcatttcatatctaagttttatctacataatgcatggccttttattgttatcatctcgattcgtcttcatcctatcagccacatctaccctataccctatagttcaacaaatgattttactcatcactcattctctcgttcctcacgcaacggtctagattgcatatgcgaaatccaacgcaaggtcgtctccacctcccacccctgtatctgcttacgcgtcaaacgcccacagtccgctccacgttccacattgctcgcgatcttcctccacgcccgctgattccacccctctctttcaaccaccaccgccgaattccctcacagccgtcatcgtcgcgattgccaccgatcccccaccttgggttcgtcgtcgcggtgaccgagcccccgccgactgtcgtgccgcgccaccctgcctcgccctagcgccatcgctgattcgtttcatcgagatctagccgtcggcttcgtgccgcccgagagcaggaataacgcggggttggtgtgagggatcctcggctcgatcgaggcgcagcccgtgctgactaacggcgccgctgcagccatcttcatcatcaccggcctctaccctcagatgggaaaggaaatcttcatgttcatgtgttccttttctcctgattacaggtcatgtcgttgttttggcttatgtttgatcgtgcatcacggccttcataatttctgattgtatttgagctctatctccggataccctcatgttgttcgatgaaatgctcgtacacatacactgcaagaaatcatgtagtacatggagcatatgttcatgggtaatagatgtgttcatggcttttagggtaacatttttttttctaaaattaattgcactattgtgctgcacatacagcaattactgaattgggattgaacatcttaaatttttatgtgttacatgtaaacatgccattacatgatctggtggccgccactgccctttagctacaacatatatttggatcattcatatatttatatatttctgaaagtggtccaggtcatcaaggttgtctaaagatatcgaaactaattcacgaactaattcaaaaccaatattattttcttaagatcagacatttagactgtatatatgtgaattgatggcaactattgaataaatatggtcaaatatctcatgaacccgccttttttttcagaatccttttttttgtgaaaaatcaaaaccatctcattatggtagtacccgagttgtgaagttactgatgaaaacattcaaactgaatttggttgctgcatttaggatgtcataggtattttctttttaaatctctctcgctgatttggtttcattcatttagatgagtattgaaaacctttctcttgtgacaattttattcagttatgtatttcattcagctgatgaattatcctttgatcatagccattataaatgaaatataaactgaattgcactatctgcatgatataacttctacaattggattatgtttttcgattttggcatatattgtatatgaatttcatctacttggataaccgtgtttctggtttttttagggccttaggggggcatgtttctgaaatttaccgtctggaaaaaattctgacattgcttattatatactcagattttccaaaaaaatgcttatgtattgccagccttctagcacatgagtttggatgcttgttattgactgacataatgatagcttgcaatattaaatcggaatacaaacagtgagtataaaaacttttgtatgaatggaaccgtttgtgttattagagtgaggtttacatttggtcaatattatattcccgtttatgttcatgaaattcatcttgtttctgttcagtgcagtactcccttattgattccttcctcatttctgaacaaaaaggactcactaatcttagatggcatcatctacactattgacgcatcatctgcactattgacctccttatgttcatgcgacggatattttttcagatcagtgtggtacaatcctacttttgattagtgataaatagaagtttgattgttgaactgatcaatacaagatcctaatttgtaagtagcatctattgcacctaaaattttgtatatgcagtacatatatattagttaggatcatgtatattttggtattgctggcaaatataactctcaccttggatcacaaatgatttcagctaaacaccatctatataagtttaacagatatttatctaaactcaaaactgaaacaaaaaatgtgtttaatgtctgaaacttgcaaggtgctactatgatctctgaacaaataaacgttctgagtttcctagcagcaaattgatttgttcagagatttaggtgggggcacgccataataaatcgttgagactaggtcatataacaaattaatatgattttttaaagcaacttttctttatatttttttacataaaatacacagatcggaaaagcgtgcgtataaaaagaagtgagtataagtaaggaagatggagtaaaaagcacacccttaacccactaacatatgttttgcctcattgtaccccttgaactactaaaattggtttgctcgagcatttatcttcttcgtctctttttatacgagtcatattctaaagctgatattttgtagggccagacataacaccattatcaaagctctaaaatatttttaaaaattttcatgactattgtttgaaatttaaaaccacgatgtttaaatcatgcttactgctttgaaatatatgtatacggtggtaaaaaaaatatgaaaaatgttgagaggtaggttataatgtatctatatatcaatcctaccaaatttgcttgcaaaatacgacgtatatagttgtatatctttatctacttaaaacattcatagtgtttttgccgtgcatcgtagaatagtgtgtctcacacaatttttcatccgacatgtgaattgttggtccgtttccatgtcccccgcaaacgtccgactctttcgcccacgtgaaacggaaacaatcacatataaaaattcagtttccaatccgagcacgacaacatcacgcacccgctgcatgtagcctcaagcagtgacatgtgcctcccctatcacaaaaacgagactcatggcggtcagttgtcttttgagctgatagagattttttgctggtgggtctcacgaatctgtcttcaagtgtatagaaatcttgtgaccgccaacagttcatagaatatactttactcccttcgtttcatattatttttttcactcaaccagttttagctattaattatttggcaaaatttgctacaggacacgcaaaaaacgtgtaattagctgagagacaccgtgaaaacgtgacacggctgatggacactacaaaaaaatgtgtaattggccgtaggacaccggtcgcattattttattatttccgggtcaaaagaggtgagaaaattttcaaaatgacaagattgcccctggagccatattcccccgcgccaggagcggcagacggcgagagatcctgtgatggcggcgatggctgctgccccgcccctggggttttggacacgtacggctccatcttaccgtagagccctctgatccagcccatgtacttctccgccgctgccgcccgctcttcgaccagaacccatagtactggatgttgtagagcgcctgccggtgcgggaacggcgtcaccgccggcacgacgcggaccatctcgccaccgtaggggtcgaggatgagcagcccagcaccgtccttgaggagccagctccaggtggtctcccagacttggctgggcatgttcttggacgtacggagtcggacttggccttcaagtacttgtccggcttgctggtgtccatgtccaggagcatctccaatggcttccccgtgccgtagaacgtgaagtagagcacggactagatccacatcatctcgatgcagtcgctcgcggtcacaccgagctccaggaaggtgtcggccatcgcggcgacgaggccatggcgtgtgccgactaccgaggtacagggactcgaactacgcgttctggttctgcactacgacgcggagaagttcctgccgccgccgcctcggatggcccagaagaggtcctcccccatggcggccctatcgaggagcctccccctcggcgttcaccatggtggcacgacgacgaggtcggaggtgaggccatgcttccgcagcatcaggctgaagccgccgccgctgaggaacccgtcgacaccgaccgtcccactcgggccgtcgcgctgcccgcgcgtcgttcctccgctccgccgcgtgtgtgaggaagaagaaggatatgagagcaatgtgggcctgttgacaaaaaaaatcgaacacaccggcctgggagatctgcttagctcctgtgcaggtccaaaggttggtgagatgcgggcgtgtcagtcagtttgatcctgcaaccgacaagatttgtaaacagtagatcaaatagccgatcggctaaacagccaatggagcaatcccagccgattccgataccagccgatagcgatagggtttaagcaatcggctatatgtccaatgtagatgatgatataaaggcaatcagctgatgatgatgtaataaactaacaataatataatccaatagaaaccaatcggctaataataacatggtagaattagcactgatccgaaggttaaaacatacatcggctggaggtccgatgtcataaaatccacaagattagattaaacagtgaaaccttcgttgtcatcggctaaatctaacttatatatacaattcttataagccgatgcaacgtccagataattcattggctgaaaccccgatgaaacccttattggcagtcaacaagcaggctagggattatggttctaagcacgacttagtagatcaaacttaactgatgcagcactaagtatgaaaagaaacacaatatctagacaatcaagcccttgactgattttgaggatggtagatgcctaagctaatctaatctagcaacacgatttagccgatatcggcagaaaccctaaagcgagaagcagccgatagagctaaattaatatgctaagattagattaatagagacatatgataaataggtaggcaaatatatcatccaaaccagagcaatccaagaggtcgaatgtactgatgcagccttgaacgacaccgacgtagatgacagattcaccagggcccgacggaacgtaggacttactccttcgccggagatcgaactgaaccgatgcagccccgcgtcaggtgcccaaattccgctgaaagataagtaaaaacctcggtaaagagggtggcgatgcgccgagagtagttgtattgatcgatagataaaaattacagggacccctggtacacaatttatacccttgggtctatagagtccttgtcgaacaagaaacaaactttctaaaagataaaaggaaaacataaagtccttatcggacactaaacacactttcctaaagataaaaggaaactaacaaactattcctaattaatagataaattgccatgccgcatcctctttgaactcggtcgtttatggataagcttcctttagtagattgatttccttaaccgaatatagtaggaatccaactattggtgacttgataacttccatcgaccgattccgaaatgatgtagccgataatgactctaagccgatgatgactttaggcttaccaaatttcactgttaacaggggcccacttatgattagcaaatagtaatcaccctactaattaggtacaaattagtccatgacgcgtggggccaggtggttaaatacctattaaaaattagattaaacatacactgtctatgacatttgggacccactggtgtttaaagaaggaaagagaaggggcaatctgggcatttagaaaaatatctcacctcttttgaaccagaaataagaaaataatgcaaccagtgttctatagccaattacacgttttttttagtgtctatcagccgtgccacattttaacggtgtctctcagccgattacatgcttttttgtatgtcctgtggcaaattttacctaattatttttgtttcacggattcaccagttgcatatataatactacctccatattttaatgtatgacgccgttgactttttatccatcgtttgaccattcgtcttattcaaaaaaattatgtaattatcatttattttattgtgacttgattcatcatcaaatgttctttaagcataacataaatatttccatatttgcacaaaatttttgaataaaatgaatggtcaaacgttggttaaaaagtcaacggcgtcatacattaaaatacggagggagtagttcattttcttaaaaaattgctaccatatcatccatatgtgtcatacattaaaatacggagggagtagggttttcgcatgtggtttgtgctgcccatatggaaagatactaaaaaatattttttatagtgataagcgtcgttatagcaaaaaaaaaatatttagacctagcagcctgcaagaacaggttttagccaaaggcgaaaatcattttttatagtgataagtgcccttgcagcaaaaaataaaatctttataccacactaataaataattacaccttcaactattgattatctctacgtgaaacccacatctctatcatatgttccatccacgacatgcctgagacccacccaggttcataagaaagccccccaaatatccatcatctaactctccgccaacgtccacgaaaaaaaataacatatgtaatttggatttcctatcacaatgcacgagcatctttgctatttttttttaaaaaaagagaaatgagagagatgaaaggaaaaggttcacttgaggtcccttatcttgtcatcgagtttcttaattgtccctgaactaaaataccagatataacaaatccctaatcttacaataccgggtcacgttaggtcccaaggcagtattgctcctcggttttggtgacgtggtggctgagtcagcgtgggacccatgtgggtcccacatgccagccgataatcttctcccacctatctcccctttcttcccgtctcaacccaaacctccagggcagtcagcaacaggtggggagaagagtggcgactgacggctgcgtcatggacctacacggcaaagagcgcgaagaagcgaagtaggaagggctcccgacacgtcgtcccctcgggttacaccaccacatcgttgcgtggcagctcgccgcgcatctgcgccgcgtccgcatcatggttgcatatcagccacaccgtcgggattggcgggaggatctccaagagttgggagatggagtacgttgcgacgcctgagcatactcgcgagcaccactgactgcatgagtgcccgtgcatgcaagcgaaaaggacgccagacgctgaatcgcgggaaaggtgtgtggtggccggtgaccagcagggaaaatggtggtggttgttgggcggcggcgataaataaaagcccgacgacggcgcttggcgatgggtggggagaaggctagcaacgaacaaaaagctttgcgatggccagcgttggggaaaagggcgcatgcatcgaggaccatgctaccgcaacgtggagtagatggagtcgacatcgaagaccatgcggcggaaccgcgtgtttgcctctgcgaagaagagctaaacctcggggacacgtgaacacatcggcttttgagcagctcgatgggggcgactatgagcttgggggataggagcttggccagcgtgacaaggcggaagccccagccctcacgcgtgcccgtgaagacgacattgcagttgtagttgggacccgtgccacaccccgcacgtgcgcaagtccatgacgtgagcgctcctggtcattgggagccacgtcagctggcggcctccgccgtcgagcttttccccgccgacggacacccttctccccacccatcgacgaatgccctggaggtttgggttgagatgggagtagaggggagtgaggtggaataagattgctggttggcttgtagggtccacgtggggccctacactgactcagccaccacgtcaacaaaaccggaaagcaattctaccttgggattaaaagtgatccgttttgcaagattaggggttcaaggccgtttaaaattcaacgacaagaaaagggaccttagatgaacttttttgggagatgaaaaaactccagcctcatgggcctgtgcatatgacccataggcaggcgacaccgcggcagcagagcgctgcacgacctccgcctcccccaatccgtcccgtctcctcgcccgccgccctcgactcccgtctcctcgcctgccgctggcgccgatctccatcctgctagcagaggtggcgccggcgtcctcctgctcccgccgcattcgctcaccggtgagcatcctaatccatcccatccggtctcggtctcggcctcggcctcgaatttcgtctcctcgcccgccgcttgcgccgatccccatcctgcgagcagaggtggcgcccggcgtcctccttcttccaccgcatcgtcgctcgccggtgagcatccctccctacccacacctcatcagttattctgcgttatccctcaaaaagtttgggggttcaaccgaaacagggttagatctccctctgcctagctccacctactttcaagttgttaattttgatttccgtttttagcagatgtaatttggttactgaatctcatccaaacacccttagaacgaaaaatgtaagctcacataatttgtactcatccaaactcacataaatttcttaagaagaatctagaccacaaactacccatagtcacacaaaatatctttttatcaaggtatattcttataagtaatttttattccacaaaattttctaaaggacatactgtgacacttggcattaatctaatttaactttttttctttatcaggttataaattttctaagacatttgtgccacttggcatgaatctaatttaacattctttctttatcaggttataaattgaaaccattgaatgtactttgtcttcccgtctctaaaacattgtgatatatctataatattttaatatttttaagtttaaaaataatttagactaataatatagatatttaaattaggtaattaataaattcaaatcaactatagtttagaataaaaaaacaaaataatatatgccaagtacaatctaataacaatagaatgttagaaacaatatgaattcaatatttttataaattttaagtacgattcatacataaaattaaagaaaaatataaatttatatataagtgagaacataataaaatgcaagttaaaattattaaaggaaaaatattattaataaacaatgatgttgatgtatttctaaatattttcacgtattatttattaagtgtcaatgattgaaatggatgatttaccatgtaacagattaattattaaaattatattgttttcatccgttacaatgcacgggcattttactagtctatataattgatcgctctatcaataaaccctttaatatcgacaagtaaccacaacgttaagccattgatcgacaacctaaaagctacaactgaccataaatttcactggcttagatgagatgtaaacacataaataaaccataaaaaacgagaattcggagatgatggcaccccaagtccccaactccaaaccattttccggacaaaaaaaaaacattcaactctaaaccacagactcatgagaccatgtaactcaagcaaatctgactaacaaagataactcgaaatcaaatcgagaaataaatgcagatttgctaaaaagacgtgtgtgaaccggtcccaaattctcacaaatctgatccatgaaaatctgcagccgttatgaacttccaaatttggttccaaactctgaacttttgctcgccctactaacccccctcacaaatcgcccaaaatccgaacgacgccgccgccggaatccgccaccgccgccgacggaagcaagggcaggtcaggccgtcctcgggagggggggagaggagaggcgcatggcgaagctggggccggggcaagggctggggtgcgaggcggcggtggggttgctggcgccaagcaggaagagggagtacaaggcgtgcaacaagctcaccgaggggaagcgggcgctctacgccatcggattcaacttcctcgacttccactactacgaggtcttcgccaccgtcggcggcaaccgcgtaagcatccccttcttgttttgtttttcttttcttttccccgtttagagttgttcttattagtgatgaataatgatatatatagagagagagagaaatagggtttgatttagcaggctgtggattttgggggaacaacggattttggtttgaaatttggtggaaaccgcgctaagcatcccatcttgtttttagggtggtctttgccatttggagttgttcttgtgaatgaatgatagtaaatgataagtgtagtaaatgataagagagagagaaactagggttttgttttagaagattgtggatttggggaagattacgcagattttggttcgacatttgatggaaatcaaaagctagtaaaatttccttggaatttgaggtttctaccattttccttttgcatcgaacaatctgcgatttggcatacatttcggcagatttgatgaaaattgtggtttttctgggatcaatcatatactagacaaactcttttaatggcaaatatgatgaaagatggttgtctttagtgggctcgtgtgaccaattgtgttttcttgatcttgcaggtgacaacctacagctgcctcaaggatggtaattttgctatcctgcaagcatatattgatgaggatgtaagctccgcaacaatctccagtgtgtgcagttactttttttttaaaaaaaaaaaaactttgattgtgacattgtgtgacacttctaactctttttaaaaaaaactttgattgtgacattgtgtgacacttctaactcttgaggtctgcattcttttctcagaaggatgaatcgttctacacactgagttgggcttgtgatcttgatggcacaccgctgttagtggctgcaggaagcaatgggatcattcgggtcatcaactgtgccactgagaagttactcaaggttcgatagtgccatattctcatatgcttctatagttcttggcaaacttcaatgaaaattcatttttgagaatctatgctcttttgttatccgacatacccatgattgaagctatgcttcagataatagttgcttctttggtaaatgttgatctgtctatcttatccatttaagaaggtcacttgatatttgcgttgattaagagttgcattgctatagaattgtttttctttttgggtctacaaaagtgtaatttttgggtacactcctgcttgctacgtggctgatatgacactatctgttgattatgcattatacgtggaaagttttgataatactatgatacatatttagaacaccacaaaatagggcacatcaacaatttactcttaggcataaaattactatagttcagatctattttgtgctcattgactcttgtgcgtgtattttatggcctttcatttggctatgaatgagattaatctgctgaattggcttttgtccacaaggtttgctttgtagtcttatataggagagaagaatggtggaagatgtagaacctagtggatcttttccagtgggacagtcagaaaattgggcatatcaattatttactgtcatatactggtgtgagggatttagggtgaatgtcttatttctgtatatttgttcagacttttgttggccatggcgattcaataaacgagataagaactcaagcattaaagccttcgctcatcatttctgcaagcaaggtttgaagatagccttttctggagctggatctttctatgtttaattatttctgattctgtttcacatggcattgcataggatgaatctgttaggctggtggaatgttcacacagggatctgcattttgatttttgctggagcaggaggtcaccggaatgaagtattgagtgttgtaagttgattctatttcccagtatgatgttatttagaataatactcactacaaaccacacttccagcttctgatatcatctttttcattgagctgaacatgttttagttgattccatcagtaataaaataaaaattaggttccacaatgacagtcattttatttgtagtccgattacattaggagaaatgttgatcaactatgctttgctgcaggacttccacccatctgatatctaccgcatagcaagttgtggcatggataacactgttaaaatatggtcaatgaagggttagcaagccatctcaacatagcttttttatttgcattcactttatgcttatcattgacactgttagttaatattatcatagaattctggccatatgttgagcaatcctttacatggactgaccttccatcaaaatttccaacaaaatatgtgcaatttccggtatgctaaatatcttttgatcatctttgaactattattttgcaagattttgttatttcatccatgtggcatcataccaatctttctctgcttccaggtcttggttgctgtagtacattctaactatgttgattgtactagatggcttggtgacttcattctgtcaaaggtcaaacttcatcttctttgaatggatttatggattggtagagatacagtgctcataatgcatccatactactgatgcaaaacttcagtaggattctcatcaatgctaacttcaatttgcagagtgttgacaatgaaattgtgctgtgggagccaaaaacaaaagaacaaagtcccggggaggtgttataattcaacttctctagaactacagaccttaattcattttacttgtcttctgatctgatcatctcaacagttttctgtcatgttactttagttttcactatccctttccatacgtctccctctcaagtaaaattactttttttttttcaaatgtagggtagcattgatattcttcagaagtatcctgtgccagaatgtgatatctggtttatcaaattctcatgcgattttcacttcaatcaattggcaataggtaatatctcccaaattgtgttgttactttggaaaatttgtgacaatattgaaaatgttttgtttgtgggaaacggtcatactcagtactcacaagtcaaaagattacattcaataaaaagaattgtggaatgttgcccagcacccttaatgttgtgacaaaaaagaaactaattcacatatttaaactcattgggtttagattattatttttaaacaaatactacactgaatactcaaagataaccatgtgcttatttaaacaggcaaccgtgaaggaaaagtctttgtctgggaagtacagtccagtcctcctgttttaactgctcggtaagttccaagaacttcagttgtttcccatcctttatatgcacttggttttggacgccactaaatcttgtatttctgcatgccaacacattatttttacaggctgactaatccgcaatgcaaatctgcgataaggcagactgccgtgtcatttgatggaaggtgcttcactaaattctaatatccaatcctcataaagtgcatattccagcttttacttgcccacaattcattttggtgaagatcctgtgcattaagtggatgcatcgttttctgcttgtgtccttgtttggtcttcaatgccccgacatgtgtgacattttttctctcttgttcagcacaatccttgcctgcagcgaggatggcagcatatggcgatgggatgaagtggaccatccaaaagcatgaaaagtacccttatagacagaccatggcaatgccagattaagattgacttgggaattcctgcatgtgtactttgttgtgggggttatagtaatcagtcttactgttgaaaaaaagtgcaatctgatactctgaaattagaaggattgacagctgaatgctggggttaccaacttgaatgttgcaaataggatactgcttctgttatatgctgaatgtttcaagttagggcctttttgtaaatgggaagattcggctatgccagatttttggaaaagttgccatttgctttgttaccaaagttgcatggcaaagattggcccagctcaaatttctatagttataaatgagttgccaaatattttggcttcaaacaaatgggtgccactttttattttttggtattgccaagtgccaactactagaatggtttctatcaaaaaaaaaaaaaaaacctactagaatggttcagtttggctgtaaaccaaacaaaccctatatgccctatgcctctatgtatttgcttgtattgaccattattgttctaattttgaccatcggtaacattttaatgattagattacgagtaaattgcacccacagtgcatcagcttggcaggtgggtgtaatttagtgtaagaacttgagaaatgagcgttctagtataacaacttggcatgtaggtgcaatttagtataagaactttataagtgatcgtataaatgcaacaacttgcaagatatgtacgattttaataaaataaattaagaagttatgtggcagtttaattattgagagcatttttttatacatacaatttttaagtacttatgttgacaatatactagcgtggatttggatataaagaaaacaaaaattcttaaaggtaattggatgtgcagtataattcttaaaagattaaattcaatattataaggtgatatccataggattgctatgtaatgacatattaacatcgtgagaaaaacttacctagcatatgcctagctattcttgtactaaaacgcaaccacttgtcaaattgttgcactcgagcgttcaattctcgagttcttgcactatattgcacctacccgctaagttgttgtatcgtgtgtaatttacttttagattacgataaataaaaaagagctaaattgtacttgtttttatgcagaagttgatttttgttaggacggtggagactgtagtttagtgaaaatctagaatgaacgtagctcaactggttaagttccttgtgatgaaaccagcacactcgggttcaaatcctaaatgtgacatgtgtgttcgtatttacgcctaatcattcttttagtggtaagcgacataccagttgatagcgaggcacctgtggtgatttcatcaatctcaattctcaagatttgctagctcagtttactagaggtgctcgtagaggtagtttgtgtgcgtgttgtcggcgtatgcattttaactatgtttcaaagaagaaaagaaaactgtgatgaaggttgtgaaacggagggaacattggttgaggtctgagggccgtatcggacggctaggataagctccagttaagacgatccgacgcggggggcaatttcggtacaagaaaaaaaaatccttcattttctctcctcctctcttccctttcacttggccgtcgtctcctccccccgaacccggccggcgccgaccctttcttcttccgcgccggcgacgaaccaccgnctgcgaatccccctagccggcggccacccggatctccccagccatgtaccgcggcgggaagttcccccctctctcgcccccgtccatccccgagctaaaccctaaaccctagagatctgtggcactggccactgcttggtttttttcgcagatgaggtctcggccatcgtcatcgacgtggggtcctacagctgcaaggcggggtacgccggtgatgacacccccaaggccgtcttcccctcggtgaggcagaatgcttcttattcttcttcttcttctcccatcatgggttggctcgctgtaattctgtctcggagttggaactgtgtggtctgtgttttgttggtgagagttcgtgcgggtggtgtcatggaaatgatagggctctgtgcgcaatgcaatcccactggcaattttgtgtgttttctccccataattttgagctgttttaggtcgttgactttgaattctgatttgaaaaaaaaaagaatgatgtgttagtgtgtggcgtcatgatatacagacatatgtttattatttaggtcaagctgtgaattttgctgcgtgcattagttcctcctaggtccccagccacctgattaatggttttattcgagcactggatcttagtctgggaacatgaataacagcagttttttttttaaaaaaaatgttagtagcaggctaactcagatattggatagtaccacagataagacctgcacttaccttttgattttgacatatgcgtgcaaaattatgatgtattgactgcattgttagtttacctttcagctttgtcttagctgcaaacctgtgccattgctcgcataggtagtagttagcagtgttgcatatgtgcactgagagtcaaatgccaaactgaatttttaaagtgctaaaagaatctgcattgtggtttctgtggaattgctacatgttggtactagacgttaacttcaaatgctatgacaggtgaacttctggttactgtgtttgtaacgggaagtacttttcttgtgtattatgtcaaataggattgtactctttctgtcccaaaatataagtatttctagagttttgcacgggtattaaggaagtaggtggaattaaatgggggatatgatttttttgattggttgagatgaggaagtagggggtgaagttactatattttgggatgcggtatttttttgtcttaggttctacagtattattttttaaaatttttttcttcctttagttaacagacttatattggggtaatttgaattcttggagtagattgctaatttctctttgttgccgaggaagtgagaaaacatataatttagtgacatatagcaaaacaatcagctgtaaggtactaaaaagtggtgtgtgaatcacacagaaaaagtgtttttgagtttcactatttgatgtcgctgctaatagattagcatattttcttctcctttttctacataacgtggcagtagttgcaagatatgtcattggttcatgggattatgcatctgagctacctaatgggtaatttggttttagaagttcttactgtggttggtgcacattctgttgtgttaaggttgttggttcaattgagcaaacgggagaaactgatgaagcaaaggcagacaaggaggctgaagctgcatcagattctaagaatggagccaaacctatggatgtggacaaagccaagacaaagcgcaaattgtatgttggtcaagaattggagttcaggagggatcatatggaggttagtttatgcagattctcaagtatcaatattgatgctcatgattttgttaactattgtttactgattctcttcctacccaataggtgatttcaccaatgaaagatggaacagttactgattgggatattgttgacaatatatggaatcatgctttcaggtgagtttaactatctatttgatgtagatctgagtaatgtcgtgccaaaagtgcgcgctgaaagagctggccacacttgtggcaaaacttgactagaaaataaatatctgacatgcggggcacttgagtaacaaggtttggcacattgcttgtgtggtttgccaaacacttgccagttgctgcaaaaggccaaacatgccttccttgattctggggaagtttgggatgaaccatactctctatttaacatagtttgcttagaatctgcaacaaagttcatcttctaggcctctagggcatcttttggatgtcaacatggttactgctttatgccattgcccaccatctttttaccttacatattaatattgtgcttttcaaatatactgatagtgaaattccttcttacgtgtacaaactggataaggctttccttcttgggttatttacttttattggattctgtggcatctctattagctaacattgattaaatactaggatttcctctatatggtgtggatatgcaactattgaagtttctgctttgttagcttttatcttcacactgacttgctctacatttcaggcagcggctattgatcaatcctgaggagcatcctatgttgatagctgaaccatctacaaacacaggacagcaaagagagaagtatgcctatatgttctgtatttaaattaattgtgttgctaagttgcgtcaaacctgaaaaacattgcttgttatatgaactagctgatttatagcacatttatcttccatgactcttatcagtcatgagaactgtattggtaccaggatttactgcatgcttttctacttctccatttaatgtcagaaatgttagtttttctgtgtttctgtacttcaggaatggacaaatatggaattgttgatcaccctgtaaaacttataaataccaataagcacaagctgagatgatatgaatccgagttatatctattcattgcctattatttttgtatggttctatgaaaaagacctgactgtttttctcatgttccatagagcagcagaacttatgtttgagaagtacaaagtgccggcactgttcctagcgaaaaatgcagtatgtatttgtcaaaagtgataattcgtgtaattagtttattagttctaattgttgatttggttgtcaggttctcacatcttttgcatctggacgtgctacatcgttggtagttgacaggtgagcatgtccttaattaaattttatttctgcagctgtaacttactgtctccttgtagataaaatgtttcatttagccttaacttataaacaaatgcattataacttttgaattctgaaatatttttccaccagtaagtgttagggcgttaggcacagtgcacaaatattgggtgtatcttaccttgtcaatcctccttagaatatgatgacaaatgtccatggaagtagaaaatggctgttatatcaaagtcaatctgtcatgcacagtatttcaaatataaaaccaaactacacatagacaaacaagacaaatcctgttgaaactgaacttagaaatcaaaaagcaatttttaatgaccatctgcatcattttttatgaaggatgcgcttgcatccaagggtggaaagcgagaaacactatccttgtctgttctgtcaatcccacttcccacaccattcaagaatcaggacatcaatattttctttactggtcatcaatattgtacttgagttgattgatgctcttctttccccctttactgtatcataaattcctaacatcatcttggtatagggtgtaagcataaccatctaaattctttcagcatgttttaagccatagtatctgattgtctcaaatttgatgcctgacatgtccaccgatgtctctattggactttaatggtgtcaagcattttatgacttatttcatttttgttctcatggcttttgggctttgttatgagaaacattactggaatgagacaatgttgtcattttttgtgcagcggtggtgggtctactgtggttgctgctgttcacgatggttatgtattgcaaaaggtatgatctactatttaatactgattgtcaaggcaaagtgcataatgcactacttgcatgtgtctaattagttatttttaccctttttattctctactttctcatctgaaaactgggaataagggaatcttcttttaagacaataagtttctttttcttgttttacatggacgcttgctcacataacatggacagcactctcaccttgcctctcaggaagtatactttttttcccctacttgttgctaacttatttcatgttgcagtctgtggcgacttctccaattggtggtgaatttttaactgactgtatgatgaaaagcttggagagcaagggcgttgttgtaagcatctctcttgcttaagatagcatactagtcttcttgtatgttcatatccaatttgttcaatgttcaatttgcagataaggcccaggtattcattcaagaagaaggaagtcggccctggcgaatataaggtctagtttatttaacacttcgttgatattcatattttttccctgagagctacaaagttgactgtttaagcttacctttttgttgaaaatcaactataacaatatatgcttagctattggtatgttcgaaattagttcacttgataaaaatatgaaacagtgaaagcagcaaacataaactacaaaaatagttaactacctatggagtgacttcacagtccacacattggcatttgattactggcagaaaaggtggaagatcctgaggggcagtctgtttttttgctgaccttgttttcggcaccgaattaagtcttctccatgccacatctctcaaaatatactttcgtgtccttcctctgaaagataaatttaatcaccaattccttgtatccccaagtgtggatggcatccaaagcatccaaaaagtgaaattagtcaactactacaacacctttagtctcaaacaagttggggtaggctagagatgaaattcaaactgaagcacccaaaccaatgtaccacttaaaagtgcatgcttttggcacatggatagctactctccacaaactcctatcaaaaccaaatccacacacacactgtgagttaccttgagtatgtctatgtctattcatggagaggaatactatggtcattatttcttagcatttatgtgggggcctatttcttggtggtcaaactcatttagtctattattaagggtctgcattattgtgttacttgatcatgattatggttccactttgatacatgtggataccatgatttttgctaatccctggcttctacaagattttgctgccattacactgtatgattgtaagggaaccaacaccatatggattatttgacggcatgcttgtcttttcaggttgtagatcttgatcttccaaacacaacggagagttacaagttatactgcatggtattttcattgacagatcatttatttttgttctctgttgtttaattttgtctgaatgccttcaatggtgatgcttcatatgttcacagagagctattgctagtgatatcaaggagtcagtttgcagggttccagatactgccttcgatggtataatataaacacatttaatttatgaatggggcatttgcaaatttgccaccggttttttcaattttgcaaggatgccactcgagtgacagttctagtggcatttttgcaattttctagtggcagtcttgcaataacgattcaaagtagtggtaaatttgcaattgtccctgccgtacacgcactagttggctattttttattattatctgaagtcctgtaacataaattatctttgttgcagggactgttttaacctgtccttttatgttcttttttttatgttctgctgtttacttttccctgttttattttcatgcagaagtggcatatgcaaacgttcctacaacttcatatgagcttccagatggacagtaagttgtatatcaaaattatttatgcgcatattttttttccagtaggtttagtggtttaattttgtaatggcttattgacgtgttccaatacagttagattatgagctacttttctgcatgtgcatctgctgcatctgtgcatgatacctcagtacaccacaatgattgtttataaaattgatataccacaatgaaaatcaacaatatattgacataaaattaatactccctccatcccaaattataaggcatatatattttttacatggtcttcaatgacatactttgaccattaatttattccatgtcatcttcccaatgaatatgaaattagcatcacatgaaagtacttcaaaatatgaatctggtgatataacatgcataatacttagcattgatatggttagtattattattagtaaaaagttaccgagtttgattttccttaaaaataagggcgtcctataatttgggacagactacagagggagtataccacaatttgaactagttcagtgaaatggaagtcaaatagaagggagaacttgagtgcagcactaagatttattgtcctttaaccttcccatgtaccttcagcttctatatgttgtgactttgcagattggtaggtcatctcatgaaccccaactttctttaaattgtcatggtcatttggcatgttattttgagagtggcgcatgatgcaccaagagggtgttgagatgcaccgatatagctgaacttttccttgctattttctacaacattatggttaagattttgtttgtgcaatgtacctttcaagcatctttaacttgctgtctgatatctggacagaaccattgaagttggtgcagacagattcaagattcctgatattctgtttaatccatctctttctcaggtgaggtttgatgaaaagaataatacttgctgtacacttgtatttcaggcaggatttgtaactggtgctggtactagattaccttgttccagaacaaaaccagcttgctgttttcttcttcagtagatgctgttgatggcttgaaaaattcttttgaaccatgttgaattgctgactctcacatgcacacgaattttgtgatgcatagactattcctggagttgatggatttgcagattcaatgtcagttcgtggccttccacgaatggtgagttaaatgagagctagacttgcatttactgttgcgcatccctggcagttcttcatattactgaagttgctattgctgttactttctcaggtcattgatagtgtaaataggtgcgatgttgacattcgcaaggaactgctaagcagtattctggtaaatgcctataaattcttcaaccacattttactagctctcttggtgttgccatccatgagcttagtgatatctttcccaaaattctcttgtgaagttctgttaatacaattctaacatctgcaaacatgcattgtggatagctttcaggtggttcatcatcaattctgcagttgaaggagaggctagaaaaagaagtacttgaggtatattttttcttcagaacaaactaggactgccctggcctcatcctgtttatacttcccatttttaaatgtgcaccattttatagcctgtgcagccaaacttttaaatttttaactactaaagtacattgaaaatattccggggttgctacatggagaagtagtggtaggtttgcctttttcatgaaaaagtatattttatcattatatgaataacatataattataaatgcagaacttagaaacagttaaagatttgtggttggagtcctttgatgtctctaatgccatctgttttcaaacagaggaaacaacatataggagtcaagcctatgatctttttctttgttcttgtccaatatggaaatacaagaataaatgaatctcattttttttcttgggatagttaataacgggccagagtgcaagttaatagaactctattctgttttcaggctattgaaaatgtttccttagaccttgtgcaaggcttgttcttatatatacctcaaaatattgcaggaatcttctggtaatactcgtgtaaaggttttggcaagtggaaattcagtagagaggcgattcaggtattcccttttatctttgtagtctttatccttcccaaattcaattgaacattttgctctactgctcactggagaagtttgaatgagtgccttttggctctgcaaagtgcaactctgttgcttgtttttattgcttgaaaagcttaacacatgaactaccaaaatatactgatcactttgttctagtcatacataccttaagtcattttattctgcagtgtttggattggagggagcattctagcatcccttgggtcgttccagcaaatgtggttctccaaagcagagtaagcacaacacagtattttaggttatgtttcccctatctcgtcacggacagctcacaagttaatgtgatttatctcactatagatacgaagaacatggagtatcctacatccaaaggaagtgcccatgaagttgtggagcatcgctacgatttgtgaccaaatttgggtgcatgtgggcaatcgtattacagccaccctgttgttgatctatatcgactattatccgacgatatttatcattatattatgactagttagtttgtagattttgagagggcaacataagaagcaatccagcttaacctgttatgttcttgatggtagattctagttcatgtgttgaatctgttctccctgctgtagaatgtatcgagttgctgctctctactctgtacttttagaataccttttcaatcatttggagtcagctgattgttgtactacttatacgccacctgattagtcatgtcaacaattaaacttgagcactggttaagttaagagtggcctgattgtagttgataatcacattttattcgtagacattgtatgctggatctttatcagccaccgtcagatcatcctctgtaataaatcttcatcagacgtgtgtgccaatcgcaaggaacacgaaatgcatccgaaatgttactctgagttaatcaatactataattcttggtcaaattaattatttatatctataaagtttaaattaaatttaggaaaatgaattcatgcaaatcttgtggtaagttgtcaatttcataaaaaatccagcttactactccctttttaggagtgtgttgtggctgcacacttctgccttttgatatatacggttctattctcggtgtactcctttattattattaaaacaatcccagttacttggtaagtgctaatcacgaatcaaagtcaacataacaaatcatgtgcgtacagctataactcgattacacaaacaacaaaattcatatttgaacataaatccagttgtagcatatctggtagtataaagttttttttttgtatagaagagttttaatttctgtaagttttggaaagcatttaatcctagaaattgtagtgtagctcaactaaaaaataaatgaacttgaatcgaaattgggttgtatcataaatctttaccactcaaacgaatatttatcctaaaccacaaatgactcttttcatcaaggaatgttttgttttcagcattttaaaaaaaaacttttctaatatggttttcatgtttcgttcttttgaaatttaacatctatttaatttgcacggctccataaattcaacggatacatattctgaataattactaaggaggcatatatcggctctcttaatacaaccgcttgtttctcaaaatttattttgagttttgtctacacattctcaaggacggtacaaacacactatagatgttcacaattttttttttctaaagttgattgatggacaaatgtttgaacatataaacatataagcactgaatatttgcttatgcaggaggtatttatatcaagttcgatactttactaccatagtccctaggacactaaaatgccttcaatgatctgatgaagcctaagagagaatattgatcagtggagcgacttgcaactacacatggcacaagtagactagacacggtatatattcatattaacttgttaaaattttactacttaacagttcacttgtggtgcatccatatcaattcttacttacacaatatttgtaaaaacaacctaacactataggatgacctagacaacctttatgtcaatcacacttagaagatgatcgtctttttaataaataatgtgtactacacaccatgctctccatatagatcaagatctacaaacccttccacttataaaccttaccaccaaaaactcattaagttgcttcatttatctatgctattaagaaaaaaacttatttcgtttatgccatttctagaaatggctagtcacactattcacaatattatataataaataaaagtttcaaatattcatccaccaaaaatcatcaagtcgtgggacttatatgttaattagagaagtccctttgggtgcaatcgattttggaaaccctaaattttttctatacatagaagagagagatgtctagttgcaattgcttttgcgatgtgccaaccacccttctagctttcatccacgtctacttaatggccattcttcttcttctttttcttcactattactacctcctatcttagcgaatctttttttcttcactattactacctcccaccttagtgaattcatcctcattgttcacaatgacattgctaagttaactaggtatgctaagtacacaattagaatataacctagagcctttgtttccatcatacttaaaagatgacatttttatatagataaagtgtgctactcacaaggcttactatatatatgtatgatacacacaaactccacaacccaaaactctttcaagttgtgtggcccatctatgctattaaaaagcccatttagcccatccaacatgagaaaccctagggttttttccctataaaagatacctaggttattgttgcttttccaccccgcccgccgccgctccctattcctatttaatcccatctctcttcctcatcaccgctctcctctctccaggcaagaggtacgcactttttgtttcggatttgaaatctttgcttcgttttactatcattggtcataagttcttttttgaagatgtttgagaataagtttatcattgagattatcgtcacttgtgataggaagtacgcaacctcaagccggacaagacgtgagcaaagatgggccccactagtaggaaccataaatcatctcaaaaagagtaagtggtattcttatatagcacacattttttaaggatatatacatgtttcccacaaatgtttcaaacacatatagtgatatatttaaatccgacaacatttgaattgaagtgtggcaccgaatgaagccaaaccaccccgatatccacagcgcaaccgctccatcactgcctctgcctctgcctctgcctttgcctctcccgctgttgccaactccagagttgccaaggaaaggccatcttcatcaactgctggtgaaggtgaaccacaggaaacggtgctaaagcttccaagcatcccaacacttcctgcacggatggcaaagttggtgccattagaggggttgggatgcgaggcagcggtgggatcgctaacaccgagtcgggagcgagaatacaaggtgaccaacaagcacactgagggaaggcgccctgtctacgccattgtcttcaatttcctcgatgttcgctactacgacatcttcgccaccgcctgtggccctcgtgtaagatttcttacgaggcgccatattgatcttactagggaagtagtagcgcttcatgtttctataaatagatcaaaatctagtatttaccttattatcctattcgcattagatgtttttaatctgactttgtgtcacgtcccttttttcatgtttcttaatttgcctattttgaaaattcacattcgtgttcattcacctaaaatagcttaatgaaaatttcataaatatttttgtttaaaatttgactaaataaaataatcatgctgccatttattttattgtttgttaattggagttatggttttttattcgagtttggaagtggagctcaactctgtgaattattatcaatctagaaatattcctcaaaattatttttgttttatatttattaatgtaatcgtgatgtggttatgatattaccttttgttattgtgtgtgctagagttgatctgggactaacacattatacacagagggatcctagttggggtcccgacactttgcgaatgcgctttacactttaaaagtgcattaaaaaatataattttgttgaatattttgataaaaatataattaggggaaggaattataagatcatagatttcattgatcataaaattaaattttaaggatggagttatgcacatatgttattttcaatgtgtttatgctaacacgttgcgccctcgtgacctttgcagctttcaacctaccgctgcctcatgaatggcaaatttgctcttctgcaaagctatcttgatgacgatgtaagctctgccaataattttgagtgttcagtttattatctacaccctctgttccaaaataaaccaattccttgctatggatctagagatagcctatgttcagagctgtccagatccgtagtcaggaattgatttattttagatgaagaagggtttgatggcatgcctttttctaaccatggtggggtctccattgccttgcagatgaatgagtcattcttcactgtgagctgggcttgcgacattgatggcaatccattgttagtagctgcaggaagcactggaatcattcgagtcatcaactgtgccactgagaagatatataaggtctagtagtgctagtgccattttttcttctttgccactactgcaaccttggataaactttgctctgtatcagtctatatatgtttttttttcagtaatatatgccaagctatggttctgttgcttatatattggaaaataatttcttatttgatagattctgatttatctgtgttatccattccaggaggtcacatgtaattcgcttcgattaagaactatagcaatcttttgactttctatatagctactaaattgtgccttttctcttctaaacatttgtggtttcagtgggtctttagcatgtctagtcagaaaattggcatataaattatgaaccattctatatcaagtacataactgatgtgcggccagtgttttatttctgtttatgaaaaataaaataaaattacagagtcttgttggccatggtggttcagtaaacgaaataaagtctcaaccatcgaatccttcactcatcatttctgcaagcaaggttagaagattacattgcctaatctgatatctacatctatttcatttttactgatgttctttcatacggcattgtgtaggatgaatctattaagctgtggaatgtgcagacagggatcttaattttggtttttggtggagtaggaggtcaccgacacgaagtacttggtgttgtaagttgcttaagctccactgtagcattttttataaaaaaaattgtaatgctactaattaacttgaaattgtccttaaaaataggactcatccagcttctgatgtcactttttttattgagcagattcaattttattcatttcaccaggagtgaaataatccttagtcactgaaattttgcgcattctttctttacattacgagtgcaaatattaatcataattaattaatattattgcttcaggacttccacacatctgatatctaccgctttttaagttgtggaatggacaacactgtgagaatctggtcaatgaaaggttagtgaaccatctcatgataaaaagaaaaggcaattgcatgatgcttatcggtgaaagtgtgtgaatgctgtagaattctgggaatatgttgagaaatcctattcatggactgatgctacatcaaaatttccaacaaaatttgtccaatttccggtatgcttatagtatctgccaatcatatctgaatctgttctttaatctgtaatttattagtatgtataaccaatatggtatcatctctctcctttcaggtcctgtgtgctgaaatacattctaactatgtagactgtactaaatggcttggggactttgtcctgtcaaaggtaaaattgttattgctcttttgaagtcaatatttatagtgcttacaaattattatatcttggttttatcctattcataaagggctatacatactgaattactgatactgcaaatttccaggctgtaccaggaacagccttttcaatcattagattagtgttacagattggttttcccatgacaattgggttacaaaaaggacaaattcattagagtaaaatttttattactcttttgaagccaatatttctagtgcttaaaaaattattatactgtgtttttatgctagtcataaaggacaaatttattttctactgctagtgcaagttttccaatccttagactagtgctacaaattgggttttctagtgaaaattcggttatttctgaaggatgaatacatctgatgtctgctaaacttgaattttcagagtgttgaaaatgaaatcttgctgtgggaatcgatcacaaaagaagaaaaccctggcgaggtaatataatttaatttatctctagaattacaaaatcttactcgtctacttatatccaaactaatctggctatgtttattttcttaaagaaaccatgttactttctttctccatgtccctatacatactacaatacatactatgtcttcctctaaggaaaatggttcttttgatttgtagggtcacattgatgttcttcagaagtaccctgtgccagaatgtaacatctggttcatgaaattctcatgtgattttcaccacaatcagttggcaataggtaataactaatgttgcactgttctctcaagaatcattttttttgtaaggcttgacgaatcattttgttgttatcgttctaaattattacacaatatacctttttcttggaagacaatgaatatgctagtatttctttagataatggatatgcaatattgattttgatattctttaaaacaaaatgtgaagtgctgaaggataaccatgtgcttattcaaacaggaaaccgtgatggtaaagtctatgtctggaaagtacagaccagccctcctgttctaattgctcggtaatgttaacctcaagaactcaacttattaagtttcatcgtctgcatttaatttggtatataggtgttgcctgttgggtgttaatttctaccaattctcatgtcttctacatgtgtgcttatcatcatcatgatcatctacaggctcaataatccacaagtgaaatcagccataaggcagactgcagtgtcctttgatggaaggtacattactacattcatcctgttcatactataaatttatccctgcttattcattctgatggagctagcctatcatttgcactgtgtttatgcttctgttttattttttatttttgttgtttgttttcttcttggaagattaaaaaaatgttttattgtgtttccattttcttcagcacaatccttgcctgcacagaggatggcaacatatggcgttgggatgaagtggatcacccaaccgccccagtcccaagcaagaaacaaaagtgaagcaaggattatattaattgaaattaataaggctgaattggcgatttgttcttggtatactttgttatactactttgccttagcgttcatcaaaactgccatttgattttccaacattcagaaaactctatagctggatgtaagatttattatcgcaagatattcaggatgttggtcggtgacttggttttatcaataatttgctgggaatatagtacttaatctcataatttgtttctctgtgaaatcgtcgtaaaaaagtgtttatcattttttcaatgttaagcacgggtgatttggtgttggagtcatgcatgattccaccactatgatttaaatcctagtgtccaaaaatatcaaaaaaatcctagtgttcaaaaatatcaaacacatgtgttgtgctatcaataaaaaaaattattagtgagattagggatttgttgttggcttagtctctttgagtcacgggtgtgcatttcccttatggagtaataaaaaaaagaattgtttatcctgcattctcgttaacactctaaagcaccagcaaagcatgcctacattttaattacctgatgccttgtacgttttattggtaattaatttattccaaatgtccaaaataaacgattcatcatcagtccaaatcattttatcgtaattaattataagcttctgaacatgaagccactgcaattaattagatttaagctgacctccggttctgtaaagagtcgtatgaggaagaccaagaccagccatggaaaatgtagacggtgacggcagcgatgggggatgtggttgccgtttggcgccaaaacgatggcgttttcatggccgtcggcttcttcctcgcgccattttcatggtgacttgaaggagacgtattgtttgaacagccaaagcatatatacgtgtgcaaaaaagagagaaaaaaaattatgaaaagcaactagattcacatgatactttgtttctctcttcttttttttttcttttgagggacactggacacatgatgctttattggtaaaagatgatacacaagggaatacactgctgaagcacggcagcgatcacagttcacatgggaactctttgtcttttttcttttttgagatttgactaattttcgtggagtctactactctactccctctgttttcaaatagctatcggcggtatctattgttatttcaaattgtccactaataaactcttaataatagttaggctatggtgaatagaagttttgtggttatgtttagtatacatttcactttgataatatatatcgtttttcttaagaactagtaaatatcttttaagaaaaaagaggtcaaattattaaaaatatagggaatactatgttaaggtttatgcttttcctgatcatctagtttaaaatacaagtcatctataaaaaaaatgtacaagaattaaagaaattgttgaatgactacattacattttttaacgaggaacatcattatcctttttactcaaacttagatccctaaaattacttagactcatttgatacagatacagaggattgaaatcctacataaaacaatcctgttaggtcatttggataaatgattaacctccttaaaatcctttggctcatttaatggtaattttggaggaaaacaaacatgcgatctagcctcatatattatgtttttgtgagacactttttggtactatgtattggttctactatgatgtattgtaccctatttgttttctaaggtcctaatggcctaatataatcgtattatagatatatagaatggttaaatggttattgtctatgtgatatgtaagattgttgcttcgacttgatatccgaataaatatttgtaaccgatagtgtacgtatccattttggtacgtatttgttccatattttttcccgccattatccaagtttgtatccgtattcggcactatccgtgttcgacccgatttcgattataaaatatgggttaggatatgggaagggtgatatccaaccgaacccgacccgttttcaccctaccgcacacgccgctcgcatgagtccagtgcttgcatattgggcctaccttttcaactgggtcaattaatacccaataaatagaagaaataagttcactttacatcccaaatcgaacgcccatctcccaactcacaatactccttcgacagtatagcggccagttttggctaacatggtgagtgagagccatgtgtcaacgtccaactcttttgccacatcacaatcggcgactgcaaggcgggggaggtcgtgccccgctcatcactgcgcgtgcaccgcggacgccagccgcacaggatcttcgcctaaaagtgatcagtgccgtcgccaagagatacaaaccactgcacgcctacatcacacactcgccatgagggacaccaccgcccgcaccttcgatcgatcactcgtggttgcactgttttcgggcgaagatgctcacctgcctcttctgtaacaccccaggtttacttacctagaatgctacacactacggtacagaaaccaccaagtcctaaattcattaagaatttcgacagagtctcacatgtaaattcggacatccacaacaggtaattgaagttaaactaataataatatcattcccacggagcgatccatccttataatccaaactattaactcggtaggtaagtgaatacctggggtgttacatctacgactatgatgtcgtcgacaacaccgatgacctggccacgcacgacatccctagggcgcggacccccttggctcctaaaggcgtagggccggcaattgtcacacctcaatctgataccgccgtacaacggcacctgacaggagcgtgtcgtagggaaaacggcgcgaacagcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggacgaggaaacaccaacagcagcagcagcagcggaaccaacggtctaacacccaacaccacaggcgacggctgggaaccaggacgaaaccctaatcttcacttcactttatcttctcttcagggtggaggaactatatatatatatatatatatatatatatatatatatatatatatatatatatatatatatata

SEQ ID NO: 53752 - DNA, 19185 bp, Oryza sativa
  unsure (1)..(19185): unsure at all n locations
aaatcttttgtttgaaatcattttgaaatcactaagtgatttatttctttttaagtttgggccgaaaagagacttgcgtctcgattcgactttaagagatgtttttcaacagctcatttggtaatgtactgacctcccgggtcagatcattacttctcggctcccagagccattccacttgattaatcggctcccagagcctttttcattttctcggactcccagagtccagctgcccagcagcaaagcaatccgcttccactcgggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcacaaatcaaactccaaccacctcgatcggtaattcagcaagcttctcgttcttgcattaccaggaacctggtttggctccaaccgaccccgccctggcgttcccaactattggcatgcgaggtttccctgaaccgactagttacttagccagggtgtcccattccaccttgtggttgcactttgattatgttcgatgagtttcccacaggaatcggtccttatatgtgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggttatttggtatacgcgctcagagagcacgaataccgaggtaccacaagggtggagagacaaggaatcagggtagtacgacctacggaaattagtgcgactactgggtaggtccgtcggtttggcacgcaaaccgaggccaagcaagttaagtgtgtgattctaataatgcaagttgcaaacaaataataatgacttttcaattataggggcaattgatcaagggtgacttgcgtgctcaggtcttcacaaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttatgtgaatactggaagttgaacggagtcaatcggacgagcggttggggagatatggatttcctaagattatttggattttctgtctaaaggaaaaggatttatcaaatcctttggaaaagaaaaggaaggagggatgtcatttagacttactcgggcggcttaggcgcggcccaaggggtcatgcgcagcgcggtcaggccattggccagcgcgggcgcgggtggtcggcccattaggggcgcgcggcagggggaggccgaccggtggatcgggtgcacctcgcggagtcctgggtggggcccgcttgtcggtgactggggtcactgagggacgggctcacgggaagggcagcgatagggtttggtgggacgtgtttgggcgcgtgcgccggtggagcgaggcgcgatggcccacgtgcacgcgatgggtcatcgtgtctgcgcgcgcacgtagggggaagcgaggctggcggtttgactcggtctagccgagttggcaccggtgtggcgcctacgcagcggccacccgggccggcgagaggagaaagaaagggggcgcgcccgaatggacggcggacggcggccgagttcaccgaagttggcgcgacgattcgagaagggagggagcacaccggaataatgagacggagaaaatagagtgcgccaccggctcggattcacggaagggagaccggcgacgacgaatcgcggcagccctcgccggaggtgagaaaaggggcaaacggtagaggggcgacgaggattcaattcgaggcggtggaagcatctccggggttcaaggagtccgtttccggcgtcggatggggcggaagagcaccaaggagggctggtgacgagcggcggcctccgggagcgggcggcaacggcggtgaggccatgccgggcggcggcgggtctaggggcggcgtctacgcgtgttcgggagtgccaccgagctatcgcgcagactagagggggcgagggagagcgaggaaggggaacgggaggaggcactaccgagctaggcgggcagtgatgggcggtcgacggcgcggggcgagttcttcggccttgggccggggaaggggaagaagaagggtggccggagtcctcttcggctcctcgcgcacacgccggcttcaccagcacgcgcgacggcgaagggaggcgaggtcggcagctgcaaggcggcaacaaaggcgcggcggcggtggaagagagatgccgagagagaatgagatagggaggctcggcctaggctttatagatggaaaagaggcggtttgggagggggaactgacataggcggtcaagggtgcaaggacgacgagctggtgtggtcaaggtggtggcaggcggtgacgccgatggtggtcgggcaaaaggaaaaaggtggagaagaaagggagctctgctccttgctgtttcgggataaaggaaagggagagggagcgaggccgagggctctgtctccctcccttggacgcatgcgcacaggcggggctgggcgacgcgcggtcacgggcggcgtcagggctgacgcggcggcgaccgagcggctcggcgtcagggctgacgcggcggcgaccgagcggctggcctcgagcgagcgcgcgcgcgcgggaacgagcggcacggccgaaaatcgaatggcggcagcgggaaaaatcggcgatggcggcagcgctggcgtgggagagagagagagttacatagagagagagaggaagaagacgagagagcgagagaactgagagagcgagcgacggctctctctcggctcgcatgcgtgcaacgcacgtgcgaggtggggggagaagatgatgggctgggaggggagatgggccgggggaggaaaatcggtccatccaaaaatacagggaggtaaagtagacctttttttaaggagatagatttggagagaatttgaatttgggggaaggaattcaaaataggaatttggttatttttggagtcagggcgaatatttggcaaggattcaaagagagggattgaatttcggaatttgatttggagatttgagtcgaaggaggaattttcgaggtggaggattttgatttcgatgagagggaacaacgggattaaattgagatccttggcacaacttagactctcacacaaagaacgaaaattttcacaattaggattttgccgaattagtttttaacgcctcacgaaaagcggagcgttacagcaatccaccggatttgggtgccagacagcagttgcggcaattcacatgggaacacaaatgctgaagcacggtagcgatcacaattcacccgggaactcttttcttttagagatttgactaactttcatggagtctactactctactccctctattttcaaatagctattgactgtatctagtactatttcaaattgtcaacgaataagtcttaataatagtcaggctataagttttgtgcttatgtttagtataaaattcactttggtaatatggtacttttttttaagaacttgtaactatttttaagaaaaaagaggtcttttttttaaaaaaatatagggaatactatgttaagatttatggtttatctgatcatctggttttaaaaagaaagccatttataaaaactgtacaagaattaaagagattgttaaaatgactttattacattatttaataacggacatcattgtcttttttactcaaacttagaccctaaaattacttagggattcattaaaataaaagaaaaatggagcaaatatagaggattgaaatcctacataaaacaatcatattacttcacctagtcttcgataagtaaaacgtttaaggtcattgggacaaatgaccggtctccttacaatcctttagaacttggaggaaaaaagatctagactcatttttctggtttgaatccgtatgtttttttgttacgtgttgttaaacaatttttgttgtaaattcctatatattcatttcctccagaattcaagaagacatgaaatcatattatcgaatcctacgttgcaaaggagacatatatttaggaagggaggcaatctaaattgttttagatttgtgcacaagaacaaaagagattgttaaatgactttattaccctcttttaaaactactaatgtatggtttgattagaagctgagacggttggttttcttcccaacctcactccaaaaagtccaaatacacattcccacgctcaaccttaacccccgcctccgctcgccgcggcgcgccatggcgccgacgccgccgtctcgcccgcgcctccctctccgcccactcctcctctccctccctctcctctcgctcctcctcctcctcctcatccaccgtccccaccccttcccgncgnctccccttctcgccaccgccaccggcacgcggngcgacgacaagccggcgccgcggngagcggcgtcgtctttggcgcccaaggcgacgacgacgacgacgctggcgcacgtggtgttcggcatcgcctcctcccgccgaacgctgccgttccgcctcccgctggtccgcctctggctccgcccgcccgcgcgcgcgttcctcttcctcgacggcccggcgccggccgccgccgccgcgtccgagccattgccgcccaacctccgcttctgcgtctcctccaccgacgcctcccgcttccgtacacgcacccgcgcgggctcccctccgccgtccgcgtcgcgcgcatcgccaaggagctcctgcagctcgacgaccaccaccacgcgacgccgcccccgccgcggtggctcgtgctcgccgacgacgacaccgcgttcgtcctcccgaacctcctgcacacgctctccaggtacgactggcgcgagccgtggtacctcggcgcgcgctccgagtccgcggcgcagaacgcctggcacggcttcgccatggcctacggcggcggcggcatcgccgtgagctggccgctcgccgcgcgcctcgcccgcgtcctcgactcctgcctcctcaggtacccgcatctctacggcagcgacgccaggatccacgcctgcctcgccgagctcggcgtcgagctcacccacgagccaggattccaccaggtaacctttgcttcttattgtttacattttctcatcaacatgctactgccctaatggaatgttaggttagattgctgattgctcattaattcaattgtgttgatagatagaatgatagatagatagatactggtggattgataaagaatgaactttttaaaatcaaaatttggtactcttgacacctgactggtgagtagagcaggaattgtctcaggatatatctgaccatatttgataattgtattttgtgccgcgtaaccaccatcacgggcggtttgtataacaatgattgtattactgtaataattaaatcattatgtagtacaaccatgttgttcctcacaaaaaaaaaattgttgtaatctattcagccttgcttagtcacaccgtagttcagaggcatagctagtctttgatattaagttatcagttatggaagagaatcgttgggtgaaattttggattgtatcaggtcaaaagaaaaaaaaatagtattgagcttgcaaaatcattgcctagtatgaagggattatgttgttaatggtagaaaatcttaagctgtcagcactctaaactttttttttttttgcttccactataaatttttagtgtacattgttgtctgcaattctgcatacatttgtgccgtacattagacttttcaagaaaaagcttatcctttagaatgctctcaaggaatgcagaaccacaccacaccaatcctgtagaatgttgctaagttgtgtacacatggaaccatactgattacagaacataagcgatgggtactggctaacaactacaactacgaattgcggaaccaatacgaaatctttgctactgcccactggatttagtgatccatgcttgtgcatcgactgattttgatgtgagggcacttgaaagtgggtgctttggtccgcatgccacacatccctttcagattatcttaagcttcgccatcactatctaaatgctgtcaaaatgggcatcttccaagataatgatgttgtcaactagaactgttggctgttgctgaaataagtagtgcagtggggtcgctgtctgacagttaaataagccaacagaaaatatttccttttgctccacctatgtgtttcacttactgatgtgtatgacttccactatataaactgcaggtattgctttcttcctcattttcagccactgaaaactatgagatgtcttcttcttgacgactctttagacgcgaaacattcccatggctttacttaatattatgcaacaaaaaaaatcttgattcttaacttgtgtgttgtgttgcatttgttatatccagatcgaccttcatggggacatatctggactcctaagagcgcatccgcttactcctttagtttcactgcaccaccttgatcatgtatatcctctttacccgggtatggaccgtgcaacagcggtgaagcatttcttcagagctgccaatgctgatccagcaaggatccttcagcagacagtgtgctatgaccattcgaaagcaattacagtgtcaatagcttgggggtattcagttcaggtgtacaaaggcaatgtgctgcttcctgacctccttgctgtgcagaaaacgtttgtgccgtggaaaaggggtcgcaatgctactgatgtttttatgtttgataccaagcattacccgagggatgagtgcaaaagagctgctcttttcttcctcaaaagtatttcttcaggtgaaggcaagatcaaaagcgattacactaggcagctgcctagaaaatgctcacctaacttgattccattgaggaatcttcaccaaataaaagtggcatctgagccattacatctggttcctgggaaggtatggctatgatgggtgcctcatcaattgtgacacaaatttcagtgctcgaattaagattttgtgattgttcttttactgttgtgtgtttttaggctttaagacggcattgctgtgatgttgtgtcttcctcatctgaaaccaacatggatgttaacatcaggaaatgcaaagaagacgaactgattgcgatgcattcttagtcacatcttcaatcgaactggatgcaatgctcttcctctgtagtaagttcctcctcacatccctttgtattttcacagaattttcctggacacacgcctcaatgttttatcacatgaaacatgcgtttccattttattttgggtcccaccaggtctgacataacttttctcgtagcaatttataattttcgtatgatctttgcagtaattccattgtactagcttcctagtacagaaagtgacaagacaagttaagcagactagcattgtaatagattctccatgaagtctcacattctgccgtttactttggtcaactggaatctcctttacaaaggagtggaggcaccataatctgtttgtgctatacaatgacctttttagcttgaagaaaaatgcatagtggacttgagtgcggccctccttttggtgatcaagacgacttctggtgacagtagtactactgaaactagaacagcatggatacatagatagatacttcctccgtttcacaatgtaagtcattctagcatttcccagatttatattgatgctaatgaatctagacatatatatttatctagattcattagcatcaatatgaatgtggaaaatgctaaaatgacttatattatgaaacggaggaaagtagtgagatgttgaacaacacacttccttattattattttttaactttacctagcaaatgctcatatttatatatgatattttaccttaagcactttttgttgtgaacttttgagtgtacattgggactgtctgtacttctcaatatttcatacagcagaagaaataatttcaggtcctgcttagaattacattcaactcctgttctgttgaactgcttctgatatgcatggtttttgggcctccatcttggcccatccgtatgtatggcccggttttttgactttggatgtggcaggatttcggcctatccaaaaaagggacgtttgttgaattgggcctcttctaaaaaaagtgtcaatgtaatcttatgctggctaaacttggctggttcttggtctatgttgggcccttttggctgtgtttcttttgaatattttttagattctattcatcgtttgccgcgcgcctgccttctaaactgttaaatgtgtgtttttaaaaaaaatatagaaaaatttctttagaaaatatattaatctactggggcaattgaaatctagattatttgtaagatttttagctaatatttaattaatcatgcgctgatgcatcgctcttatttatgtggcggtacggtggttcacattaccataccaactgtagtcttcacacatataagacccttaggttcaacatactcggcctgctccaaataagagtcatatatttataataatggtaatccaaacgaactcagccttaggttcacgttaccataagccccaagtatggtaatgtgaacggtcaatcaacttgctccaattaagatagtcatctttgtagtattcatacatataagacttaaataaaaagataaactaaatggttgatcggaacctgagtagtaatttcaatactccctccattttaaaatataaatatttttaaaatagtgccaagtcaaatatttttaactttgactattaatagaaaaaataaaaagatcaatcatgtaaaattaatgttgctagatttatcattaaacaaactatcataatatgtaactcttttaaagtaacaatatcttgaaaactgtgtcgaagtctaaaatgcttatgttttgggtcggtataattacaatataagtatactttaatcagtaataatatctaaaaggttctaaactagtaataaaattgttgtatagctactttcttcgatatttgtcatgtaaacagtgatgattatgtcgtgttatccagcagacaagatacttttcatatagctaggcaagtaggcatgaacacttgcgctagtaggcgatgcagagtggctaactttgtccttccaattgacaaatgcagcggcatgtggcccatcaaatttggtactagtactaatctctgagtacctaacgcaaacttttgctgtgcgaccagttgaacccccctaatggtctgttcatcattggtgactaatgtgtctccattcaactattcatggcaatgtctccaacatttatatatcggcagttgagctctcttttcccatcaagtacatgtacgtacatgccgccatgtattttggaataatggataaaatttaatggagcctaaggttaactacactcacaatcaatgtttatctcagtctataacatgttttaaatttgtgtctcgaatataatagtacagtttagtcctccccatatgatatgtgtgtttgcagatttttttttcccaatttgcttagtaccattaaaaaattacggagttaaaaaatacggttgtatgtaccattgatacgtacgtaggtctaggttccacatgtcattcttgatggtattttataacttatatatatctttctgatggtattttccaaattctctctcttttttttttgccagaacggtaaagtgacgctggccaagatatattaagatgtgtttgtgagttttctgaaatcaagatctcctcatctaccaaccatatactgtgccgggaccaacatatagtacaagctagagattattattgagtccttatcggttcatcagagtgtgctcatccgagtgtgcttttcagatcatagatagcctttggtgacaaacagttttagctaatattccttccgttatacgatatcatgttttgggtttgtcgattgtcaaatttatttaagttttgctatgtttatagataacgtagtaacatctaacttcaaattactttcattaataaagccactgtttgtatataattttatagcatatatccattttgtgtttgaaatattactatgttttttaatataaattaattagttaaacttgaagaagtttagtttagaacaaacctaacacgtgatatgaaacggtggaagtataccctgtacttgtaactctatcgtgaagaataatacatgtcgcaactataaatatatatcttccgaagcagtaaaacttgtactcctaaaagtgctctcaatctaaggctatccataatgtaatggaaaagtaggaaataataggcattaagacatccttactactgcattgtgaaagtggtaaatagctagtgccaagtcataggcttattattaggatataagcaatttaagttgagtctcaccttgtttattttattgtggcaattctcatgttagacataggttgaactttttttttaaaagatgggcccaccttattttccactctacacatgcatatggattgaaatcctctaacgtaactttcctctgacgtggtgactaacatatggggtccgagagtgatgaagtgaatagtaacgtcacgatgaatggtaacatcaaaggatttgcttctcatgggcacatcgtggtctttccaacctgctaacgccacttgacacggttcaccttactgcctagttggatcgtaaacattgaggatgcccgaaaggggtgagataaagcagtaaaacgacaaagatattttcatcaaaattaattaaaaccagcagatacttgtgcagatctgaacacggcgatctctttctgactcttcatccttgggacaggaacaagcagctaattaagctagcgtcgtactccacagtagtggtagttaacagccggtctgaacacataggcaagaattcaacgacccggcccagcaatagcagcttattgatgcaccgaattaagcaacaattatatatatctggatccaacaataattcatccgatcaactaattactaatattgcgggccatccgatcctgaccgttgaatcgggcgatccgatggtcaggattcagtccagggtgatgatgatgatgatgatcctgatcctgatcttcctcctcgatcgacatcttcccgacattgtcaacatctctttcgatcggtcgatctgtagctgctcctgctgttacgcttgctagctactccctccgtttctaaacgtttgacaccgttgatttttttaagtacatgtttaaccgttcgtcttatttaaaaaaattatgaaatatataaaactatatgtataaatgaaagtatatttaacaatgaatcaaatgataggaaaagaattaataattatttaattttttgaataagacgaatggtcaaacatgttttaaaagttaatggtgttaaatatttagaaacggatagagtatatatcatcaacccccagtaccattaatggaggaccactagctagctgggtcttacattgcatgcagcagcagcttgctaggccattcgatcgatcgatcgatcatatatatatatggatgagctacctacactgatatgatccaccacaattaatgtgctcgagacgacgcagcaacaaccgccgcgccattgatgactaattgagatcgatcgatagatagtataagagatcgaccacgagctctcgatcagcctagctatagctatagatagatatacaatctctctctctctctctctctctctctctctctctctgattgttctcttctgcttgcctcttccatggagtgggctcgaggtccagccatggcggcagcggcagcggcagcggtggtgatggtcgccgccgttctggccggccaggcgatggccgccggcgcgacgacgtacacggtgggcgcgccggatgggctgtgggacatggagaccgactacaaagagtgggtcgctcgccggacattccaccccggcgacaagctcagtcagtaatccaaatccaaatcgagttttagttatctctgttttcttgggttttcttttgtactttttaaccatttgaatttttaatttcaaaaataaaccattctaaatctatttccagaatctgaacatttttggcacaccaaacccaccagacttgacaaaataacgtcaacacgccagccgtagccggcgtcatagtttagttttgtactatcataccaaccatatcgatcggagtgggcaaataatagcactgccacgctagttagacctgcgtcggtgttgtcttggtaaaagcttcaaatcttaattacatataagttttggaagagtttaattattttttaaattgaagattaaaaatgttctaaaaattaaaacaaattcttgcgatgagcttaatcctgttcttgatttggatcaatgcaagtgcagcgttcacgtactcgcgtgagctgcacgacgtggtggaggtgacgaaggcggggtacgacgcctgctccaacgccaacaacatctccgccttccgctccggcaacgacctcgtcgccctcaccgccgtcggcacccgctacttcctctgcggcctcaccggccactgcggcagcggcatgaagatccgcatcgacgtcgtcgccgccgcctcctccggccccgcagccgccgccgcgccgctgccgtcgacgtcgtccgtgaccgccgccgtcgccggaagccgcctagtcctcgtgctcttgtatgctcttctgccattgtggtagcattaattaattagtctcttgtgtgtatatttttgtaattgtaagtttaagtacacgtatatgctttgatttagttaatattttgtacttctggttttaatttgtggttattgatcggattttagatatgcatgcatgccttaatttggtttcatttgactgaggtttgtgttacgacttgcatggagagagaaatgattgttctcttctacaaagctaggatttttttttcaaggatttttatgaagttcaattgttcaaggattttttttgaagttcgactggtcaattttttcaaggatttttatgaagttcagaattgctctcaaactaaccataacgtattacaatatgcaagatgcatgaagctcattcatatatggtctatttgatgacgttctaattaacgtacctttctggtttttaatacatgatgttattcacttttaaacatatgttcaactatttgtcttactaaaaatttacaaacaacactacactggccaaggtcacctgtgacgggcccaaaccctcatctttgacggcttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttgaggtctccgtagttagaagctgtcacaggtgatctacctgtgacggccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcagatttgctagccatgccctctgaaaaatagaaacatcacagatatattccagtcacagatccatcacagatacatcaccccccaatataacatcacagatccccaacaacacatatatgcagttcaaatgccacaattttgcacagcaaattcacaccccttgaaagccacaatttcggtcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaagcgcacaattcgcctctgatagcgggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcattcttgccctccttgtgcctaccacccttttccacatatgggccccaagccatatttaaggccttggtgatttcactgaaatcataatctttggacttattggagttaaggtaggtaacccgactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatgtacgtattagaactaatttaattaggagatatagtccagtcatatcacaagtatagaaggtatgcacttacaaggagtagcatttaagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgccgaaagtcatgatttcatcatttgggggcacgggcagcagatagcctgaccaggtgtcctttactgtatcgatggacaccttggcatacctagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtacatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgaggaccttgttaaccctttcttccacccttgcattcatgctagcttctagttcttgaatgacctcaaccttaagttcggccttcaaacgagcgtccctctcttccttggagactttccgtttcctgtattgggatctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagtaaccaagcccaactagaaaagaagatagtcatttatacgaacttgtactttatacgaacggaaattagttaggttaagtagtgaactcaccagttcctgatagacgacggcatcacttttgttctcaaatgtgacagagccgttcgggttgaccttaccccttgcccgcgcccaggtgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtaggcgatgtgcctcgcttgattccctaaactcttgggtggtcttgagagagcagaattcctcccaaaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctatcccgcagcagttagaccatcttccaatgacagtcctgggcgccgtgggcctaccactagcgtcaacctctcttataacttgcactgtggtcggccatatattttgtgaccgcggatttctactagacctacttgcacttgtcccgcccgacatcgacgtatgttgttcatgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcataacatcaaaagagcaagtgcagaaaatctgttcttatgcataaaaaaaagaacaagtgtagaggtatataaccactgaatcaatcatgcaaatttaaaaaacagcagcagcaagggtacagaatttgcatgattgacataaaacagcagcaggaggagtatatatgccacaggggtatcaacagcatgggtatataaatgaacaagtgtaggggcaaaaaaatgaacaagtgtagataatatgttcttattgagcaattcatcactggccatttaataaggaacacattgggcagcagcagcaagggtatataaatcatcaaagaatgacagaaaacaagtgtatatagtctcctcttatcaatccagaaaattcgatggcctcttcggtggtgtaactctcgatgatactcccctcggggtgtgaacggttccgtacataacccttaaggatccccaggtacctttcgcaaggatacatctgcgtcatgaatgctggaccacaacactttgtttgcctcacaaggtgcaccggaagatgttccattatgtcaaagaaagttggaggaaagtacatctcaagatgacatagggttctcacaagttctgcctgtagtttatctagtccctcgggatcaatgatcttctggccgattgcatggaagaaggaacacaaccgctggatcgggtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccagaatattgacttctttttccacatgctcctctcttttgtcttttgtttttccacatgctcctctgtttttt

SEQ ID NO: 53753 - DNA, 797 bp, Oryza sativa
tttgcttcttgtttcctccatacactccgaacacgcccatttccctttcacagtttggccataaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcgggccttgaatgagcatggcaagcataatgtactttcttttgaaacacaaccagggaggaaggttatagttaacaagcagaactggccatgtactgtgacgactgctcaaatcaccgaaaggattaatgccgtccgtacacattgcgaaacgcatgtttcttgggtcatttgagaattcctggtaaatcctatcgattgtccttcactgcactgaatctgctgggtgcctcagcatagtatcgactttccgttcttcggcatgccagcgcacaagcttagcttgttccttgttcgcaaacattctcttcatgcactccgcaattgggagataccacaacacctttgctgggcctcccctctttgacttacttccttcaccttcactctttgctcgtttgtatcttgatcccccacagatagggcagacatccaagtcagcgtattccttgtaatacaaaatgcagtcgtttggacatgcatgaattcttctgacctccaggcccaacggacataatacttgcttcgcttcatatgtcgtctgaggtaaattgttcccctttggca

SEQ ID NO: 53754 - DNA, 943 bp, Oryza sativa
tccgtggccgcggccgccgcgtccgccctcgcgctcctcctcctcctcctgtcccgctcgccggtagcacgaggagccgcgtccacgtcatcacctaccgctcccccgccgcctctgcggccgcggccgcgctcccgtggatcgactgggcgcgcacggcgtcgatgaaggcggccccgggctgttgtccttcgcctccgatccgggcagcgtgggtcggtcgctggcgctgctcgtggagttcgctcatggtcggcggcggcgaggcccggcatggtcgggtgaggcaaggtgggaagtcacgcgggcggcgggtgaggctcatggtcggcggcggcggcgaggcccggcatggtcgggtgaggcgaggtgggaagtcacattgtcggcggcggcgaggcctggcatggtcgggtgaggcgaggtgggaagtcacgcgggcggcaggtgaggcgggcggcgtggctggcgtgcgttctttttttcgttctttttggcgtgcagtttcttttttcggagcaagacgcggtgttaatccggtgctaattgtaaccgcaggattaatccggcgctaattgcaatcatggtgttaattacactaaacaactcgtgctttttatattagtctagattagagtccaagtccgattcaattagtgttaactaatcgggtgagttaattgttagtaatagtttggtttaatcctgggccgtccgatccatttgtgtgtggatcagatctggacgcgtggtggtgatgtgatgcaattttccgcgtggggtcccttggttccttcgtaatcaagctagccatgggcccacgtgccagtcagagagtggcttgcgcactgtcgatgtgctgggcccaccagttttctttgatgggcctagatgtaattgggccttggtggatagagaggaggaggagagagaaggagaggga

SEQ ID NO: 53755 - DNA, 8962 bp, Oryza sativa
  unsure (1)..(8962): unsure at all n locations
cgcttatcttctctgcttgccacctgctcgatgaaatgcctgagtgcctgctggttcttggggtctgacgctttagggcttggactgtaatttttggtgtgaccagccttagcatttttgtgtgattgcaaccacggtcagggtgcctggttctttgaaaattcttctacttacagaatcatatcttctatagtgagattgttcatgtagtgtggtagagtactttagttgcattgtgctgttttttagccctctcgagataattttgaatggatctgcaaaataggagcttcactcatattattcctcgcaaagaagggttgacgatgatgtggatcacaccaatctttgtactgttcctcgcaaaatgtaggtgggatgatggtatgcagcacaccaacctctgtctccagagggcaaactttgcatctgagagtacacttgaaatgtgctactagctactgtttccaataccgttctcttttttttttggtttttttatgcagtttgatgctcttgtttctgcgttgccactatcatctgaagaggatcagctgaaaagaattaaagagctacaggtatgtctcagttttgccctctgagcagtacattgtgaaagggtgacattaagctagtgtcttgtgaagatggtatctttgtgcatgtttccttctgttttttttttcctacgccttgtggatggagtttcatactaaggttgtcctccttagtcgcttgctttcttctgaatgaaggtttagcagacgctcggcagcatgtcctgccatagtatcagtattcatgatacttgtgtcctgcagctaaaatgcttatgaatttgaaatgcgcaggcagagaatgaagttgtaggcacagagcttcagaaacaactggaagctgctggtatgctttgctattacattcttggaatattttgccttcattatataattcctcaccatgttacaactgattatttacaagtccagtgttttacatgtcttgttgcttttgtagagctggagctgaagcaagttgaggctctttttaatgaagctacagatcattgtataaacttgaagaagccagagtaatagttatcaatgtaagtttggatttctcccttcactatctcaataaatctttagctttttttgtgcttgcaaaaaattatgcttgcgcttatgatatgggattattttgtgaccagctgtataatccgcttgacttcccaaacttggtacactgtattatcaggaagtcaggatactgataacaattttgttcttatggtgctttttgcagtacaatattctacatgcaccatttactagatggctgttggcatcatgtccatgatcaattattggtttatgtagtttatgtacgatgatggcctgaacaaaacataattatggtggatgttgacctgttatattaatccctcgcaagatgctttcataaaaccctctgggggcttgtctttctgttgatcagaaaattccaacacagtgttgttacgtatgatcgtagtatcactaaaatgacttatgtttgctttcctgtcatatcaggtaacggaacccattttggagtcatgaacagatgaaggtggagatgtgaatgccagctgccgatgctacatgtagactcagttttagtatcaagttagctgatgctcaacaatattccagtagtacttgttggattaggaattaaacctagcactgtaatttacagtaacttgaatagtttcaagctggttcgtttaatctgaaataatttgagcataacttcatgtttatttattatagttgggccactgttcgttcacagcagcacaggaccatatagtgctatgcaaatacaattaagacatgcctaggattcatactctttgaactttgaagaactgcactgaagatatggaacaatattatctcggtataaagcattcctctctaaagattacccaaacattgaggctaaacatgacttgaattctagcaactctgacactgaaatatagaacaccatattttctaggggcacttggacaaacaaaacatcccttgaaaactttatttgtcaagctccagagattggctggctaacttggagcaaactctcaactcaggcatacttgcaattgccagaacctgcaaaggttggcaagaaagccatgtaaatttgcaggattcaggtgaaagaaacagcaagtgaagcaagctttgaagaggctaatacttactgggatcagtgatggtgatgaggccagtgccgttgaagaagcaattccatgagttcctccccctggcctggtagtaagcgttcatggtgaccgacgcccgcgtcggcaggctgccatcgtcgtcggggaaggagcatccgccggtgccctggatggcggcgcagtcgctctccgagcaggcgaactccaggttagccctcaaagcatcctcgctggctgctggatttggacacaccatgtcttggatgactgcaggttttgctcagtttcaggcaagaacagttgatgagcatggcaagatcatatgatgctgccattctgggtttgtttgcattgctgcagaattaaggagaactgaaatttcttgatgagaactgagaattgtttgtttgtttgtttgtttacctggctatggtataggctgggtgctgctgctgctgctgctgctgctgcatggaatacagattgtggagcattttgttgagagaatgaggattggaaaacatggagctgattattttgagcagacaaaatctcatctgatttcaaaaacaatagaaaaaatgtttgatgaagaaaagtaggctgtaagtgagagatgtgtaccgttgctgtgcagcatgaagagtgcgagagcaaagaagcatgtgagcaatgaggcagtagctgaagccatctcttttccttctttctgaacctgagaatgcaatgagcttctttctctgtattatgatgcgtcagaagaagcagcagcagcgtaatgatttgggctctttgtttggaattctttgcacgaggaaacgctgaaggtaatatataagggaggaggaagaagcaacagaaagggcgtgctgcagaaacggttggtcttcaaatcaatccaatttatgtcccatttatttgcgagaataatggctcagtgcattgcagcattgctactatttatcatcaggacggttacaagaaatcccagtagataactagcagaatataattggtcaaactccagacaatactcagtagtagtacataactcaaaattcacaatttgatataaacaaatatacacaaaaagaaatctattgttttcatcacagaggcaaatctccccaagcaacataagaaaaaaaaattacggttttcctctcctcaagttatttatttatttatttccccgttgtatcattgtatgtcattcgttctatttcgcagtaactatacaaggagctaagacagaagaaaacttatgcacatggagctagctttaccccacaccacattcttgattcttttgttacaaatcaacatgaacaaaaccaaaaacaaatctaatcattcgtttggtcccctatctcgcagcacaaatccaatgcatgcatttgatttgagtatttctcacaaacgatatgttcatgcattctgtacattaagaacagatttaagctccattccatcagtccataagcatttgatcatcctgagtacagcctcagcttggaccgaatcgtctgtcgacaaattgggcatttggtcaggctctccccacattccctgcagcactgttgttttcacaaagaaagagaatccaatcaaacaaatgttttttctctacaattttgcatgtcagaaacaatccgatcaaacaaatgtttctacatatttgaatagatttcatcatctgttaagaggttaaaaaagaaaactctgaattagtctgaattttcagtttaccatgtggccacacccaaatgccaagtccttggcattggtcaggcagattgggcacacctgcaagaacaagcagcaggtgatgtgtgagtcaaatcttggtcaaacctaaattacaaggaaaaaaagaactcttgatgaaactatggcaatttgctctacttgatcctctcttggtgacggtggggcggcggcagcggtggcggcggcgctgtcttccctcctcagcgatggctgcctccccgccgccgacggcagcggcggcggagcaggcatgatcctcttagccttccccgtcgaccggcttcggagcagcatcacaaaataaatcatcaggtgaagaagagtagaaacagcaatgttgaccagctattggatgtacttcctccatttcataatataagttattctaaaatttcccacatttatattgatgttacatcaatatgaatgtgaaaatactataatgacttacattgtgaaacggaggggtatgaattaagtggtgtttaaaactgatgaagattaagttagcgcgtaaaacgggaaagtcattagcatatgatgaattaagttttaattattacaaatttgacaaatggatatatttgatattttaaagtaacttttatgtataaattttttggacgaaccaacccatttagttgtttgaaaggtgtgctaactgaacccgagataaaaaatgtgaatttgaatattattcgtgccatgcttctaaaagtacgatttctccaaaagccttatgcgtaagtgcttcttagataatttcttatgaactactccctccatccaaaaaaaatctcaatcctgaatttgaatctggacacaacccaatcctaggtttttttttttttgatggagggagtatttgttagctttgtactaacagttaatctatccccagcaccagatgagcaattttcttaagtccataatctatctaatcatccggttagaacacgctctactgatagatatgatccattatattagaaaaaaaaatgaacggtccagattaattctactactagcagagaccattgtaaaacgtctcggcacaaacgttaagacttaccctaggatgccgagctccatggtggccttgtattggatgggcacctccatgagagccgccaaggcgaacgccgactctttctgctgctgcgtcgtgctcctcgacatgatcgacgtgaagttcacaaactgcacaaaacaattaagtaaccattgcattattgcatgtttaatctgcattgcattgtgatcaattcatctccaagattcagtttatggtgatgagattcagaggttaacctgaaagttgtcgaactggcgagccgggatcttgtcgtcgaacttctgcatgtcttcccatgggccatctccaactccaacaagaacaatggatagagggtaggagctgagtagatcaatcaacaattgaaaaagaaaaatatttttttcttaagtaaatttaaccaatgtctttttgcaagtctgaaattaatctgaaactttgcagtttgtgtataccttgccatgacaacggagtccactgtcctcctctcctgggggctcagatcattatcgcttgtatcaacactcctagtcacctgaattttgccacaaatttttttattaccagactgagtgaattctactagagagtgagtcagtgtgactttgcagaagtgttcttcatttcaaggagagaacctgtccatcagcaacgatgacaagaacatgatactgtcctccactcctgtcaacaatgtcgacggccgcctcgacgatcggcgcgaaagaggtaggccctgcaaattgcacacaatttcaccagttgaattgtcagtgacagttcagttttctgcaggtcaatgcacaatgcagaaggtttttcagagatgtgaatagattggatcatcaccagatagcctgaggtgtggcacaatcttcttgtagcatgataggacctcctcgaatccatggcagggtgagttgtcaggatggaagctgaacacattgtagtcatgtgtggttgctgcaatgggaaaaaagaacagcacaattcttcagacaacaaagaagacaatgaacatctatcatatgatcatatgtttttttcctcaaatgtctaagttctgcacaaattttgtttacaattcttgaacatctagcacaaatttgagcctcttaccgtcgccgaagccaaagcatgggatgagattatcatcgtcgaaaggtgccaatgtcttgccgatgatgctgatggcttgctcatatggatttggtgtgctgcctatcttgtgcaggctctgcccactgaacgaacgcttccctgaatacacacagataattcagaactttcagagcaatgcaggcaagaacatgagcagttgaaataatcagatcagatcgagcaaggaccaaggagttcttggtgaagatacagttaggacattattatcgaaaaaatatatttatttctcctaaaaaaaatctacctgtccattcgttgctcttggtgaagtctatgccaagtatcaggttcgacgactcgagcccttgatctcgcagagccgctgtcacctgaagaaaaaaaaatcaatttgttgttcaggcattgattcgatcagcaattcagaagcagaaacatgcaaaaaaaaagaagcttaatcaatcacaatatttggtctatttatcagtgatctcgtcgtgttcatccacctgatcgagagactggtagttgtcaggtatgtacgagtacttcttggtcagcatcgccctccggtggttctcgccgccgccgccgtatcccggctggttcatcggcgctctgtgcatctcacgacggtgaccaccaccgcggaataacgctccgatcacgccgcccatgtgatgcagcagcgatgacgacggtggctaagaacctcagcttcttcttcttgtacatgcgagaagcagctgctgtcaagctacctcctctctgcttctcagaaagttcagagatcaatcgattgatggatgaattaaagccgcaagcaacgaacaagatcgcatagaaggcaagcaatcgatcaacgaggatttattcctctgaaatgagaggagagtttttttgcagcgaagcttcttgagtctttcgctgagctgagcctttattccatcgaccatcgtgtcctactgctttaggtcggcagaaacgctatagctgtttctgtacttgttgagtaatcacatcggtaataacagtttgtggattggattttttcagggtgtaatctctgaaacctctcgttaatcatcagccaaagctgctaaatctgaaaccaggagctgggcattctgaaactttatggttgtttttgctgcaagtgttaaagttgcagattcttgtggctttctctggagcctcatgagaaagcggctcagggattcttgaaaaaaaaatgcagacagatgcatcgtgacagtgaagatatgtttggatcattgcttgtttttggattgctgagtcaatctgatgtgttctcttgatcttttggccttgcaactacagggaaattaaatggatgtaaagccctaaagcatgtgagctgtagtcttgatttagaacatggaacttttccctttcgaaatgaacgtatcaaggccgcctttggaatggaggaattttgcgggaatttcgtgggaattggactgatttctgtggaatttctgcgtttcgaaggagctcgaaattctataactaacgtggagcttacgatgtatgtttgtgataagttccatacgactttctaatgggacaataaaagtagtactgcgctataattttggttcaatatgtgatattaattgatacccttgaaatcgaaattttatggtattgtttgaaatcgacaaaaaattatatactatggttggagtttcctcaaactctatgtgttctaaagttgttatggattatggctgaaactgccgcttaaaacgaataacaacatattattataaattaaagttaaagttttgattttaaaaaataattctaagaaatactaggaaaaatcgtactgtttgcccgtgataatgaatactccctccgtcttaaaagacgtttttgaccgttttaaaagacgttttgactntggtcnaagtcnaactgttttaagcttgactaagtttatagacaaatattgtaatatttataatactaaattagtttcatcaaatcaataattaatatattttcataatcaatttgtcttgggttgcaaattttattatttttttctacaaagtttgttaaacttaaaagcagtttgactttgaccaaagtcaaaacgtcttataacttgaaacgaaaggagtagtccgtaagggtaggggaactaaactttgataccgtattttattccctttgcgaaaacttttcaggtatattttttccgaagtgaatacctgaaaacttttcagttcgatattaatcatggattttataactgagtcaattttgcaagacaattttcttatacccttcaaaagacaagataataacctttcaggtcagctaagaatattggtaaagcaggcaaggagatgatcatgttgtgggcggttttttttaagactatgggcagttgattctcactgggaatattgaaacttacatgtggcgcgcatatgtgcgccaaattgtgtttggaaaatgttctaccttttccagctacaatactagacattctttgcaataataatcccttttcaagattcgtgaatgaataaagtgtactccctctattccgaaaaaacgaatctagtacaggatgtgacatattctaatacaatgaatctaaacaaaagtatatccagattaatagtattagaatgtgatgaggatgtgtcacatccagtactagttttttataggacggagggagtatgtaatatatggtatgggccata

SEQ ID NO: 53756 - DNA, 7588 bp, Oryza sativa
  unsure (1)..(7588): unsure at all n locations
gtgctctgatggggcaggctttgggcggggcgctgcgccgcctcgggcgccgccggggcggcgatcccgccgccgcgctgctccgttgcggggtcgtcccctcgtcgtcatcatattctgctccggggacgctgctcccgctgaaacaaccggtgggggattgcgggggctgccgccggagcttcagctcgtccgcttgggtgggttcccgcctgtggcgcagtctgcatcggcgtcagagcgcgggggccgcggccacggccacggcttgggaggcgcaccactcgacgaggtgaggtagagtagctagctagtggctgcttggcgaagggctgcgcattttaattcctcatttcatttctacatttcgttttctggtgctgatgtatttcatatcttgttggtttgcctctgtccaggaagagctccatggcaacagtatcaagtgagcctgacacatctgcttcacagtctgaaatcctacatttcatcaaatccacctttgggacacttgaaggtataccatgcaattgtttagtggagaataaaccaaaaaaaaaaaaaacaaaccaaaatcgttatagaggatgttgcattgttgcaaatggctagcttgtttctgttaagatttgcaatgttgttaatattcatgtgccaaaaaaaatcataaatttccttctagttaccatgttttcccacctgaaccgtttgcattgtttgtgaagaggctgttctgttctaacgtacaagagtgtaatgattttcatcgttatttattatgtttcgtccaagttcttccaaagctgaaatgaacttgcgtctggtacaggaatagtgctagcctttgcttgtagatgcgagtaaatgtgctgctccttattcctgaggattaattccttggtataacctacaatttattgatgcagggcaaaaccattgttggttgaactgcatgaatgacacctggaagaccctcaatcaaggagtataccttatccttttatatgaatcttgtggaacatcagacagccatggaaaactttcatctgcttttcaaagattgaagtatcttcaacagaggtatttatgtaaggcatgctggttttctagcctgacaaaatctggaacttgttttaactcctccccttcttaggtatccacgtctgactgttttcgctatggagtatgggagtgatattagttccctacaaagccaaacagttcatacagtaatgaaggagtactttacttttcctatcttgatgtcagataaagactttacacatgtaaggcacataacctcgaaatcttagtagtactatagaagtttgaaaatgttttcatgatcaataagcgttcgtgaatggtgaatttgtgatgcataaataactgtattccacttttcgttgatgcctttggtgtatttttattgcattttaacctggagatttcacctatatatattctacaaatatgttatgcacatttggtatattcaattttggcagtgttagactcagtttcaagagctctctaatcatgtctctgttaaaattgaagaccttgtgttgcattttcttgtattaaatactttgttgaaacaagaatgtcctttcatgagtgttcagattacaaatggtgcttgctgcttgctatttgaaggttctaaggatcatgccctcttctcaaatttggatgaagagcttgaggttttgatcaagggtaaaaacaaaacatagctggctatatttataatgttataaattatgtcttgtctaaattttctgttctcttgaacttttctgctgtgtttttgtgcttagtttgatgctcatcatttgttaagcctgcaaatctttattgaaagcaggcatggacaatgctgtcttgaaagctgaaccttctgacactgctttagaatcaagagtttcttggcaaaaagaagaggttcctaaagaaccgtatgttggttctgtaagaaatttgttactataccatcctggtacttacttgtcacctttttctggcatataattttctacttaaacatcaatattgcagcctaattctatgaaattgatgacatgttttttcccatttaatccagaagttgtaaatactcaaatagtcaacttaatgtgctgtagcttgcatatcggttgatgaagatggagatcgcattttcatctcagacagtaaccaccatagggtcatcattagcaacagcaatgggactattttagattatgtatgtatgactttctgtttcagttgggtttaaatcttatctgcacagagtgtaggactgcagccatgcaggatgataattgtatttgcccttttcagattggatgctcccctggctttgaggatggtgaatttgaatctgccaagttcttgcgccctgctgcatcattttataatactgctgaagattgtctgtatattgtagattcagaggtaattattcacagtagaatcaattccttttttttctctacatgagaagtatgctcttttcagtagcgatagttttcttgagtactgtgtattcaattatccgtaggtcttgtttgcatattacaccttctacttctttccttgtcctttaccttggataatttacaactacacatgtactaatgcatcgcattcaaaccatactgcctgattcttgttcagaaccacgcagttagaaaagcagatttgggaaggaggatgttagagaccgtttatccagtctccagtaaaagtagcagtggcatctggagttggattgttgataagctaggcttgagacgggaagatgctccaagtgaaaatttcattgcagattcaatagcatttccatggcatttgctaaatattacagaagatgacttcttagtagcagaccgcaagtatgcacaacttctcgccccctacacgttgaccttctttaaatatcaattggattaatttgtctctctcacaatggctatagccatttgcatctaatttaacttattttcaattttctgcaccttttctatgttagattgtcattcgtttgggggttgacatgttgtgcatgtacagtccagtcagatcccagttttagttccatatcgataatggagctcaataatggttctgtggatgcttgctggctattcttttgatcaagtgtgacaagaagatgcttctttcgggaatgcagaacaacattcttcttaagagacttttcttgttcatggtgaacctatagtttttacaagaaatattttaccatctatggctgtgcttaaataaactattgaagtgcttaattcagtaaagctgcactactttcttggtttttaactttttatatggcatgcacacacaatatactgtgcgtcagttataggtggttcctgtttcggacatattatcttgatgatttgctaagaaatgtttcttagttcttatattactgttgtttgcagctttgaagcatcatggatcttgagtgtatcaactggtcaaaaacaggaaattggaagaggtcagtgaattcctttttttggtatgtcagatttaaatttccctagctcattgaagagttaaagtcttgtgaaggtatagctgaagaaatggagtcatatcagcaaataatacatgaaagatgtgctctcctgaaggatatgaacatgaattggtcgtcaagtgctaaagagcattctgatctgttggggaagatcccgttcaaggaacttgtctcgtctgttgcaagatttcagaagtacattatcttctgtgatgcaggttgatctataagctattattgatgttaagacttgattttctgtcaaattatataataaatggttccaatttatttcctttctgtgaagatggtcaaagggttttgaagcatgacttggataccaatggcacctcaaatattcaattttcgaattttggggtccttgggttgccgtattggtttgtttgccatctcgagagagtatcaaccaggtaagctgcttatcctatatttatatgctcaacgtgtttgtgatgacatggaaattgatatgctgatggtagaagcttgagtgtgcactgttttgatattcatttctctttgttttgtaatgaatcggcaggggacattcaattggaaaatttcaagagcatacccgtaaagtaaatgtgctcccaggtaagtgataaattaacagtatctgcctgttactattatccggttgttccatgtgtgccacatgaccatcattgactgcacttatgacagctctaaatctacttgcaagtttatggtcacatgacctttagacccttgttacctcagacagagtggtatcacatttgcttgctttcagcattttttttgtaacttgcggtgccttcaacctcaattgcttttgaattgacagcagtcatgtgctgcaattgcataatacaaaccttccaattctaaaacaaactgcacaaatttgaataatcatgagaaataatgtaagttactcaggtgcataattttaagaggagctttacttattgttttgtctactgatgccacactgtactgctatgtgggattcattcaagatattggtgtaactcgatgtgttcatttcacaggaagatgcaatataaaggtttctgtagatataccagctgatactcaacttgccgcgcctttggtcgagagttgtatttggcgccaagtaaggggatctggtgctgaggtatctggttttgatgaaccatccacaagcacagaaaaggtaaaaggaactccttattttgttcatgaactctgtgatctcttgcatagagtttgaccacagttgaaagaagctaatccttgatccgatgcacatgaactcaggttggtatagcacagcaatggtatgatgagatagacaacctagctttttctgaagttcctgaggaacctacagtgcatgaaggtgatgagaacctttcagatggaagttatcaagaacagagaagagcgcatttcaactgtgttgttaatgtcagtcctgggacatgcgaggttcgtctgtctcctctaaaaaacaatcttctacctttgtggagggaaaatgccttactggtgttatgtcatgataactctcaattactcatgttttcatcacctagaagttcagacacattgttcacacaatgccatgttgcctttgcagctggtggcctttgctgcgttgtacctgaagatcgatagcgcgaaagatgaccacggagaacagaaatcactggtgaagaggatcatccagtgccagcgtcgcgaggatcacgcaggcgttgagctactgatggagagctgcaaggattcgagggacctgacaatcatgaagccggtgcacctgaggctgatgctggagtgtgccgatcatcctgctgggaccaccaacaaggagaccatcagctcagagtccagctttgagataaacatctctttagattagtttccaatgatacgcatagcatgatagagcagcagagtagtttgatttgttcgctagagagagaaattcaacactttcagatagttttgtatctcgatggtcctgttccacatgaaaattttcagttgagaaactggttcatggagcacttaagttttttttttcttttggctcaactttactaccacaagtctgtaataactttctccacttaaatagtctaaaagttcgaatccaaaattttgaattcaacaaaaatcgaaattcgttgcatttggtctcttttgttttgtgccaagacctttgtgcctgcaccgttatacaagtccacctcagctcgatttgaaaaaaaaaaatcggtcagtaatatttcctcttcgttgttgttattcatgtgcatgatgcaaatatatttgatcaaattcagatgttatcttgagcaagctagaaaatttagcatactctgaatatctctcattttctctatgtcatcagtctccaaattctttcaagggtgtctttccaaacttgaactgaaggttagctagctcatagtgttccaaacatgaaacatgtgtgaatttggaaacatcatattcgaactacttactcgcacacccacttatatgtgagtaggtaatctacaaacccacttattaaagatcaaaataagccacttacccgcttattttaacttataaatgagttcgcggattagccacttacactcttaaactgatcttggatcgacccgacgatcaggtgtggtgatgaactgatgatcagctcggtgacaataatttcagcaaaggcatcatatagcacaacaacatctacgatcgctatgatttcaagagacatgagctcactagctcattatctaaaaaatgagctcactagctggctgagcacgatgggattatcatgtgttcattatccaaaaatatttgacttggtattattctaaaaatgtttatattttaggtcggagcgagtactactagtatacctagtatactttctccatcccataaaaaaccatggtactatattttcatttcatactgtatacaccagctcttaaaaaaaaaaactgtacacacctgcctaacgctgacgaaaaagattttgaccactcccaaaaaaaaaccacacaggttttgacctgttccagtgtcactgacttgtgggcccaggagtagccgcggcttgccctcgccgaccttttccttggcgatgggagcacgcgaatcacgacgcacgcacttccttctttccttccttctatttctaccgccgacgcggccgcgagccacggngagcagcggcggagcaccgacgcggcggccatggagaggaccgcggcggaagcagcggctggggggaagggggcgtggagggacggccccgtgacgtacctccacctcctcttntacatcgccatttccggcggccagatcttcttcaacaaaggcaagcccaccaaagcaacccttctatcaggcgacaccatcccctccctttttttctaccccccgcgcttctccggcggattctgcctgcgcgtgcgcgtgatccgccgccggcgtgcccggctgtacggcgcggcgggcggggggttttctgtggcggctcgtttttgtttctggtgctgtacggtgtgcgaaatgggtaggattccggatttctgttcccctctagcttttcatggatggtcaggagggtttagattagtgttaattgttgtctcagtattggcgtcatggatgttctgacaccgcgggatgcgtgtaaacttggtgaaaattggtggattgcatctccgtgtgcggtctagagtgagcgctttcgagattcgaagatggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53757 - DNA, 10027 bp, Oryza sativa
  unsure (1)..(10027): unsure at all n locations
tgcagagagacacacaaagccaatattaatatgcatgctccatgtatacatttttctcatcaggtatgtagctcaagtagctcatgtatatgaatggatcccccttttggtatttattaatccctacttaaatgcattcgctttctgaaaactaaacactctctctggcctaactccatatatgtaaatggtatgtacaattgaatacattcatcataggaagtgagttaattagtgatagatgacagtgtgacagcctgcctgacaggcacacaccaaataacaagaggtacttagcacttactggtggagaacacttaagtgcaggaaatcagcacagcaaaggcagtaattaatttctaggatttaccacatatatgcaaaggattaattcagaaggatcatcacaaattaacaagaaagcaaagcattataagagctaagtaccaaacaaatcaaatcaaacggatttgaacacaaataatccttcaccaacacatctgacactactactatacctggccgagggagagcgccgaggaagaagaagcgtaggcgacgccgccgccgccgccgccgccgttgggccggccgatcatcgccggcgacatgttccggccagggatcatcatcctctccctctccctcagagcatatacaaatatatgcacacaccagtactagagagagagaaagatatagctatctagctagaccaacaaccctaaatagctagagatccaccatggacgaagcaacactcgcagagctcagatctaccaacaaatcaacaatcgatatacaaacacacaccccactcgaaacatatatatagctagcgctgcagttgtacggtctatctatatctggcggcacagccgatcacgcagtcgtcaagaacacacataaaaatctctctctctctgctgctgctcttgctactgtctgaaagagagagatcagagtggagtgatgtgaggaggaagaagagtgcggcggtggcggcggcgggaggaggaagaaggaagagggggaggaggtgaggagggtgganggtgccgggtattgaaaaaggggggagtaattgcggggagagtaccggaaagggtgcaatgggcattcattgcgggcgtagcgtggagttattgcatgacacgcactgccccttctagcatctctaaactctctctcttctctcctgtactcgcagctagcagtggtagagagagattggtatacgatgtagactacgtgtctagtaggtgtgtacgtacatacgcgtagatgtatacggcagttcgtacgtcatgcatggcctggcgcgcgcgtgggaaaattggttcgttggtgcgtaatatgtatatctaccgatatatagtagtatactggttatagtcgttagatcgtagtgtaataatatatatggataagcggttttatcgtacgttttgctgaaagtcatcagtgacgtctgacaccggccctcttacactacacggatactagctcagtatttatcatacaccatgcaaagttttttgatctcttttttgtttcttctctagtttgtttggattcactacagatgaagattaagtatggacacgtaaaacaagaaggtcattaagttttaataattttaaacttaaaatggatttgttttatattttaaagcaacttctatatataaagttttttaagttaaaaaatgtacagtttagcagttaaaaaaataagtaaaatttagattttactacaaggagttgattaaattttagattttcgtggcacgcttttcaaactactaaacggtgtatttcgtgcgaaaactttttatatgaaagttgttctaaaatatcagattaattcatttttcaagtttgtaataattaaaagttaattaatcacacgttattatcacctcattttgcgtaaaatacttaatcttcatcttcatcttcatcttcattttcaggagattcaaacaccacctttgtatcttaataaaaaaagtttggaccatttttatggaattggataactttttaagttacgtgcatgcggtttagatcagaatgaagagtcgccaattaggacacttccaatacaagtttcgttctactattaaattaggtactactccatatcagtaatttggatgatgtgtaaaaaataataatgaagtgagagatgaaatgggtttgtatcttagatgaaaccttctatacgctgtttccttatatgtattgcctataaaaccacaaacatgaaacaatgtgttatcatattagctattttagtcatcaattaaaattaccttgttgcattggggatggctctagtatagtacagttgtgaaaaaaaagaagtgggttactaaaataaaataagaggcttgtacgaacgacagagactagccaataataacttaaaaagtttttagtcgaaactgaaatgtatataataaatataatttagttgtatacaactcacatgcatttatatctcgagcggtaggggcaactgcgtacaaaagattattatattaaagtaagactaaaagaaaccatagttctcatttgacggtacaagcgtacgttgacacatagttgatctaatcgactaggtcagacctgatccttatgaacgtataacttagagaaaatcccctacgtacacatgaaagttcacctaatcccttctatacctctgaattttgctcaatcccttacatacccctaaattttagtttggatctcttccatgccctttccgctagttgacagttagttgaccgttaaattcttttgaaaaagtccattttgccctttcctatgaagaaacataataaattaatgaagtacattgttggaatgtaaaaatttactggatgagactattatatttatgagtctgtgatgcaccatattatttgtgacaaatttacttttacatatgatataaaaatttaatacttatttattagttattaaaagttcttttatgtagcatatgtgttttcatagtaatataacatatttgtttattactatcagaacacatatgctaaaaaaataaataagaattaactttttatgtcatatctaaaagtatatttatcgcaaataatatggtgcataactatctcataaacataatagtctcatataacacatttctatgctccaacaatatactatattaatttatatgcttctttataccaaagggcaaaatggactttttcataagaatttaacggtcaactaacggtcaactagcggaaagggcatggaagggatccaaactaaaattcaggggtatccaagggattgagcaaaattcaagggtatagaagagattaggtgaactttcaggggtacacaggggattttctccataacttaagatttatggagtcacaataaggtggtgtttggatcagggacttaactttagtctctgtatttagacactaatttagagtattaaatatagactacttacaaaactaattacataaatgaaagctaatttgcaagataaattttttaagcctaattaatctataattagagaatgtttactgtagcatcacatagactaatcatggattaattaggctcaatgattcgtctcgtgaattagtccaagattatggatgggttttattaataatctacgtttaatatttataattagtatccaaacatctgatgtgatagggatttaaaagttttagtcccatctaaacagggtctaagtacctcactgttgatgagtgtatcacctaccactgaaaaaatatagttgtaacacaagtacatatactgagttggatacttaaacccgaatgtgtgagttccatcaaataaaccataatttactttggagacataataattaccacatcgatggaagaagaagaaaaaccatatacaaggttggtggtgtgaaaatccatactacaacaaaatatgtaaatatattggtcacatgtataacaaacgacaccactagtacagaaatgattttcgcaagcggctaaaacctattttcacaagcagctgggtgggccgcctccccatacatgtctgtaaaaattggtattttcctagtcaggtagggcatccatgcacgaaaagcgattttcgtggcggtcagttaagccgtccacatgcgaaaagaaaagaactcacaaaaaatcccaaaattgaaaccctagatagcctcgattcacaagtgcagtcgtcgtggttaccgcagcccattgttgcctccgtcatcgttgtcacagagctcctgagcatcgttcgccatcattgccagaggtcctgcagctcccgaagccggcagcaccagctccgccgccactgatgtcccaagcactagatccgttgtcgctgaggtttcgagcactagatccaccaccaccgaggtcccagatccgcgcccgccatcgtcgctgccgccttcacaaacctccatcgttgagcacccagcgccgcacccgctatcgccgcctccagaagatcgtcatcgctgcctccgtctcttgtcgctgccactaagagaaatgaggagatcggagtggagaaaaatgaggataagggagaggagtggaagagaagcggagaggtacgtaggagagaaattaaaggagagggaagccgatgctatatttttgcccaggtatcaaaaaagtccgtgtgcgaagtaactatattttgcaggcggggctcttaaggagcccacctacgaaaatcattttttccaagcgggtcttttctcgacaccctaaaatcattttgcatatggatgttcttttggtctgcttgtaaaaataaaaggggtatctgcaaagatcatttatgtagtagtgggtaacatctagttgcatatataagatagagatatactttttcaatgaacataaaaatagaattagggatttacagtactaatttccaataatcccaatataacccctcgcaattgcatggcatgaacaggtgaggtggtggggtatgtcaaatttagaatttgcaagttaaattataacaatttaaaattctatattttctccaaaataggaacaaaactattcatgaaaatgtttatcaatatgatcacttctccaaattaaatatataaatccgtggaacagaaacactcaactctaaaaaaatattcaaaagatacacaactctaaaaaatattcgtaaatctagaactatgtcaaacacacgaccatatgtatatacacgtactgcacgtacgtgtcaacgtacgtagcatactgtaaagactaaacagattatagatggagggtgaacgtgtacgtacactagtagcaagctctttcagaactaattaaggccatgtttgtgtgtcacatcagatatacggatatatatttaaaagtattaaacatattctaacaacaaaaaatattacaaattctgcctgtaaactacgagataaatttataaagcctaattaatccgtcattagcaaaatatttaatatagcaccacattgtcaaattatggcgcaattagacttaaaatattcgtctcgtaatttacacgtaatttgtgtaattaatttttttatatttaatactatatatatgcatgtgtccaaacatttgatgtgatagggtgaaaaaattttgtttaggaactaaaccgggcctaaaggtaaatggacacatgtatatattatatatacaggagaagacagggtgaaaaaaaaagagggagaagaaacacacagccggtaagtggtgtgtttggtttttatcagcaacagcaggcagagcaacaggagcggccggtactgcacagagccgtttttgtgagctgttcatgacttgtggtgaaagaattaataggtggtttaggtccagaatttattgctttcgatctctctactacaccgattgatggagtacgtatacgtacgtatatactcctgtttatatgtatactgtataaaacatgcaaacttttacagttctacgtttatacaacacgcatcggtatatatgaaaaatatatagctagaataatcattattggtctatataaaccaactcggatgcagcaacggccgatttatgtattattaaaaaattacaaaccaaatcaacatgaactaattaattttaactattttatagttttgaaattgacaataaattcaaatgatctttttattatactgtttaaaaatgattgataaagcactttggaaactagtgttgaccaaatagtataatgaacagcaaaatggcatgcatatatctaagtgcgttatatacataatttaattgtaggagtacgtaactctaattttgaccagacatatggcgcgcatgcatatatctttgtagatggagaatctcaattcactacaagaaaacggaatatgcttgacggaatctagtttatttttttccaataaattgttcagaagttttagatttaccatgtagatagtagggttgcaataatctcatatttaatataattaatcttgtaatagtcacttatatttaaatatctaatcaatcttatttcagaaaaagtattttggtcgcttgatctgcatcgaaggatgacacaactatatttgtggatatctatggatatacaactccaccaccacaccacagtggtcgtgactaaaacatatatttattaattaccaggggtttttttaaaaggaatgttcaacaatggttttttccacgtattactatatatagggtactgttattatagagttttattgtatcaatatcggctccaacttaatatgcatgcaatatccagagttcaggtttgatacacactaacttcaattgaaatcatttataatttgatgggtgcaccgtgcactacatattatgcttttgtttgaaatgaaggtaggaaaggcgacatttcaagtcacatggcctatgtgttatgaaggtcagcttaaatcttaaatgctgtggtccacaccggccgcaagctgggtaacaactgattatgatggatggattaaaggatatattctactccggtagttacatgtattatcaaaactttaatgtcataagaaccttattattttcttgttcacttttgaggttggtgatttattgaatgaagtaaaaaaaggacaagcaattttcttacgtttatagtattacttttcacatctatgtggtttatttgttaaattttttattttacatgtagatttatttggagttggttccgtagctacatgcactaaaaatttatatatgaacctagctgtgaattgatctgttcacagagtaaaatgcgtcatcaatagcacaaaaaagtgaatacaattcaacctctcattatttgctctatagcttatatgccgttgtcaaaatttaagtgaacttgatttggagttgattttatgttctttttgtcgtagtttcttttttatattggcttttaataattaaacaactaagggcatagatataaaagtttacctataaattattcttttactaataagccgtttttaggccaaacaatgggacactttagtcacttattatcttgattcttgaattgctagcttaaatagtcacttatcctgaattgcttaaatatggaaaacagagagacttggccaaaaaaaaaaacagtgtgctatgcttaatttggactatatacatttgcacccagctctctatatgtacaagatgatgtgaaggacctaaaatctgaagtaaatatttattgcatgctgatcttctctacacaaaatttggttgggtccattatattggcaggtggtcatgcacgggatgggccggagacgttgcaatacaatagaatgcatgctagagactaaggctcctgcagcatccaattaattccggctggccacgtacatcaattgatcaatatcagatttattgatgaatggtcaaccaccttgcgtgcatgcgtcataattccggccctagcttgtattgtgaaatactatcaatatccctatgtgtccattattcccttcatacttataaagaaagttgtttaggacagcgacatagtctccaaaacacaactttaacttcttatttctataaaaatatttattgaaaagtgatatatgtatacttttataaaagtatttttcaagacaaatctatacatataatttttacattttcaaactcaacaacttaagagttattcataatttatattctcaaggtttgacttaaacattgtcctaaacgacttcctttatgagtatgaagagagtattttctttgtgtggagatagtggcattgttaatctagtactctctccgtcccaaaataaaataatctaatattgaataagacataaatctagacagaaagactaattagatttatagtactaagatgtgtcatattcagtaagtactatgttagtatattattataggacgaagatagtaataagtgatgagcggatattggacagtggtactggtggtaagtttgccaacaccctcactacaaactccatatgttttttttaaagaaaaacattgacattgtgagatcagagagttagcaacatgtgtcaacgatttccaccatcaactctctatttctatgaaaagaaaaaagaacactacgagagccaaagggttcacatatctctcggatttgctattttaacttccaacaaaaactttgggagaatatttgttaaatttctgatcgttagatgggcttgaagatgcgtgctagcagggatggggtaaatagtcaacgtggatgcagcacatggaacccttgcgcacgccaatccactaacctatgaccccttttgtgaattgtgatgtacacaccactgcttacatcttacttacattacatattagttgtagtatattgtaattgtactaccgttatattcgacaaatttttagaggcattttctgttgaatgttaaggagggtggcggtgaatctttaacaaatactcctttagaaaggagtagggtggtggtgaatctgttataacaccctcaccactaactctatttttttgaaaagaaaaaactaaattgtgaggcccatatgtcaatcaccccccactacatacctacttttctacttttgtgagaagaaaaaaatgataatatggggctaaagggtccacatctcaataataaatatatttccaaattaaaagatgacatgtacaatgatatttttttcaattaaaatcctatggcaccgaaccgacaatatgctactagttacaagtcacttatcttggacacgtgttattctgagattattagattacatagtgtttgtaagccttattggaccctctatgtcaagtcaaggtttcgtctaataagaaaaaaacagaaacagagtatgttcactttgtttacatttttaagcctaccaatatttgacattatcaattttcgatatgttttggtgttaccaatagagcttttaagagtggaagctttcgacttctacaaaatttggtatgatagtagtgacaagaatatgtttattttgttgtcttatcaaaatttagtaatactcaaatttggtagggttaaaaacgatgacaaagtgatcaaacacgcaatgactacctgtagttgcaaagtggggaatcgaaatgtagtttttttttaaaaaagaaaatgccaaagtataagatcgaaatgtaggtgcgtagcgactgggccttcgcagcgatttggcccaacaagctggatcacaggccgcatattccatgccaaataggaataagttcatctaaggtcccttaacttgtcaacgaatccgatttacgtccttcaaccacaaaaccagatacaacgggtccctcaactatcaaaaccggtgcagattaggtccctcggctgtttcgatggcggttttggctaacgtggcgtctacgtgactaatttgactcggtctcgatctaacatggcactgatgtgggcgctt

SEQ ID NO: 53758 - DNA, 1175 bp, Oryza sativa
ggcccacgtgggccccacatgtcagtctaactcacccccctcctcttctgcttcctctctccccatctcccctctttttctctctcttgcgacgacggcggcggcggaaatggagaagagtggccgccggccatctcgctcttgcacacgctcgccggtagagtagggagctcgcctagctccttcccaccggtcgtcgcccttgtccccgatggccgccgtctgccgcccttctccccgatgaccgccggcggaagaggaggaagcggcgccaccaatttcaccagcgccccacagcgacggcttgccggcgccgctctccgcggtgacgacgatgaccgtggatgtggcggcgccagcgctggcctcgacgtcctttgctggccggcgtcatcgtcgatgacgacgacgactcgtcggaggacgacgcgccgtcgacatacattccgatggcggccttcctgacctcgagcacgaacagcagcagcgtgaaccagacgatggcctggaagacagagagctggacaactgttagcattatttttgtgtggcagttagcttcgtgcatgcggctagctagtggctgccgaattaattggatcgcgcgcgtgctgcgtgcgcgtacgatgcgggcgaagtttgtttgcttagtggtgtgtctgttgggctataaaagtcatgtattctcatgagttaagtgccaagtgaatgagaaaaaactagataaggtgttcgttgtcgagaaattcttctgtgtttgtccacaaagattttcgctccagctagttgaagtgtgcgtgttgctgtaatccttggccagagctgacaacgacgagctgctgtgcccactcgccgtacatggcgcgcgccatgggcacgccgacgatgagcgagttggtcagcgtggacagcgagaagctggtgatggaccagcgacggcgcagccgcctttgctcattgtagcgcccgttctgtcgtggcgcctagtggaaaaattatctcttaaaaaccctaattgcgaaatttatttccttgcttgtggtctagtgtccgtgccatctcaagatctcaatccccgatctatcgtcgagttcaattccgaatccaaatccatcccaatcaaatttctccgcataagtctattttgcctcccccgaggtcgatgggccgaatct

SEQ ID NO: 53759 - DNA, 803 bp, Oryza sativa
tgttaatttctcttggtcctatctcatttcaaatgctcaatttcaaacttccccgggtttattttacttcagaagctaaacagtgaaattattaagcaattttccctagataatatatccagaattataactctcccttgcattagcttgtttattttgatgtgtgcaagcgcaggagagataatgtgtgtctccctagttagtttctttttaatctttagaaaataaactttacctatcagatttttagtacaagttaattagaacagcaagaagtcaccaatgtcatactccacaactagatatagatcaaaatcacttgtctgcatctccaatataatacatatataatgtaatccaaattatattcacacctagtcttacttaagctgaattacagatatatatgctcgatcatatcatgaaactgcacacagtgcatattttctagaactctagctatatatgaacaattatttgctactctttctgcaatattatccttgactgttgcacagctcatgaatgttaaatcacaatgcagagcttgttggatggacaccaccatcagctgccatcactgctgcagcagcaccacaatggacaccatctgcttgatcagcaccagcagcatcagcatcagcttcccccacaggcgacgacgacgagcgagagcgacggccgtgcccctcgcgacgagctggagatgagcaagtccggtggcagcgacaacctggagagcggccgtggccgtggcggaagtggctcccgtggtgatcaggaccccaaccagcgcccccgca

SEQ ID NO: 53760 - DNA, 17839 bp, Oryza sativa
tggtgatcatgaaccacgtcagcctcgtggagatgctcatggacgtcgggcagtggacggcgctcttctcgagcatcgtgtcgcgcgcggcgacgctggaggtgctctcgacgggcgtcgccggcaaccacaacggcgcgctgcagctcatgtccgccgagttccagatgccgtcgccgctggtgccgacgagggagacccagttcctgcgctactgcaagcagcaccccgacggcacgtgggccgtcgtcgacgtctccctcgacgggctccgcgccggcgccgggggcggatgccagccggcggcggcgcgcggccaccggcgccgcccctccggctgcctcatccaggagatgccgaacggctactccaaggtgacgtgggtggagcacgtggaggccgacgaccagatggtgcacaacctgtacaagccggtggtgaactccggcatggcgttcggcgctcgccggtgggtggcgacgctggagcggcagtgcgagcgcctggctagcgccatggcgagcaacgtggcgtcctcgggcgacgccggcgtgatcacgacgtcggaggggaggcggagcatgctgaagctggcggagcggatggtggcgagcttctgcggcggcgtgacggcgtcgacgacgcaccagtggacgacgctctccggcagcggcgccgaggacgtccgcgtcatgacgcgcaagagcgtcgacgaccccggccgccctcccggcatcatcctcaacgccgccacctccttctggctccccgtcccgccttcccgcgtcttcgacttcctccgcgacgactccacccgcagcgagtgggacatcctctccaatggcggcgtcgtccaagaaatggctcacatcgccaatggccgcgaccacggcaacgccgtctccctcctccgcgtcaacgtaagatagctcttcttcctataaaatggatgatgaatcgatccatcgccattgctgatgaagagaagaataaaataatttggtgcagaacgcgaactcgaaccagagcaacatgctgatactgcaggagtgctgcacggacgcgacggggtcgtacgtgatatacgcgccggtggacgtggtggcgatgaacgtggtgctcaacggcggcgacccggactacgtggcgctgctgccgtcggggttcgccatcctccccgacgggccggacggcggcggcgggtcgctgctgacggtggcgttccagatactggtcgactccgtgcccaccgccaagctgtcgctcggctccgtcgccaccgtcaacagcctcatcgcctgcaccgtcgagcgcatcaaggccgccatcaccggcgacaacggcgtcgcgccgccatgcccacggtgacctcgccggcgtgcccatctatctgtccatcatgtgcaatggtaagtgagatcccctgatcattacagaacgaaatttctaaaattctctcaatttagtaaaattgttcaaattcagtcaaattttgagccctattcagtgttttttcatctgcaaataccccttttcttatttcagcaagattgaactctgctttaactattcctacaaaattccagcaaaattactaagtgatcaatttcttgaaatggttttctctgacttaatttcataattcgcatttatgatggtttaaatttgatcgaattttgtgcaggggatcaagggagggatcaagagcgaattcggaggtttagcaatgtggggagtcaagaacgcaccgcagactactgtccttgcaaaagtgtagttgctgcttcagttagctagttcatttatcattttttttaatcactatcaccaccaccaaaaaacccccagaaaaattaatcatgagtaaaaaccttaattatccaacacagcagcaacacaacttaggtcctgtgatcatggctgatatatatacactacatatatttatacagtgatatgtcataggctctgagttgtgttgctctcaacaaattcctactcatcatccaaaattaaatttgcttcagagttcagacaaacacattgcatccaatccatgcatatgccccctcttatttgatttcagttaggttagtttcagttaagttattaatgatctgtcacctgcattacatggctcatcaacagttcatcagagttaattagttcggaagcaagcaacactttgcaaggttggttggttggttcgggtattgactcctctttctctctccgggttgccactctctctctagaactcctcttctgatgcaagatttgttaatttcatcatcagctggactaatgcatgcatatgtgtactgcatagtagtacctttaaattcagtttgcaaaaagagtgtgtatcatgtttgtgcttaatttgctctccttgtctattagattgggcttaaactttgcatgcatttggagatttgcagaagtctgtcttgtatcctctctgtgattctcatggacagttcgattaattggactacctttttgcatccatatctaaagtctggctgagttgatgcattttgttttggtgtatatctgcaggtgttcaatgatgtttttgtgtgtgatatgaatgatgcgatattttgatgttgcttcttgcacaaagtcagatatgaaatgatgttttcctagtatatattttccaaagctacatctcaaaaacctacacatgacacatcacccatggttagtcttgcaagaaaaggacattttctcttttttggttcagatgatgctgtcaaagcataggaaaccatgtgtatctcaaaaacccatacattacctattggttagtcttgcaagaaaaggatacgtctcttttattttattcagatcatcggatactgtcaaaacctaggaaatcatgtgttccaaacaaaacagatcaggagaatcaacaaccatggcggcggcagcttagctttaaagacagttaagccatctcaacttaaatgaaggccctaacacccaacaaatttgttggtttagtcagagcaggctgctgtcacagtgtcacctgtcgacatctctcactcctgtacaaggaaagatgttgttcaagcaatgcagcagctgcagacagacagtagcagcggtagtagtaggttgtacattttttttaagatgatgttagtacattttttactactagcaaaagataaaacttttaactaattactagcaaaggtagcgtagtgactcaaccactaaacaaatgtcacaattcacctcctctttgttcctttcatcatgttcttcacaaagtaacaagacaactgaagattcagagagaacacagcatactacggagcaaagctgaaaagatatgctgatagaatggagaaagattggtgtttatttagttatatttaccaactccgccaataacatcattcagatacaaagacaaacaaacaaagatactcttgtagctaatatgaacttccaagcattattggtacttttttatccaaataacaaagctctaatcaattgctgctgttgtattgcaccctttcaaaactgctcatggaaaagctatcattttttagcccctctagagttttttcagacatcaaggtacttgctggctgtgtggacatccttgtctcctcttccactgcagttcaccaccaccctcacgccgtcgggcagcgttgggcagagcttctccaggtaggcgagcgcatgggacgtctccagagcagggatgatgccctccagccgagagacgcgcttgaaagctgcatgtgaagatagcattcgaaaagggaatagttagattttgagcatagcacttaaagagttagatattgcagcattaatcaacgattgggacatcaactagtaaatgtttatcgttatgtcagtgaagatgtgaaagacttccaacataactttacgcaactcggtaatattttagtactcaggattatgttaaaacaagtaaacaacaatcaagatcaaaacatcaactaaatgtttaacataacatgcatatgtgacagactgacggctagcaaactactgagtcagcaactcagcatgttaagaatttgcctggtcttacttatctgtaattcagggtcactttcggataccctactaactcaacagcaaagcttaatttccagtgtaaatctaaagtttttgtctaacatgtgaatcagatagagttgcagacaaccaaagcgtagttgctctgatatcattaagatggtagaggggccaaacaacaaaattggtgccttagccctgcttaaactcgtatcaagaaagttcagaacattcacaatatatgctactaagaataacagtttttaacagttgttggttctattagcctactcttactcattagcagtccccaccatcaaagagatatactattggcatttatagtagatattccaccaatcaagtggaaggaaaatatcagagaagagaaccgtagatagtgacactgaaacacataccatccagtgcctcctgatctgtcacgctgtcatattcagcacgtccaatatccttcaaaaagctatgctcaggcccaacaccagggtagtccagcctaccattcaaaacagcatagatgattagcccaactgctgtaaaaatgaattactgtcaatgccaacaacagaatactcacccagcactaatggagtggggttcaataacttgtccatcatcatcctgcaacacatagctcaatgatccatggagaactcccacttctccctttgtcaaagtggcagcatgtttgtcagtgtctacaccatagccagcagcctccactccaatcattcttatatcttgatcatcaacgaactcatggaagagacccatggcgtttgatccaccaccaacacaagcaaccaagacatcaggcttgccaccccacttctccatggcctgtctacgggtctccttgccaatcaccttatggaactctctcaccatcatcgggtatggatgcggaccagcaactgatcccaaaatgtagtgagtgttctcaacattggtgacccagtcacggatggcctccgaggtggcatccttcaaagttgctgtcccagaatgtactgccctcacctgtttcagcaaaagagatcagcaaaccatgttgaggaacaattgtacattcatatcgaaacgagtgtacacgattgcaagcacaaagatgcacaagtttccgtcatacctctgctccaagaagcttcatcctgaaaacattaagtgcctgcctctccatatcctgagcacccatgtagatgatgcactgcagcccaaacctcgcgcacaccgtggcagtggcaacaccgtgctggccggcgccagtctcggcgatgatacgttccttcccaagccgcttggcaagcaagacttgagcgacagcattgttgatcttgtgggcgccagtgtggttaagatcctccctcttgaggtaaatcatggggcctgtgccatcagcgcgcttgtagtgctcagtcaatcgctccgcaaagtacagcggggtctcccggccgacgtaatccttgagaataccatcaagttctttctgcaaagagcaaggtgttgtcaagcacacaactctcttgttatttcataatctccctagcaatcaaaatgactactactacttctaaacatttcgcatgattcaggaatcatatgaagttgcaggcattgcagtgataaatgaaacaaactattcacactattgaaatgcatttggtctctgaaaggcgatgtagctacagctcaaatacagtgataccggtgcttgaagaataggggctccaaagtactatatgtggctgcagttctcggaaagggacacagacgaaaactgaatcttcgtcgaaaaatcaatcggtctcaaaggaagattgattggttctgcaaattgatgtgacttctcccctctaccacaaaccagagatctcaaacacacacaagtatcacgtattactagcgttaatccacacaaaataaaagaagcaaactataagaatataatcgaagcaatcatcattaatccacaaaagaaacaaaatcgacggactaaaccttgcaaatcaacatctccgaccatcaaccaattcggcgacgaaatgaaatggtggcgttttccaagggggttgaagaaaataaaacccaaacgaaatatacttcgcgaatcaaatcgaaacaagcgagcaccaaatccaataaatcggagtggggggaggggggatccagcaccgcggcgggtacctggaaatcttcgtcgccggcgagggcatggaacgcggcctcgagctcggtgagcgcatgcatcagcgtctcgggcacgtacttgcccccgaacttcccgaacctcccgaacgcgtcgggcctcgcgaacccccccgacgccgccccgttcacctccccggccgcctccttcgccggcgacgccaccgccttcgccggccgcattgccgccgccaccacagcccccgctcccctcctccccgccgccaccctcaagccccccgcgcgcaacgcccccgcaccgaccctcgacgccgagatcgacgcagcggcggccgcgttagggttcccgacggcggcggccatggattccgaccacgaagcgagtaattaatggatagggaggagaagaggttgagtgggggagaagcgggtacacgaggcgggtatataaaccggtcgcggtaggaattctcccacgcgggggtaggtggtccatggacccggtgcatgggccggcccactcacagcgaggcgccgggtccgcgagggcgtttcgtggaccgggtgcagggggggtcgcaccgggcccaccggatcggggtaggggtgggggcgggtcattcggcacgtgtggcgggggcgttctcgtcagagcaagttttaacagtatagctaactgctggctctaaatcatctatagctaatctaatagtctattcatacaatagttaagtacaaaaatatactacaccattaataccggtcctatctctcatatacacataacgtcttagagtccgtgttgcaactagctataaatctgtagcccgttttcttctctcttctcttttcttctcgatacgtggttatagaaaaaaattgaaaatatacttctttttttattattttgcatttatatacctatgtgacgaaaatttgcacaaatatacctatcccgcagtgtggttacgcgggaccgaggcggtcccgcactaccattccgcgggaccggtggtcctgcagcacggacgcacggtaccgcgtcggtcccgcggaccggccgtgcggtcacgcaggccggccgcgcgtgaccgagcagccaagctgcacatgcatgcatatagcactgtttgacactgttctgcactgtttcgcactgttttcacactgttcatgagccggttccgcacattggatccgcggtaccgctgtttgaacagtgccaaatagtgtcaaaacagtactgatacagtaaaaattgtggaaccgagccgctccagcacgcccgttccgcgggaccgtgccgctcccaaggtgctcccgcatccctgccgctcccgcatacccgttccacgggctgcatcgcttccgcgcaaccgccgtgcgggaccggctcgatcccgcatccccactacgcgcgaccgtgcctaccgtaccgctcccgctaacccaatatacggacgaggtatattttcgcaaatatatgtcgtgcaagtatatttttgtaaattgaaagaaaaaaaagtatattttcaaatttttttctgtggttatagcggtcttatagtgagatttggatgtgagacgtggagggttctcggccgttcatccgtggggacggtgggtgcatcgaggccgttgattgggggatggatgggtcggattggggtcagggtgggttgatccacgtaggcaggatattggtcacgttgtgttgttttttttagtatttgaaagttgaaactagtggatggaaagagatggaaaatggtttgctgtgatacggctagttgtaaagcttgatcgtgacaaaaaaaaaatgaactagaaaagatatttatggctgtgttcagattctaactgttctcattaaacttccaacttttctgtcacgttaaatgtttggacacatatatggagcatcaaatgtagacaaaaagaaaaactaattgcacaatctgactgtaaatcacgagacaaatctttttagcctaattacgtcatgattagctataagtgctacagtattccaaatgtactaatgatggattaattatgcttaaaagattcgtctcgcagtttacaggcgtaatttgtaattagttttgttattagtctacgtttaatactttaaatgtgagtccgtatacgtaaaaaagaatttgacgatgaactaaacacggccattatctaaaacaaagatatttataccatccacatccttatctctctccaaaattaaatattaggtaggcaaataatgttttttgtttttaataacatcgacacgaggttttttttttccataggataataaattgttcttggtacctttttttcccagcgtggttgtaattggacttttgcataatttctggtatcgtgcggtaattgggattattattttcctttggcttttcccaaaaattttggtacgacaaaggctgtgttgtttggcttattaagattgagtagaaaaacttttatacatatatttttagcggtccaaagacatagttgagtgaaaaaaatgaaaagaagaaaatttaattttacaatatgtttgtaatagctcataagccaaagtccaaacaaataagctttggttgatttagtttgagtttaaattggactagggtacctgtctggaatctagacagtggtcaaagcacagttacacaaagacaagcattccaaattgaattctctaataagggaccaaaaggagatcaatatagtactaatacagtatactagtagatccaaattgcctctaaaataaacctattaaatattcaccaagaattgaattgtactcacagtccagccatttatctaggcaggttcgcatttccaagcagcagcttcacaaaccacatcaaaacagcagaaagctccacattgacactgatgtgtcccatattctgaccattcattactactgtagtagccaagtcatcaattgaagaacaagcgagatgttcttcagagtcacaggcgagagacgacgtagcaaagcggcagccttcttgtttttactaatgttctttggcctctttgactaatcacatcttcagagatctctcctcaccaaccacaacacaaaacacccttcttgctacgccgctgttaaaactggtcaaggtgttcaaagcaaaatttctttttgtttgtactaagctgtcctcctttctgtggtgattaaataaattattcagacatgagatttggtcaggaccagagaccaacaaccgaatcagtgaaaatttcctggcatcttgcattggatggacgatgaatcacggtggctagctagctagatttttccagtttaattggaagaaatatggtacactgctactactacaacaacttcagaagttcagaagcatcagtgcatcagaaggcaggcaccaggaagctcaaggaagtcatacatgcagctcatgttgtcttgccgactttgtcaagcagacatacgtgcagccatcgtagcctcgcatatggatccagcgaataaaattcaggttaaaaatatgttcctaaccctgagtccctgacatgtgacaaaatagactggtagtagcagctagcttacacttcttgtttgtgctgcacactgaaagggacagcacagattagcacaaacacaaccatcgggtgtatctcagcttatgctcatacagatgatccaaagattgtacaatctcatacagaaagcttcatgactcggatgaatattctacaaaagttacattgaggtaacatttggttcagttgccctaccagcaaaatactctacctgtcaaaccaccatagtgaacattgaaattgggaggggaaaaatatgtttgtgattttaatcaaatccctaaattacaggatcctaaactagctttgaagacaaaagaagaatcctaaacttggggacagctaaggctgcttcaatctttctaatacaatgcaggaagaacaggcaccatgtcttcaatctttcttggcatacttgccaacatatgcctacacacaaacacagcccaattagcctatatgtgtgagtttagtttctcaaatgacaagagatgccaggtggacagcgctgagagtggaagctcattgttacctggacgagtttgtttagcttttctctggagtaggacatgtaaatatcaatcttctcttttgtttgaggagtattttcaactgtggtcgtaactttgtcgacaaccttcttcacaattgttttatgaacctctctgctcatttgaccctctttccaggtgggcttaagtgcatccttcacaaagtcagccagtgcaagcttaaacatcttcaacgccttggaatccttgctcttcttgttctcaccatcttcattagcctcagcatcagtgtcctttggttcttctttcttattttctgcaggtgtagtttcattggtcgccaaggcagcagcaggaacagtcggtgcaaccgaatggggtaaaagcagagggttgccattactactaccagcagccattggtgcctgaaatgtctggggagctggttgttcaggtggaacaatatgtgaaggttggaccattcctgcttgttgtaaccaaggccagtgattaggttgaactgcttgaggtgcagcagacgaattgttcatcaaactcgaatttggatcaggctgagacgactgcagcccagaggtatcagcagtcagagaaggaacaaagtactgggccaaagatgcagtaacacgacggacttcttcctgacttgacactgcattgtgagaaagaggagctccagccatatcaactgagctggaactggccaccactgataacccttgcaaggtttgactctgagtttgctcatttggagcaacaggctggaaattatgtgtgttttgcaagccttgatcaccactatctcggcccaggttgggtgtgtcacttgttgcctgattctgcccagcatgcacgattgttggaagattctgtggaacttgaccaacattgaaaatttgtccattatgcacagagagatctggtaatgattgtgcccccataatgtagccgtgttggctgtgccccatataaggagcaactggctggctctgcatgctaggagcagagttatttgtagttgcatgaggaactgcaaactggtcctgcctatttggatgtaatgaaaagtcactttgctgaacttggctattcaaaggcactgaggatgtagtattctgcaattgggtggcgcccggaagagatggtgcagcagaaatttgagaaattgcatcttggctctctgctttttggcccaagttatgccctcctaaaagattagcagaatgcatcccgatttgcatactcaaattgccaacggttccaggtccactctgaccacccatgtcagataccttgtcaatgtttatgctctctgtgcctgtttggacagaaggtatgaactgtggcagttgtgaagcagctatttcaggtttgttttgccctactgaaccaaaatcatcctgagggaatatctggtactgactacttccagcatctttggaatgccggtttttgttctcatatcgagaatcatttctgccagtaccctgaggaacagggttttctctgtcatctcttgacaaaacatgagaacttgcctgcacagaattattttgttcactccagctcaagtaatctcctcttgttgtaggcccaccagtgtaaccaggctcatcaggtgcacccagtcccatttggctctgggaagcttcctcgtggagatatgggcaattttggccacgacggcatccaccgttagcaaaaaatttgcaggggtttttatttgttctacggtgctcagtcctgttcccatatgatgaatcagggccacttctaccaatagcattatctctaacctcatctctccatccaccatgaggggtggaatcatcatgaacatatcggcaattcgcacccctactgcatcttcctttgacaaaatcatggcatggcatcgtagaccgatactcccttcgaggttcagatctttcccaagttccttcatcataatggccacctcgaggtggcctattccttaaatagtcatcttgttctcgtggatccatgaagtccctattctgatgcccatacttttcccttgaatctacaggataatgctcatcaaactgcctgcgcacaccatcttcatgagggaacctgcaatttgagcctcttctgcatctaccagctacaaaatccctacagggaagagcaggtcctccagatgatctgcttctctcaaccctccattcagatccacggtcactgaaataaggacttctgcttctgcttctgcttctacctggtacctcgccctatgctcctgcttctacttctagaacggcttctgttcctgaacagcgtaaaagaaaacaaaaatattgaagaagcagggaaaagaaactactaaagtgaatctttcatgacaatttcaaataaatgtattccatagaaattgtaaaaacttcttatgtgagcatcatctttgacatttatagaacaaacaaaccatacaatctatcttggatatttcattcttgataaatttcattttaaaatcatctccaacagctgctacacaatatacaagaaaaaagttaccagttgcacagttaattaaactaattacttgttcaaacacacctgcgtgacctgttccaaccacctcttggagatagtggactgcgacttctcttccacgcatctggaccagatgatgatatcctagaagaataaccacggctaagagttgtaccccacccatcaccacgccttctgtcatctgcatatctgctcataccttggttaccagctgccttttcaaagcctctgttgtgccagtcatttttattatgatcctcatcacccattctaagaggcaacctttcagaggatgccttggatgacctttccttgatatctttgttgagtccatcagctcgatcctgctcatgtccagcgctaccatggtgcatagagacagtagatttgaggttcagagattcaccaatttgcttgtcattaccatgaccaaaatcctgagaagggagcaaatcactgccctttctatgatcatcattgccctttttatgatcatccatattcataggaagagactcatcttcactgatctccactatatcaggaggtccttttgtatcccacttggaccgttctttccttgtttcaccagtcattttaacccttctttattagtccaacaaagaagtagttcctggtgcacaacctcctttcccttatccgaaagtactcttgtcggtctatctgaaataatcaaagatcgtttgcatatattataatcaatggaagaatagaatacttcaacaacaaaagtgactgctgcagtatgcgcaaaagatatagctttctcaaaggacatgattcagaaacatcaacaaagttgagacacttaacaactgactgacagctgtataataagtaggatccaggatcaagtaagacatatctagtaaaagaacgctaaagccaggaggggtatactgaaacagaccttccactatcaaggattcaaggtaaccgcctaagtggctaaccactctcattatatagatacaacataagatatgtcccaaaaaactaagaaaaatttcttattgtacaagttatatgccacctacactttccaaattttagtcatacggtacattgcttggacatttgagtggcaaatcctcataagaatcaattttaggggtggcaaataattgataccctcaccaaaaagctcaggacatacttttctctggtatttttgtttaattgataccctcaccaaaaagctcaggacatacttttctctgtatttttgtttcatttgttctttgtaggcaactacgtataccaacacttgttgaagggaattcacaagcactcaaaccctagtgtgcactatttccatgaattatttttgaggattttcaggaactccctcgtgtcccaacaggaatgtgagtagttatcctctagagcgctttgattaccttccccacatcagactacagtcagcacatctatcttgcttatttctaagatcaaacaacaggacactcaacaatttagcaacttatcaacatgtaccaaactgaacacgtatttttgccagcaattgctgaaacttcagcatcacccatctgcttccttgtacatgtgcgtaagcgggttgggatattaacaccatactgcaacagtataaagtatagtactatagcctgcaatttccatcagtacgtatttcactgtccatttgaatgcccaagaaaggcaataagtataaagtatagcctacagttttgtcctgtggaatattagaatagatgtttttttagtcagtaaagtcgattgcccatcttccaaggatagtcgtgactgtcatttagttgacttcagactgttattactatatataccagttacttctactgctagtctgctactacttgctgtgcccaatggacccgacaatcctctcatcccccttttcactcaatgggctcgataaaccaggcctgccaagcggcaccctgtagctgcccttgctccaatgcgtcctctggtgccaagtcaaagtcgtatccctcaagtcgtgctccctatccgatttatcaactagctgacgattagtcacacggcttcataaaagtagaatggaataattattatagcagatttagcacaactaagcatgcgatttgaataattggccagaactgtggagattggatttggcacagtcaaaaggtggagaaaatgcccaacatcaagattgcacacaatcacacaatggaaaatgaaccttatgcagagataagaagcaataacttttttacagcaggactgtaagagtcatcagacttgtgaagaacttataaattccacacccaggtacaaaccagtgttttttattcatctggcatagttcacaatcaaaaaccatggaatacttcattcaacatatacattataaccactcaaataaacctatacaacttacaggtaaatatatgacaagaatgtttgctttctacacttacaggacggctaaatctacaaacacaacctaccaagaaaacaatgtcaagcagtaattgctgttatctggggcatcaacagattgcaccaaaattctccttcatttactgtgttccagtgttttgccagacttggtcgatacttaaggttcagttgttactgtctctgattgcagagaccttggggcactgatactactcgtattccactgaagtttctccctcgaatgttgtgttccagcgattttgccgacttggtggcaattaacagttcaattttttttctttatataattgctagctatagtcttgaggaatggagactaaaccaaaagggcagacactccaaaaagtggcatttacataatcctgcatgtgagaaagataattctatcagctcgcatgaattcctatgtcccctcacctaccacaatcatctcccaattctagcgctaagcacatcaaaacgctaaccctacattgtctaaagaatccaagaagccaaccatatagagtcgttttacatggaccatatagctagcatgtcatattccatctgatggttatctaagcaaaaaagaacacaacagttcttggtttcaactttcaagattaaacaataggcacaacattggtcagtaaatttgggtgcattaacagtgtatttgcatgcaattctaagaatggaaaagcacatacaagcaagggaaacagccaacaatcaccacaaatgaaggaaacagaaagatgacacaaaagagaaccacaagtccacaacagcaagttaattaggggttcttcacttgggatctacatggtttgctaggagcccttctttcagaaggatggtctacagactgtattacgtcaatgcatggaacatcgagaacttaaggaaacatgacaagcaagcaaggttgacatactctacacatcaagaaacaacaggaacaggatggcactgtagtatagaaaccaacctgagagactcagaatgtgaaaggtgtccaagcctcacaacacagcatcggatcttccagcttaaatcacaggaccataccgcatttgcttttcatctgaaaaaaagaacgaagtttgtcatcattcgccagtacgccacataataaatcgtgtttgattagtattaataataggcacaacccaggtatttatccattaatctcatgaagaaaaaaaaatgtgaaaagaaccctaaacccaacgcggctcccgtatagagaacatacacatcaagacagaaatttccaatccagacacgagaaactgtcctagcaacatgaagatctaactcgtacgcagctatacctaatctaaccagaaagcaactccacatagtcaactcgaagaatggagaatacagacccaacagattgcaatccatccttagacccagccataaaagatctcagctttggggatgcaatcccaaacccctccaaatcccctaatctaacaaaatcaaccggtgctaatctgtcgcagacccacacccgagagtcccaacgcacccaaatcccggccaaagcagccaccaaccaagctcgcgagcgagcaagcagccgcccaaatcacgcccaatcgcaagggttcacctacgggagggaggaaaccctaggcgcgggatccgtacgggaggggaaaggggaagagggtgggaggggctcacctcgacggagcggatgccggagaggccgcctgacttcgccgccgtccgccgccgccgccgccgccgcagccagcgaaaaccctaattgggagaggtggaggagcagcagcgagcagagcacgcttcgaataacggaatagcgcagcgaaagcactggaaaaagggggaaaatattttattattattattaattaattaataaagcgaagcgagtttgggtttgtaattgggttggagttggatccgattgtttgatgggctgggcctccagtactggatggtatggccctccatttcgcagaattttaacagaatgaaattggaattcatgaaattcacaagatcttgccgtaatacggagaactaattgggcgctcctttttttaatcttgcgattataattgtgggttcagagaaaattcaggatgaagtaattacaaatttgacgaattgatcacaatgaattgaatgaattgaatcggggtaattacaaagttggcgaatagactgcacaaaaatcatccatgatgccaattgaagttattagtaactaattacattgttatgtccgccgccactaatgaatcactctatcttcctaatcttgttgctgcggccggcgtcgtcgtcgtcgccggcggcgacgttcgccaccgtcgtggcggccttctcctgcagcttgcggaccacggcggccttgagcgccagcagcttccggcggtgcgcctccacctcctccgccgacatccccgacacgt

SEQ ID NO: 53761 - DNA, 1276 bp, Oryza sativa
aatccgattacaattagcgctaattaatcgggtgaattaataattgttaataatttggttaaatctcggaccgtccgatccgctctgtgtgtatctgatctggacgcgtggtcgttccgcgtgggtcccacccgttccttatattaactagtgaatatgcacgtgcaaggcacgttgtgctcaacataaattgaattgagcatattataagtataagaatctatttatctacgtgtattgtgtaaatatgacctaggtctagaatatacatacatatatatatatatatatatatatatatatatatatatatatatatatatatatatatatatgtaagtcctagtaattcataatctataatgattaagaaaatatctacaacacaaaatacttttgatatattgttttccattgccaagtcgataaggcagtgacaacacaaacagtgattgaggaacaatgttgagctggtagcgcggtttgttaatcttgctatcactaatacttgatactaacattcactcatcaacaacgaaaaatgataaatactcaaaattcaaagaaaaaactccatacacaaaattctaattgattttcatcctcggaccaccaaccaaccaaactgggaagaccaattgttttgtggccttaggaggaattattcaaatcatgctgccagcccacaccccttgccattcaaacttaaagtttaatgccataagtggcagtaattctgatcaaccttataacttgctgaactcaccctaaattcatgaaaaaccaatgacaaaaattacagcaaaacttccatgatttgcattgtacaggcaaatgatacaaaattatctaaaggtatggtacatgttgacttaccccttaacacatttccattataaaaatatactactgcaatatatgggtgtgcctcaaccctttagggtgtgtttggataatgggaaatgaggggtgagattgggattgggaaatgaatgaagagttaggattaaatgtatgagggagaatgaatggttaagatttaaagaggggtgagaaattatttcccttagacatttgccaaacactgccttagcatccaagctgcttcatcaataccttatctactgaacaggcagaagtcagattcagtaaatcttcctaactcatcaggtaaatagatgcaacaaatggggggtaaatctctaaattgattcgtatgtgggtgattcagaaagagacagagagagagagatagagagagattcagcagagggtc

SEQ ID NO: 53762 - DNA, 7827 bp, Oryza sativa
ggcctcgtcgccatttccccctttgctctccgccggttgccgccgccgaaatccgccgtagacgggctccctccggcgaatccaagccgttggctcgctccctctccttcttcctcgtcatcccggtgtgctcgctttcgccggtatcgccgtggttcgctccgccgctcgccgctgtcgtccgccgtccgttccggccggcgtcgtcgtctacctcccgccggcccgcatggctgccacgtagacgccacgtcggcgccacctcggccgcgaccggatcatccgacccggccagcagctccctccgtttttcccccgtacgcatgggcccgcggtgagccgtgaggctgcgcgtgggcccgccgcatccgttcctccgcgaaccgcgcgcgtgcactgcgtccctcccccgcccgcgcgcgtgagccgcgtgctccctccgcacggtgagccgagccgctgacaagcgggtcccacacgggaccgcgcacggtgagcccggtccaccggctccctctctcctctcctcccgcgcgccctactgggccgaatccttttgggccggccggcccattagctcggccgagccgcgctttttctctcgggccgcgccctagccgcccgagagaagtctacttctcctccctctttcttttctttttcaaaaaggatttaattaaatccttttcctttagacaaaaaatccaataatcttagaaattcaatatcttcccaaccgtaaatccgtttgactccgttcaacttccaaaattcctcaaatctctagatctatctaatggcatgcttagaggtcattaatagggccttattttcgccgtttgttgagttgtcccgtttcgcgtgtagtttcggagcccgaagacccgcagtgcgaggatttcgaggatcaagttccagatctcgagcaaggcaagccacctttgaacatcttgagcctatatttgaaatttaattatattgcttgcaaaatattatgcattgataggaccgcacttaatctgttaagtcccgtctgcaaggcagattggcggacctacctagtttgttgcatttgatccttcctatgttaattgatatatcatgtccccttgtaaccatctagattgcgcctcgatattcgtgcaccctgtgcgagtatcgacggttgccttcaaacttaaaatctgaaaaaaatttcttgggtaaaaattgggttttacaaaagacttggaaaacccgacacctgggtcggtgcttgcgaactaaatggatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagcctttgatgccgagagacatgtggattcgccggggtggtgtcggggaggacccctgggcttcctggcacagtatggtctgggacctaacctgttgttggtctgggactcctctcgtcggcatatggtaaacctgtgtcggctttggaaatgccttgtcatgaaagcttggaggtctcccgatgtggctgatccccacgggctgggtgatccgggttagtaatgtcgtgtgggtaaagtgtaccccctctgcagaggttaacaaactgttcgaacaaccgtgcccacggtcatgggcggatgtgaggtggttcctagcgtagttttgtttgactactgcttgtgaaattgctgttgtggaaaggggttcgatgattgaaaaatctgcagctgatgggatcagctaggcccgggtggccgtttgaaagttgttggcccgggtggccgtttgaaaagctgttggccgggtgccaaccttgtttcaattctaaagactgatacattgcacatactccgaccggacaagacgcactgtctcatccgtgtcgtttgagaagcactcacttagttgttttcagaaaagggttcaaataaaatcaattgctaaaacaacagcctttctttgaagcctgcattaaacacttatttcccatggcttgctgagtactcccgtactcacccttgctctatataaataatcccccccagttgctgaagaagatgaagcggatcctgctgatgaggaggtcttccaggagcaagccggctacgatgagttttagggtttcggcctagttcccaagtcgcgcctgtgtcgtttggtccaactcctagcttccgtttcccttttgtagtgcagttgtgagctcgggatctgtccgcagcccaacatgactgtacatctactctataataaagagacctttgttgctgtgatattctgtctccctgtgataccagcactgtttcctgggactggtatcgattaacaggttaatttggagcgtcacgggctagttccggtcgggactagttcggggcgtgacactcatcatgaaccgtgtcgggttcgtcctgactagatccagatcccttgggatccaccaagagaggcttgagctcggcagcgacggcgagggggacgggtgaggcgcgggcagcacgaagtcgagcggtgaggtcggctatgaggaggcagcggtgaggtgctcctgccgctcgtggagctcatggcgggtggcgagaaggcggtcggagaggcctagggatgaggagagcggcgcgagcgccgaagcgagagaggaaaggggagagagatgaagagatgggagatggggagagagaggaggaagaaaaggggtgaaatgacatgtggggcccagggccccgccattttttattaacttgtgtgtgaaactgacatgtgggtcccacagggtttattaattttccgaattgaattaccacgtaagcgccacgtcagtgccacgtcagatcgagaccgagtcaaattagccacgtaggcgccacgtcagtcaaaactgctatcgaaactgccgagggacctaattcgcaccggttttgatagttgagagactcgttgtatctggttttgtgattgaaggatgaaaatcggattcgttgataagttaagggaccttagatgaacttattcctgccaaatatactcaactggaccacgtacaggcctcaagagtcactgccggtgaagcccatgaagttcgttgctgtcaaaccaaaatacagagatattataattaaggattttccaccgaaccatatatcatataaacacaagggttcagatgttgtagactactagcgataaattcttaattaacacatcttataaatagcaattagttaaataccccaaatatcctagttggggtataactgtacaagtaataacactaggtaatatagtaccgctcaatcaaagagttagaaaatagttaacgtaaattagtgggagataattgtatagtaacaaaggatttcaatactattcaattcacttgctcatacaacgtgccctcagtacacatctttatttgtttatttattccaagctagctgaagctagcatgctaaggatcgatacaaatttatcatattactgaaattaaacgtcaacacaagtacttatttgaggaggtctcacaatgatcttatattcttatcaatgcacggtgaccttagtgtatttggtcatatcgatggtggcgcgaccggcagcagcaagggggaagtagaaggggtagatctcgtaacgcgcccagcagctgctatagtcgatctggcaccctggtccgctaccacaggccttatcaaacttggacactgctgccgacaggcattgcgcgcacgacggcggcgataagtctcgtgtgcactgcgccaatgcgtagacactcacgaatggggtgtattgctccttcgccctacctagcccgctgctgcccaccgcaacggcttgcgctgttgcttttcccattgccttccccgctgctttctggaaagccttggggttgtccatgtccggccattgtctcattgtcacgcttgcatcctccctcgtgtccacctccccaagaaagttatagttgtcgtaccgcatgaagcaatactcatacctacatgtacatatatacatcccgcataagtacataaacaactagaaaattaaacaaccaatgtgaaatctataatttatcacccatgtgtactctctggttccattattttgtcgctttggataataacacggtctcaaaaacatatgtttagctatgatttttattatagcatattatctccatcctaaaatataacaacttttacttataaatctaaacaaaacttatcccaacttatagctaaaaatatttatattttaaaacgaagtcagtacacacaaataagtaaaattttaatattattaaagtattttctaagactaatctatgtgttgcgttctagctagcattctcaaattaaactaaatattttgaaaagaatgacggtcaaagtttaaactgttttcaaatgttaagaattatgtaaccgaagagattacataacatgcagaattaggatccacagagtatacatgtgtaccatagcctggagtctgatgtatagttgcagtaggagaccatctgcttggcggcttgggcgaggcaggcgtcgcagtcgccgccggagacgtcgccgcggcactgcgcgaggccgtagaaggcgtcgtaccccctgccggccttggaggtggcgaatccgccgccggtgcgcgccttggcgacaaggtcggagacgacgaagttgatgctccgccgcctgacgacggcatcgctgccgttgagatcgccgtagttcatccccggctcccagcagaagctgccgatgggatacgtcgtcgtcgtcgccgccatggccagtgggagcaatgcagcggccaagaagactgtaagtagcagctggcttaatgccgccatggatggcgccaattgctctcaattcagcctcttgttgctactggagtagcagtagtagtagctagagatttcagtagaggaggatggctttagcttgtgtttgattgggatcgaatggttggagtttatatagagggaggattggatggggaaggaggattgatcgattgatcaatgtgcttgcagagttgcagtatgttaactgcaggcgaacaggtttcaaaatccttgttctaattgtttgcaaacttgtttttgactactactgttctaaaggtttgcatgcagacatgcagtgattagaactgtgggcgcgaagctatattattgcacgtacggatgacactcttgcagatatcgcggactagctaagctagctggctgagctggctgctggctgcctgcttgcttgctagtaccatttcttgtgggctggctgtcactagttttgacttttgagggatgaggtgatggattggataaacctatcatgtctcttcactcttcttcaaccaaacaaaccatgcatatatttaggattaagtggtcaatttacttatattacattgctcaatcaatccaaaactaaacagcccatatatattgagaaacacaacataaatgtaagcactcacaattagttcgcacgctcacccttataaagatacacacgcacatgctctaaaaaactagctattgttgtcgacgggttaatcgtctatactgaaagaataattagctgtaagtgcgagcacccacgtcaaatcgagaatttgaatccagatagcttagttccagcataagaaatctaaccagttgagttatactctcacttcactgaagagcccatatatatatatatatattagtgatgagtgaagatgaaaaagctgaaaaactattcggttgcagcgttgcaggacactgtatagtttgattgagtttgttttcgctgaatctggttggatgaaaagcaaatacactatccaatgattttgccaatttgcaaatactagttgattcttaggcaaaatccactgtatatagtctcctgtttctgcagccaaacagcccaaaacccagtagcccaccgatcgagaatctaattgcccccgcaaaaaaaaaaagagaatctaattgcgaacacgtgcatcgatccaattccaaacctcgtgcgaatttggcgccataccgtttttgtctaacgctaatgatgatttatctcctaaatgatatacatgcatccgtacactcagcttgcacgaatcctgcgcttgcatattgggcctatttcaattgccaatttaggcccagtaaacagaaagtgcatagaatatttctttttcctttctaacttgttttttcaattcaatgtaaaacatctataaaatgtattataatagaagttttttttcttaaagtcctttgcaaagtttgtaagtagaaagtttctttattattcataaattatctaggtgggaagtttactgcttacacaaagtttttgagtgaaacatttactatctatatacataatgtattctgatcaagtagaaagtctgctatttctgtggaaatttccctggtgtttagatgattatataccaaatattccttttgaaaacgaatgcataattaagcgtgatgggttcaatcgcgtgaaatgctagttgttcaagggagtggattctaactctcgacgagacatcccctcgttgtttacatgtcatccaaataattatgaaaaaaataaaacaagatagattaatatgtgataaatcactccacaaacatagttaaaatttaacttttacaagttgcaacgaaaaaacaaattaaactattgctaacttgtactcaaatttgttttttttttcattgcaacttgtagaagttaaatttaacctctcgctgcagccacatggcaaggggcggcgcttcacgactggattgggccttcacggccggatctggttatgcaatgcggtagtggccggatctagccgaggtcgagtaggaggtgtgtcgcggctggcagctgcaggatgtcggcctcgggcactggctaacggcagcaagaggccgatcacgggcgaggtcgcggtcggcacggccaacagcgataggagggaggccgcgggcatggcgtggagcggtgcgtctggccggtggcggcaggagggcggccgcgggcatggcgtggcgcggttgcgattgtggaggttagtgaggacgacggtgagcgcttaccgcccgcaccgacagctagggatgggcattcggtctaaccgaaaatttcggtctcggtcttcggtcttttggtctttgaaaagtgaagactgaatttcagcgaaaaaatgtcaggaccgacaaattcggtctcagtcttttcggtctcggtctcggtcctgaccgaaattcaacaacattttcatatatgaaaagaaataatagaaattttcaccacaaacatctcaaaaaaaaaatcgtaagcacttatgagtaaagactcttattaggtttcatgcctagaagaagtaggcatgtgaaaattagagtttaatcctattaacatagtggattgtaggttgtatttagatattttttttgataattcagtctattcgggtacccgaggagactaaccgaattaactgaacaaaattcggtctttcactgcctaggaccgaattgatgaccgaatttcttggtctcgatctcggtcttttcgggtcggtctttttctgcccacccctaccgacagcgggggctagtagcaatgccgtggcaaatatgtgagcttccggagtcagttcgttcttgctagctagccatttccatctccttctccaggaaacacctccccggctatggtcgactcctttc

SEQ ID NO: 53763 - DNA, 1951 bp, Oryza sativa
aggacaacttggcacgatgtggttaaaagtgcttgcttgcacacttgagagcgggcgcaacatcggtggtggaactgtcctcacagcacattggtggaggccaaggcgaaagcatggacgctacgggcatcgtcgtttactcgttggaggcgtcctttttgtctcctcgtcatgccgtgtttggattttgtgggtgtaaacctagcccaagatgatggtggcgtatagcttgacgtcgtgcctcctgaaggcatattaatccttggcaatttcataatcatgctccactttgttatggacggcctttgagaagtcggagctgctgcgtcgaggtggttgatgagtttggcaacaatataaatcggaagttggagctgctgtgcaggtgcgaatttggcaatgatgacccaagtaggacctcgccctttgagttttcgctctagtgtggggtagcaatgcaagcttgttggtcggcaagcctttcctggccttagcgtttcctagcgaagttggagtcgcctgtgatggtgtgatgacaataacgttgcgtatctgcctttgcgaggagccttgtttaatcttccaacttgctacttcattttgcaaggtttgtggtgaatagcatttgttgaacctggcttttctgtttttcatagccttgtagttaagatttgccattttctgtttggtacaatagttgtggttttcacatagtttttcctaattaacaatgtaatataaagtttggtctcgttttcttcttaaaatgagacaaatacttctttatataaatgtcggcaatggcatgacctttttttctaaaaaaaaaactatttgttcacacgcgcgtacatcatacctcagtacacatctttatttattccaaactagcagcatactaattaagaatcaatacagcttataaatatatagcctacaacacatgatttattattgaaataaaacatcattagaaatacttgttccgggacagatctcaggtacgcataacataactatactgctatgcgttacaacgtgtgtatgcttgcatgtatgcaatatcgtattgtactatacacgcagcctatatatatgcgagatttattcaatgcatcgtgaccttggtgtactttgtcaagtcggtgggggcctgcctgttggcctcgagtggaaaatagaacgggtagatctcgtagcgcacccaacagctactatagtcaatctggcacccctgcccactgccgcaggcctcggcaaacttggaaaccgtcgttgacaggcattgtgcgcacagtggtggtgccagatcccgcgtgcattgtgccaacgcatagacgttcacgaatgatgtgcactgctccttcgctctgcccagcccaccgctacccatcgtgacagcatgcgctaccgctttccccgtcgcctttcctactgccttctggaacgccatggggttgtccatatccggccattgcctcagggtcacacttgcgtctgtcctcgtgtccatctccccaaagaagttgaagtcaacgtaccgcatgaagcagtactcatacctgcaagtacatatgtacattgcccgcacaagcacataaacaaaagaacgttaaacaaccagcatgtaaaatctataatttttgccactcaagtttgctctccggttccttcaattttgatgttttggataataacacggtctaaaaaacatatctttcaactataatttattttattataatatacccaaaatataagtaaacttttaattttatttaagcacttcttaaaaaccgatctatacattatgttctagtgttctcaaactaaatattttaaagatcactaatagttaaagtttaaattgtttgaccttaattttatccaaaacgttgaaaattatagaaccgaagagactatatgacatgtagaattatgacacacgcat

SEQ ID NO: 53764 - DNA, 726 bp, Oryza sativa
attagcgaacaacagatgcattatgtagttggagattgctcttgacatcactctgaaagaagggccaatgggtggaccaaaagattcatgatacttgtgaaagcagaagtccgtagccacatgccatataggacaatctcatcgaatggtttctctaagctccagcctagaagccaggtgcattttgctcactcaagtgcccactgtcccatgttgtcattgaaactcctgtagctctcggcgtttctatgtattttgtccatccatctttcacataattgtgaaccaaatttgtaatatcggtggacatatcgcatagattcatgcaccagtattggtctagcaaacccttgcattgtaagcatcctgcgatgcttatcaaccatgcgtgccttttgtttcgggtgaagaatcctacgaggctttgttgtgccatagtgttaggcaagacatcgagatatttccatactacagccatggaaatgatctctagtaaaagggtgccatacgccattagaaatgtcacaatgacatcattatggctataggcttgtttatggctgtgtggaggagaccaacggctgggatcaccagtagtatagctagcattcatgttgatacccaacaatagcggtttgcgtcaggttgttcgctatcaatcttatttctggtgtatagaatatcaaagatgttggaaagcccactatttattgttttacaaacttg

SEQ ID NO: 53765 - DNA, 925 bp, Oryza sativa
  unsure (1)..(925): unsure at all n locations
cggctcaacggatgcagcaggtggcggtgcgacgggtgctgcaccgcagcaccggtggcgctcgtagtctcggcgtcattgcttagtgggattagtgaacactgaacagtaattagtatttttagttgttgggttgttaagcatggtttactggttgatggtggtcattgtactagtaggccttttggccactagtgctttattgggctaggcatgttatccgggtattatccggatatttaaccgggtaatacccgtatttttaccggataatctgtatccgtcggataccgtcctcccgaacccgatctcatatccgatagaaaatacccgtattcgaacccgctacccggagaaacttccgggtacccgaaatttttacccgaaattgtcccgaaataatacggctgggcgggcgggcgggaaatacccgccccgttttcacccctactcagcagcacaacgtgccgtncacccacaccgnatnnctctcctctcctggtgnccgcaccgtncttcttcgcccccgtngaattgnattccagcgagcgtgcttacgcctgcgccccgtggcctccgcgccgggcgatcccgcttgcagtgccgcaggtgcccttctgccccctggtcgccatcgcatgcctcttctgtttccagtggaactttctctcccgcgtggcttcttctcccgtgcctgcttgcctcttcgagtctgctgaggggacagggatgcgatgcagtgcagatggttgatcgttcgattcaaatccaccggccatgagaaaatgaggtgacgtgacagcatcaggaagcagagaattcctagtagtggggatgatttgtataggtatataggattacataggctaaatgtagagtagaactaaatttttgttgttaattaataggttaaggttaaggtgtc

SEQ ID NO: 53766 - DNA, 757 bp, Oryza sativa
aatatgttgcagccaccaatgctgccacacaaggaatctggttggctcgattgctcggcgaacttcttgggaagcaacctaaagcgatcgagctaaaggtggacagcaagtctgccttggcgctggcaaagaaccctgtcttccatgagcgcagcaagcatattgatttgcgctatcacttcatcagaagctgcttggaggaaggaagcatcagcgccagcttcatcaccaccatggaccagctcgctgacattctaacgaaggcattggggcgagttcgattccatgagcttgttgcaaggattggagtggtcaagattagttcagaatagaagaacaaggattaaggggagattgttagtataatccttgttctagttagttatttggtttccttagacagtaagctataggctgcagctgttactcggttgtcagactgctgctattagtggtagtagtcaattttgattttacctctagcaggaacatagcagcagcagtattgtcggttcagcaaccgacctatccatgtactataaatatagctattgtgctaacataagtaagctttttcagctcattttcagtttcagtttcagctagactattgagtgtagttcagaagtgatcctaccaacaataaccatcagcatattgtgttcaattgtgcttattacagatttatgcattagcaagcttcagaataggtattaccttcttcagaaatctgttcaaaataacacagcatttacga

SEQ ID NO: 53767 - DNA, 1519 bp, Oryza sativa
tttcttgtacgcattttagtgtttgccaatttcttttcgaattttaattaattctattattccttttagaaaataatttttattttgggatgaatttatcaggacgtgacagcacggcaccctccgggcgcctgctgccggcacgcaccgccccgccccctcggggaggagatggggaaggggtaccctcctgcttcctcttcccccgggcgtcggcaaggcggctgccccccgggcccccgtcgcggggcccagaagcacgaccccctcccggggtagattgttcccccctacggttcccgcccgcgccatcgtggcctcgaggagcccgctcccccgacgccccgaccacctgcatgtggtcaggatgttggcgcgctctgaatcgcagcagagggggaggacaccttgggggatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagcggcgcaatccggcgacgaaggtagtcgccgaacaccatggcccctgtgagcccctgggatcgcaggcccgccaagcggtcgaggacggcgtcatagctgtcacgaccggaaataacccaacgggctttcctgacgtgtgtgcattaatccttgtcccaggaggcaaggtacaccataagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccgaaaccttcatcttcaaggaactcctcttctggacttgggaaaaattgagcaagactgagtacaaccaccgtactcaacaagacacacccacaaatgcagaataaatgcaaaggagtacaagggaattataatgtaaagggttagggttgcagtaaacagcatttaaagacatttagttgctcagggctattttgtaaacgcgatcctagaactatacaaagttattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacggaagacgtgacatagtttccaacccattctagccataaacaagagtaccgacccaattcttgctacgggcgaacccccgggacag

SEQ ID NO: 53768 - DNA, 1264 bp, Oryza sativa
cccgggggaaagagagagggaatcgtggggaataattcccccctctttaatgcgcgcggggacggcgggaggcggcgagattcgcgacggcggcggcgctagggcacgggcgagcggcgggcgcggcgcgaggtgggggatgacaggtgggccccacccgtcagcgagggtggcgggcgggcccgcctgttagcggcgcgcgcgcggggaggagccgatgggccgcgggggaaaggagagagagagagggaaggagaggattgggccgagccggcccaagaagggaaggggggaaagaagacttcttttagggtttttttctttttataaaccttttccactttgtttatttcttttcaattattatttgtgctctgaaaattccactaaaatttatttacgcattttaggcttttaggaaatatacaaaaatcctccaagccttatttgacttttagatttgcacattttaattgttggaggctttcacatgaattttaattattctttgcacaatttcgaggatgaattttagggtcgatttgggacgtgacatagccatctcccagatctaccggcgcccgccagctggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcataggtgcgcgaagatggccaatgtcattaccgcgttggggatgaggtgcgccatctggagatcgtaaaactccataacatccatgaagaaagaagaaaatggcggaaccagccctgccatagcaaaagggaggaagaagacggaccaccccgagtagcgtggcgccgggcatctctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgctggaagaagagatgtttgagagcgagcgcgtgtggcgaaggtagggcacaggaaacaaggagttagggcgcaagcggcgaagacaaggggaataatggcgagaggaaggaagcg

SEQ ID NO: 53769 - DNA, 1789 bp, Oryza sativa
ccatcctacgcgctgtccccagcgagatgatctcgctgctcgccaccaaggactccgcgaaggacgcctgggatgccatcaaagtgatgcgcgtcggcgtggaccgcgtgaggaaggcgaaggcgcaacagctgcaccgggagtatgaatccatctcgttccatgatggtgaatcgatcgacgacttcgccctacggctcacaagcctagtgtctcagcttgggacattaggagaacgaatcgaggagcagaacgtcatcgagaagttcttgcgcgtcgtcccagagcgattttcccaaatcgctgtgtcgattgagaccctgttggatctctcgacactcaccatcgaggacgtcactgggcgtctcaaggtggcggaggaacggcgaccagctccaacgtcgacgactactccagccggaggccagcttctcctcacggaggagcagtggctcgcacggcagaaggagcgacaaaaaggggagcgatcctccaagcagtcgcaaggtggagctcgtcagcgacctcgctcccatcgcaaaaaaagaggtttttggtggcggcgtaggaggcgagaaagggaacaccaatcgggacacggcaccaaacagatgccacaattgtggccgtcttggccattgggccaaggactgtcgccagcccaagaaagaagccgctcacctagcccaaggtgatgacgatgacgacgtcctgctgctttcgcgggcatgcgagcttgaagatgacgatgccactttgttgatggcccacgcttgcgagctcaatgatggccccatcatcgcgccatctcctgtctccctcgttgaaccgcgagtgcaggtgagcctaggagccacggacgctgaggacaaggaggcgtggtaccttgacacaggagccaccaaccacatgacgggccgtggtgacgtctttgctgagctcgatcgaagcatcaccggcaccgtcaaatttggagacagctccatcgtagacatcaagggtgccggtaacgtcatcttcaccggcaagaatggcgagcacaaggttctcagtggcgtctactacattccgcgcctcaagagctcaatcatcagcatcggtcagcttgatgaaagcgggacgcgtgtgctggtcgaggacggcatcatgcgtatctgggaccgccgccgccgccgccgtcttcttgccaagatcaagcggggacgaagccgtctatacgtcctccgcctcgaggttgctaggccgatttgcttggctacgcgacacgatgatgttgcctggcgctggcacgagcgcttcgggcacatccacttcggctcgctagagaagatgggccgacaagagctcgtgcgtggcctgcctcgactggagcatgtcgagcagctttgcgacacgtgtgtcatcaccaagcatcggcgcgctgcctttccaaaggcagccaagtaccgcgctcaggagccgctagatctcgtccatggcgacatctgtggccctatcacgccggcaacgccaagtggccggcgttacttcttgctgctggtcgacgatgccacacgatacatgtgggtggcgctcctagcagccaagagcaatgcacctgacgccatcaagaaaattcagatggcagccgagactcactgtgggcgcaagctggtgtatttcgcacggacaacggcggcgagttcacgtcgcttgagttcgccacctactgcactgatgagggtatccaacgtcatttctccgcgccctacgccccacaacaaaatggcgtggtcgagcggcggaatca

SEQ ID NO: 53770 - DNA, 1360 bp, Oryza sativa
  unsure (1)..(1360): unsure at all n locations
gaggcgtctttgctcctcgctggacctggtgagccatgctcgtttgcagaggcggagggtgatgatgcatggcgagcagccatgcgtgaagagatggacgcggtgaatcgcaatgggatttgggagcttgttgatctcccacatggccatcgcccaattggactcaaatgggtctataaattgaagaagaacgaggccggaaaggtggtcaagcacaaagctcgtctcgtcgccaggggatttgtccagcaacctgggattgattttgacgaggtgtttgcgcccgtcgcgcgcatggagtcaattcgtctcctgcttgcggtcgccgcccaaaaagggtggcacgtccatcacatggacgtgaagtctgcctttctcaatggagatttggcagaggaggtgtatgtgaagcagccccctggttttgtcgtcgccggagaagaagacaaggtcctccgcctgcgcaaggctctttatggcctgcggcaggcgccaagagcctggaatgcgaagcttgattgtactctgaaggagctcggtttcgaccaaagcaagcatgagcacgccatgtaccgacgaaacaatggtggctctgctctactcgtcggggtctatgtagatgaccttgtgatcaccgggccatcgacaagagcaattgaacaattcaaggaagaaatgaaggcaaagtttcagatgagtgatcttggcttgctctctttctaccttggaattgaggtgaagcaaggagatgatggaatctccctgaaccaggggcgctatgctcagcgcattgtggagtcggctggcctcaaggactgcaacccttgcgccactccaatggaagaaaggctcaagctgagccgtgatagcacggcacctcccgttgatgcaacaaaatatcgacggctggttggtagccttcgctatcttgtgcacacacggccagacctagcatttgctgttgggttcgtgagtcgcttcatggagcggccaactgaggagcacatggtggccgtgaagcgcattctacgctatgtcgctggcacgatggagtacggacttcattacaaaagggagaaagaggagcagcggctgattggttacagcgacagcgacctcgccggcgacattgatacaaggagaagcacaagtggcatgttgtttttccttggttcaagcttggtgagttggcaatccatcaagcagagagtggtggctttatcttcctgtgaagcagaatatgttgcagccaccaatgctgccacacaaggaatctggttggctcgattgctcggcgaacttnnnnnnnnnnnnnnnnnnnnnnnnnnnnnnnnnnnnnnnnnnnnnnnnnnnnnnnnnn

SEQ ID NO: 53771 - DNA, 811 bp, Oryza sativa
taagccttacccactagacatgtggaagtacggtagtgctttgcaacagaggcccgaagaccggtccttatatggccgaggtgctaccatcaaaaccatgcaccccgaacccagcctaaaaccatttttggggattttgaatggagggggcggtgtgaagccaattccacaatgatccaacaattccacagtgtccaggtgatatgaatatttcccaaagtctatagttgtaaaccacctaatgttacctaattaaattgcgaagcatctatctaaatttaaactagggatactacgagtagagtgtccactagttgaggttttgtttaatctagggtgaacaaggtaataataataacaattacaataataatatggtcacaacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaccgacggcttcgacttccacgaagagcggatcttccgaagctgcagcgtctacacgaccaacggaaaagaaaaggcttttactctaataaattccacataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcgggtttattgcg

SEQ ID NO: 53772 - DNA, 944 bp, Oryza sativa
tccttccccttctccatctccttctccttccccttccccttcccagcttggccgccaccgccaccccctcccttgacctccctcttctccaccacggcggccaccgccgccggcttcttggcggcctcctcgactcgctccggctgcggctccatctccagctgcagcttcgtctcgggctccgggggaggcgtgggcgggggcggggcgagcgccggcgcggcgtggagcttggtgcggcggatgagcgagctgaggtagcggctgcgctgctcgagctcctcggacgccggatccatggcgggcgtgggcgtcggagtcgtcttctgctgctcttccttccagggtgcggggacgcgcgcggggcgtcgtgctcacctgaggcggcggcggcggcgagcgttggtcaccatcgctgcctgcgccgctgcgcggtggtggggggaatggaaatggaagtggccaaatgagaggtcgtggtcaaagcacaggagaagtagtagcgccggttcacgagacgaggcggtgtggggtccgtttcccctggccttttcccgatggtgattggtgacccggcgaatgtggtgagcgagaccggtttgaaactttgaactcctaacgaacgtggtgattcgttgaggccttgaggggattgtcgcagaaatagttacattttgtaactgagagtactccctctatttttcaatagataatattgttgacttttaaataaatatttaatcatttatcttatttaaaaattttgtgtaaatatataagatataattcgaacttaaagtattttaagtgataaaacaactcacaacaaaataaattataattacataattttttagataaaatgaatggtctaacatagaaaaaaagtcaatagtatcatctattagtatgtcattgtgacctgtggagttgtttgggtaccg

SEQ ID NO: 53773 - DNA, 1087 bp, Oryza sativa
acgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccctagtccagctgccaccctgagtcccgcaaggagtccctcgtactctgccatattattggtcgcccgaaagtcaaggcgaaccaaatatctgaggacgtctccgttcggcgaggtcaacgtgacccccgcaccggcgccctgaagagacagggagccgtcgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcgctaggggccacatccctggggcgctctttgtccaagtggcctcgcggagtgcactcgtcttctgtgccgacgacctcggggtcggaggatgataggggcggccttcccacagtggcctcggggccgtcctgggggtcgggggctcctggcgtcgtcggacaagcagggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcggggtcaccaggcaccgtctgacaagcgggcagagggcct

SEQ ID NO: 53774 - DNA, 907 bp, Oryza sativa
agcacctaggcgctgccgtgccgtcatgaccaagttggccacgtcgtctagccaacgttgggctggagtctctggatcggggacgacgggcgggtgacgtaggagcgcgcccgcagcttggagcgcgccctggggcgtgctgccatcgccgtagacgaggaggcgacgctccccatctcgccgcccttccccatcacccgtggatgtcgaagtcgcggatccttcgaccctctcgagcgcctcctcccgcctaggactttggcgtgaaggggacggtggagtacgagctcgacggcgtgggttcggctgcccgtcgtcaccgctaactctcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcgcaggcccccctttgccggttcggccgggggccctgggtgagattctaagctcctagtctgtgtgtggaaggttcgcgagaatggaaaaagcacaagacacgggcgatgtatacaggttcgggccgctgaaaagcgtaataccctactcctgtgttttggtggatctatgtatgaagaagctacaaaagagctggagaaccagagagctcttactctctccctctctgatcgttctgtatccgaaaaaatcaatcccccttctaagtgggcaaggtcctccttttatacctcaaggggataccacatgcaccatctctcttttttttttgtggggacttatcctctcttttcataaacagacggagacttgtatggttgtcgtccgaatgaccttctgatgggacggcccatacctacct

SEQ ID NO: 53775 - DNA, 757 bp, Oryza sativa
ttgagtccaattgggcgatggccatgtgggagatcaacaagctcccaaatcccattgcgattcaccgcgtccatctcttcacgcatggctgctcgccatgcatcatcaccctccgcctctgcaaacgagcatggctcaccaggtccagcgaggagcaaagacgcctcctcgagttcccgttttgcaatccctggtgccggggcattctccccgatcaagttgtcaactgtgcggtagcggacaggggtgttggagtgcgccgcgtcgatcctctcctcgtcgtgtgagggaggtgacacgaactctgttggggcaacgctaggacttggtgctggtgtggcaggggttgctggtgaagtctcttgtagtggcgttggggatgctgatggggtcaccacgcctccccccacactagggataggatgcccagtggtcttctcaacatggtactcgatggcgaaatcgctgctcggtcgagcatctatgccgcttgctgccgtccagtcccacccacggctctcgtcaaagatgacatcacgggcgagacgtacacgccgtgtccttggatccaggacacgatatgccttcaccccttcttcatagccaatgaagacgccgggtgtgctgcggtcgtcgagcttgcgcacatcgtttagctccttcacgtacgccaggcacccgaaggtacgtaggaagctgaccatcggcttcttgccgtgccaagcttcatacggcgtcttgccagtgaggcttttgg

SEQ ID NO: 53776 - DNA, 1165 bp, Oryza sativa
  unsure (1)..(1165): unsure at all n locations
nnnnnnnnnnnnnnnnnnnnnnnnnnnnnnnnnnnnnnnnnnnnnnnnnnnnnnnnnnnnnnnnntgagacaaaatgtggatacccacgatactatcatggtaatgtacaacaccaccagaagagtcaagtgaaatgcagcacaagtagcatgaagtatttcctgcatgcaacaaaggctaacatggtaacaacccataaggccgcatctagcagtattttaccaacggcagttaacacaatcttcatgccaaggccagagtgcacagagttgacactccccccagtcaaaccagcagtgctatacaatgtaactgtggtagaaatgtttattaaaggcgcagtatgctgtgcaaaatatttactccctccgtcccaaaaaaagacaaaccctgagtttccatgtccaacgtttgaccgtccgtcttatttgaaaaaattagaaaaaaaattaaaaagacaagtcacgcataaaatattaatcatgttttattatctaacaacaatgaaaatatgaattataaaaaaaattcatataagatagatagtcaaagttggacacagaaatctaaagtttgcctttttttttttttcgagacggagagagtaatgcagaagcagcagaacgacatgtttactgggacgatgggacgatcgccagaacgacgcgtttcctgggacagaggaagtactacaaacctcagcaaaagtctcacccacaggcccaggaatcttcctttggtcaaacgtagccatcccaccaacagccgagggccccaccccttcaagctgccaggtcatcatcgcccccggtggtggcccccgcacgtcagccactccagtaccccaccccgaccccgacccctcacccgccgcgtgacgttaccgcccacaccccaaacccgaccgttacctcaccgggttcaaaacggcccactcgccgcccgccacgtgtccgacccgcaccccgcccggtcggtccccacgtgggtgagctgaccgcgcccccgagcttgcctttgcgtgcgccgcgcggtgacgagacgacgcgagtagtgcgaggtggagaagacgagccgacaccaccaccaccaccaccaccacgagaggaggaagccgcgggtctcctcgtcttctcctctctctctctcctcaaccagctgtct

SEQ ID NO: 53777 - DNA, 2555 bp, Oryza sativa
  unsure (1)..(2555): unsure at all n locations
nnnnnnnnnnnnnnnnnnnnnnnnnnnnnnnnnnnnnnnnnnnnnnnnnnnnnnnnnnnnnnnnnatatagtttttacaaaatattttgaccaaatgtagctttgctttccattaattaaaaaaaattggaagcgcttaaggcagcaatgtcacactacattcttggtttatgtggtacccacacacacaatgtactatgaatcaactatagtaggctcctgttggaacatgttgtcttggctgctgatttgctaagaaaggcttcttagttcttatactactgttgtgcaactttgaaacatcatggatattgaagcatgtcaactagggaagaaaaaggaaactggaagaggtcagtgttaggattaagttttcctagctcattgagttgttaaattattttgaaggtaggactgaaagaataaaaccatatcagcaagcaataaatgagagatgtgctctcctgatgcgctaaagaacattatgatctgttaggcagatcccctgcaagaaatttgtcttagttagttgcgagatttcagaagtacgatatcttctgggatgcaggttgatatacaagctgttattgatgttaagacttaatttgcagtcaaattatgtacctaatgaattattccaatatatttcctttctgtgaagatggttaaaggggtttgaagcatgacttggatgccaaggacacctcaaatattcaattttcgaattttggatgccatatcggttagttttccatctcaaaagagtatcaacagatttttgaagaaggtgatacatattccaaagtttgctaatgcataaatctgttataaaacaaaagcaatatgctgatggttatcgcatatccttgtgagttgtgatacaggagaaatgagctatcactttttctatgagttggccagctctccttggatacattatattttcccctcttcctaccaatcaacaaggaagacattttgtacaacgtacaatgctttaaagaactgaagggtatacattagcttaccatgcattttgaactgttgtatgcacaaaacagtcagagcacgggacatacatactaactaggtccagtagatgtattttgttgtcatttaaagttttaaactgctgtagcaattcatcaggtgatcaggttcttcataatatgcaacctgattcttacataatgttattacttacctaataggaggtcaatggacggctgtttgtatgaagtataagcgtatgactgtatggaattgcagttttccaaagatcaagagtctggtatagtgatatgtaacctccaaaaacttcttaaattccatgtcgatccattctataccttttgcactttgagctatctgagatgttctctcctgaagtgctaaagaacgttctgatctgttagggaagatcccctgcaaggaacttgactaatctgtcacaagatttcagaaatacattgtcttctggatgcaggttgatatataagctgttattgatgttaagacttaatttgctgtcaaatcatataacaaactattccaatttatttcctttctgtgaatctggtcaaagggtttcgaagcatgacttgcatacgaaggatacctcaaatattcaatttttaaatttttgggatccttttggtttgccactgtttgccatcttgagagtatcgacctggtaagctgcttatttatatgcatatgctcattgtgtttgtgtgatgatatggaaattgatgtgctgattaaagccttcttgtgcattctttgggcattcatttcttatttgcttgtgatgaatctgtaggagacattcaactggacaatttgaagagcatatccatcaaataaaggtgcttcctggtaattgataaatttaacagtagcaccattgttagttgtgcacttatcaaaaagctcaaacttatttgcaagttggtcttaggacgcttattacttttgacaaaggggtatcacatttgctataagggctctcccaatgcatagtgtctagattattttgtattagaacagagaactaaaacttcaacttaagaggaattttacttcttgatttcactattggtgccacattagtagcagagagaactaaaagtccattgtttgaatagtaatgtaagttatttaggtgcataattttaagaggagcttgacttgttttcttttggtgccacattgtactgttgcatgggggtcgattaagatactgatgcaactcgaggtgttcatcacaacaggaagatgcaatataaaagcctgcttagatataccagctaatattgaacttgccgcacctttggttgggatttgtatttgatgccaaataaggggatcaggtgctgagatttctggttctcattgaccagccacagaaacagaaaaggtaaaaagaactcccccttttggtcatgtacatttgaatttcttgcagtgagttcaaccctagtgcctagttggaagaagctgatccttcttattttgatttacagcacatttccttttcttctgtaagaaattat

SEQ ID NO: 53778 - DNA, 8509 bp, Oryza sativa
ccttccggcttatctcgctctcaaaacaggaggcttcagcgtcttcgggccatgggtaaaaaagaaaaggagaccaaagatgtggagaacaaaacatgtaacaatttagatcctcgaacgacatctaggcaagtgtggagacccaaagaggtaaaagttaagagaccggtgatttcccatagtagagataaatccaatttgatgagagaagaatcatcggtcattagagataagtctccttcgcatgatgctatggatgttggtgcggtgttcatcttgccttcgaaatcgtgcagtcgagaaagccgattttgcttgaggggcaagacattaatatgctcatgaagaaatcaagagaagatgaacggcgatggatacaacatcacatctttgagccgccgttcgtcggatgctaaggcaaggtatgggtttattgtgtttaccattatatgcctatgccatgttaaaacattgcttgtgtcagggttacgggttaggtataccccttacccttcgatatgcaccacatatcgacatggcatacccgcgcatacacgggcattatctgcatatactaaggaaatcttccacagtgtttaagtcctactcggacaagacagggtcgtcaatatatcgtgtagggtccgatgtctccgagttcgacttggagaccacttgatttgcgatataaaagggatcccctgggaggacctaaaggatggaatctgatagccaacacaacccccacagcctacgaagtcggagcctgcaggagccaaatcgccggggatctagtcgaatcaacttaattacgatctcgccgcttcatcgagttccattgttccctttgtaacatgtggttttccatcatataatcccatatcaactggattaggactattacctatcaaggggcctgaaccagtataatttttgtcttttattgcttgatgtcgtactacgtagatccttgtaccaacgtaccccaataccctctatatccggtctacgggtatcacccgtcgacagtggcgcgccaggtaggggggcttggagctcaaggttttactactatgtcatccagcttcgtcgacaacagcgtcaacaccaacctcaaccacgggtttcctgcttcaacaacgttggtgtggactcaagtcggcgaaatcgtcttcccggtgtacaccacgatgccgatctcagccggtccatcaatgaccggaaacgagaacgcagtggctgcaacccaaggcgactccatgtcgaaggaccctcccgccgaagcagggaatggaacatcgacaacacccgagcttgagaaggattctaatgcggccgaaccttgtctttccgacaagaaccacgagccgacgagaacagcttccgaagcgacaaggtcctggtgtcctatccacaaaaccaggaaacatactttgcaagcctgctgggtcttcctcaatgcccacgccgaaattcgcgcctgtagagagcgtggaattcagcgcgtttctccaactcgtgatgtctattgtcctattcacaagacaaagaatcacgacctctcaagctgcaaggtttttctcagcgccataaagatgtcatctcctaaggtccagccatcaagcgtatcccttagagaggaagacaagagacagggaacgacgctgacctcagatcgattcgttggtgcgattgacatcgactcccacgaaccatcagttctacatctactcaaggactatggctcgtcatcaacgagtacaccatgcgaggtattggctatcgatgggaccagcacgtcagcacgcgctaatgccgaggcggagaatcaagtagttacaccggctcagcgcatcagtacccttaacacaatactgagggaggcaccttacgatcccgttctgaacgacgatcttgcgtggtggcaggaacggctacgagaatcagtaaccaacctcagccacacgttcgaaggggctgctgctgatgcacacccggaacagccaccaactggcggcgtcgatggcgaaaaccccgaacagcgggagtcaccctaccgagcaaccccttcaccccgcggcactggcgacctccgcgatcacctgaacggccgacgagaagcacgtcgcacacagggcaacgggagccgctctcgacatcacatcccttcacggcatcacgataatgaagaacgaggaggccgctcgaacgaagaccgagaccgtgatgatcgcgacaatcgtgagcggcgggcgccgggcaataccagtcgaggacgccgccataatggcgaagacgacagagatcggccccgggacaacgacggagggcgacgatgggattctcgagaacccggccgatgtcctcgtaatcctacaccagaaccaagcgattcttcgtcatcgtcatcctcttcttcatcctcatcgtcagatagacatccacgaaggacacacgatcgccgacaacccactgcccccagcgctgggtgtagagctttcggtcgttccctgcgtgatgtccgatggcctgagagattccgacccggaacaatagagaagtacgatgggagtactaacccagaagaatttcttcaagtctactccatagtactttacgctgccggagcagatgacaacgcattggcaaattatttgccgactgcgttaaaaggctctgcacgttcatggctgatgcatctaccgccctactcgatttcttcatgggcagacctgtggcagcaattcgtcgccaacttccaaggaacttacaagcgccatgcgatcgaagacgacctacatgcgttgacacagaactcgggtgaatccttgagggaatatgttcggcgcttcaacgagtgcagaaatacaatccccaagatcaccgacgcttctgtaatttgcgccttcaagtctggcgtcagagatcactatactacccaggagttagcgacaagacgcatcacaactactcggagattattcgagattgttgagcgatgcgcccacgtggacgatgcgctgaggcgcaagaacgataagccgaagaccgggggcgagaagaaaacagccacggacgcacctgagttaagcaagaagaaaaaccgcaagagtgcgaaaaggaaggctcaagcggaagttctcgcagcagaatacgctaacccatccaagcgcccagacccacagggtagcgacgcaaggaaagcatggtgccccatacacaagacggacagacattctttagaagattgcctcgtttttaaaaagtcgctcgagaagcacatggcattggaaaaaggcaagcgagtacgcgtggtcgagaaggacgcggaggcagctgctcaggaattggactcagcatatccagactctgacctccacgtttcacacatcttcggaggctccacatcgtactcttcatagcgagaatacaagaaagtggaacgtgaagtctgttcgacatggcagggggctgcacctaatatgaagtggtctgaacagaagatagaattttcggaagaagagcatcccaagactgccgttatcccaggacgctatccgatcgtggtcgagcccactattcggaacatcaaggtcgcgcgggttctcattgacggtggcagctcaatcaaccttctcttcgccagcactttggatgcgatgggggtcccacgaagcgagttgacgcctaccaatcaacccttccatggaattactccccagtcctcgtccaaaccattgggcaaaattacgttgcctgtgactttcggccaagcaaacaacttccgaaaggagcagatcacctttgatgtcgctgaattcgatacagcgtataacgccatcatcgggagaactgcacttgcgaagttcatggccgcatctcactacgcgtatcaagtgctcaagatgccgggaccgaagggaataatcaccattcaagggaacgcaaagctggcggtacaatgcgacaagcggagcctcgatatggtcgagcaaacgcccaacccacccgccacaactgagcctcccaagaaagtgagcaagacaaataagacgccgaaaccagacggcgccatcaagatcgttccactctccagtgccaaccccgacaagaccgtcaagatcggggcatcactaagcgaggaataggaaatcgcgctcatcaccttcctccgcgacaatgctgacgtgttcgcttggcagctgtccgacatgccgggggtccccagggaggtgattgagcacaaactcatggtgcgacccgatgccaagccagtaaagcaaaaactgcggagatttgcaccagaccgaaaacaagccatacgagaagagctcgacaaacttctcaaagctggctttatcagagaagttcttcatccagagtggctagccaatccagtcatggtgcggaaggccaacgggaaatggaggatgtgcgtcgatttcatcgacctcaacaaggcgtgtcccaaggatcacttccctcttcctcgaatagatcaactggtggactcgacagccggctgtgaactgttgagctttctcgacgcttactccggctatcaccaaattagcatggtgaaagagaacgaagagaagacagcattcatcacgccgttcggggtattttgctacgttaagatgcctttcggactgataacagcagggaatactttccagcgcacggtccagggcgcacttagtgaccagctcggcaacaatgtcgaggcatacgtcgacgacattgttgtcaagaccaagacaagcgactcattgattgacgatctgcgggagacattcgacaacctacgacgatatcgcctcatgcttaatccagagaagtgcacgttcggagtaccgtcgggcaaactgctcggtttcctcgtctctggcagaggaatagaagcaaatcccgagaagatcaaagcaatcgagaacatgaagtcgccacaagactcaaagaagtacaaaagctaaccggatgcatggcagcactaagcaggttcgtcgctaggatgggagaacgaggacaacccttcttcgctctgctgaagaagaaagacaaatttgtatggacacaggaagccgaagaggcattcgttgcactcaagcgctacctaacaaacccccctgtacttgttgctccccaacctaatgaagaattatttctttatattgtcaccacgccatattccgttagcaccgtcattgttgtcgagagagagaaaatacaacgaccagtctactacgtcagcgaagctctccatgacgcaaagacaagatatccgcagattcaaaagctgctctatgcagtaatcatgacatcaagaaagctacaccactactttcaagcccacagagtcacagttgtctcctccttccctctcggtgaagtcgtgagaaacaaagacgttgtcggccgcattgcgaaatgggtagtcgagctaagctagtttgatgtccactttgtgccacgaacaaccatcaagtcccagatactcgccgacttcgtagctgattggactatgcccgacaacaaatcagacaaccaaatcgacaacgaaacgtggacaatggcgttcgatggtgcactcaacagccaaggagcaggggcaggattcatcttgacatctccttctggagatcaattcaagcacgcaatccacctcaacttcagggcaaccaacaacacggccgagtaagaaggactactcgccaggataagagccgcaaccgcatttggggtcaaacgactgatcgtgaaaggggactccgaactagtcgcgaaccaggtacacaaagattataaatgctccaaccccgagttatccaagtatctcgcagaagttaggaagcaggagaaaaggttcgatgggatcaaggtccgacacgtataccgcaaagaaaacgtcgagccagacgagctagcacgacgcacgtccagacgagaaccactcgaacccggcacttttctggacatcctggcaaagccatcggtaaaagaggtcagcggcgaagttaacccagacacccccgacatcagctcggaggccacagaggcagaacgcgccgttgccgatatcaaaaccacagacgactggcgcaccccactgatcaaattcatcaacagcgacgagttgctcgaggacgatgcagaggccaagaaaataacccgtaaagcaaaaatctatggcacgatcggcaatgatctatacaagaaagcgccaaacggggtacttctcaaatgagttccgtccgacgacggcagacacctcctccacgatatacacgaaggcatctgtgggtcacacgccgtcggtcggacgttggtcgggaaagcttttcgacaaggattcttttggccaacctccctcaaagatgcatgcgacatggtccagcggtgcgaagcctgtcaatttcacagtaagcacacaaagctacccgcgcaagcgctccagactatccctctcacttggccgttctggtgctaggggctagatatactcgggcctttcccatgaggacagggcggctataggttcctattcgtggcgatagacaaattcacaaaatggatcgaggcgatgcccacgggagaaatcaaggccgacaacgccatcaaatttatcaaagggatattttgcagatacggactaccacatcgcatcatcactgacaacggctcccagttcatcagcgccgatttccaagattattacatcaggctgggagtcaagatatgcttcgcttcagtctctcatcctcaaagcaacgggcaagtcgagagggcaaatggcatagtgctacaagggatcaagacccgtgtctacgacaggctcatgtcacacgacaagaaatgggtcgaagaactcccatcagtactatgggccgtacgcaccacaccgacaacgtctaacaaggaaacacccttcttcctcatgtacggctctgaggccatgctccccagtgagctacgacatcaaagtacatgagtacagaagtactccgacgaggatcaggaggaacagcgaaacgacgatgtgaatctactcgaggaacatcgcgaacgagttgccgtccgagcagccggttaccaacaggccctccaccgttatcacgagaagcgcatccgagcacgcatactttcgacgggttcaaagccaagcagggcgaaacaagctctcacccaaatgggaaggaccttacatgatcacgcaagtcttgcggccaggcgcattcaagatagcagatggcgacggccgcgagttggcaaattcttggaacattgaccaactacgtaaattctacgtataggtcaatatcatccatacctgtaagacaccttacagtatcaataaagcctatgttcgggcacatattacaattacagtgttcatgcctgatgatcccttacccagatgatacctagcgttgaaacctatccttatgtccctttacaccgtcctgacaaggcctccgaggaacctaagggatcctcggctggggacgcccagagccgataaggtcttgtcggatcctgtagagacgaaagaccatgtaagacctggtcgtgtaagagttctcgccgtgcgtattaaccaagccgtgtaatcggaaaattaactttccaacttcacggctgggggctaggatcagtgctttctcaaccaaggcaggtcaaaggtctaagagccttgtcccccgagaagtatcctccgacgacaaggctgggggctagggagagtgtacgactcaaacgactgaccaaagtcgtgaactgaggaaacactcttacacactatatccagagtaagaaagattcaccaagatagatttcttccctacttcgcaaaatacttcttacaattatatacaaatccagaactttattacattctttccctaagatatctgtcacagggtacgaatactaccaagaaggccaacgccagtccatagactggaaaaccttctccgctaacggtgccatcgacttcgccaggtggtctatctccgcaggagtcctctgagaatgagtgaatccttcatggagaaactcgaggtgcagttgcggacgatgatctcgtacacaagccaatacatgccctcctgcatatcggctcgatcggcggcattcctgtttcagagcctcgtcaatccgcttgccaacgccctcaagctgagtacaagccccattcaaccacgggatatatccggctgctgactcctcgggatccccgcgaggtactcggagctctctgcaaacttgggccatggacgtgcagcaactcttcaggtatgagttgaaccacacctcacgacctcaaagtgtttccacggcctgctccttctttacttccaacatggctctctcgagttccaccacttcaaatttcgtcttccaatattggatacgacgatctcggtcagcaagtgcgttctcgaggtctgttcgacatggaaacgactacgttaggctgctcttctctctcgagaacacggttgatcaa

SEQ ID NO: 53779 - DNA, 779 bp, Oryza sativa
aatctgaccggcgagaagccgcggatcgcctacgggaagccgaggaggccgcccaggtggccgtccgagctcgccaagctgaagaagccgctcgggaggaggccagacttcgccaggccgaggcggcgacgacttccgaggcagctcgcgacgaggccgcgggcgcatcgcttgggcccactccctcgggcgacgctcaggacaagccaggtccgggggacatccctgagtccggcacgtccatcggcgggccgagccgcgcggcatcctcaccgaggcggctcttccccacgccttccgttgctccactgagcgcagagccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgtctcaaagctcgaagcccgtcggaaggtgctgggggagatcgccaaggaggtggaggaggagcggggggctgccctcatcgccaccaccgtgatgaacgaggcgcaggacaccctccgccttcaatacgggagctgggaggcggagctagggaagaagctcgacgccgcccggggggtccttgacgctgccgctacccgagaacggcgggcggcggagaccgaggtggcatcccggcggcgcgaagaagcccttgaggcccgtgccatggcgctggaagag

SEQ ID NO: 53780 - DNA, 898 bp, Oryza sativa
  unsure (1)..(898): unsure at all n locations
nnnnnnnnnnnnnnnnnnnnnnnnnnnnnnnnnnnnnnnnnnnnnnnnnnnnnnnnnnnacaaaaaaaatgtgaaacccgctcaattagttgaaatcttaagcataaagttttttttttcattaacaacaaacagcataacatttttttttcctgtcctaagaggaggtttcaagaaacagctgtctaactgttgtccttttttttttccttctctaacatgagatgcatgtatctattttgacaaaatccaacaatgtcagcaaggatataataatacgtcttcaacatatacatataaatgcataaactacattcctgctttcttctatcagtgaaatggcagagctccaacccattccctagaaaaaaataaactatattcctgatttgttcagatgaggagagacagacttgcaaatgctttattcatgctgcgatgggtcatggaacatgatatactgatgaaatactactgtgcaaataagaaaaatcatacactgttcatgactcgcatattggtagtcattccctcctcaatctttccaatctgggaaatataaggttatcagtatttgttgtaacatctaaggcagtgagcaagacctagtcaagcggttcaattttagctctgataagaaataagtagatcaatcatatgattgcaagcaactttccagtcccattatctccatttccgtccgctccaccaactccagcaacaagaatggacgaaggaaaatcagatgcctttatgattgtatcaatagtctcttgcaaatcagtcatcgcaccaccctggacaacaaagggaaaaacattgacaacatggaaacatgggttcagcgttatacatactgtgactattaacagaacgaagtatttctgctgattcatgg

SEQ ID NO: 53781 - DNA, 6405 bp, Oryza sativa
tataatttcaagaagcattttaaaagcacaaaacactaagtacataatttcttacagaagaaaaggaaatgttctgtaaaccaaaataagatgggtgagaaaaggaagatttccacgtttgcttcccagatgtggtacttagaaattcttctacagaagatgtcatggtgattaaggtagcaaagagtaggatacctcaggttgatagatgctgccattcaggttgaaacagtggaaataggaaacaggacatcaataggtctagctccaaagcccccataaggggaatcgcttagcagggtcatagcattgtagtgcatctctgtttccagtactgcctgccaaccaacaaaaaaacagtggaagtacttaaatcaatgttgtcatatgaccatcagaacacaagaactaagagattgttacaaaccatttggccgaccagtgggttcgatgtaatgcaaggaatctggaagccatgggatttccatttgaagctacagagcacaaaacatccaagatttcaaggcaacgacttcaagacagtatgcgtttatcaactagagagctgacgatgaaatagtgggagggccagcaagaactagcacacctgtgaagtctatggctaccatgaaattcaattgacacccccctaatgagagagcacaagttagcattagattttgtccttaagaaaaaaagatagaaactcgccaccgctgcgcgcgcacacctaacctgcgccaaaaagcatgcgggtgctgtggatgccgcgcccgcgcggcgcggcggtggagctgagcgccgccgcatggctcgccgccccccgccgcgaggagcagcaggctcaattagccggctagccaacggcggccgcggcgcgaggcagggtgagccggtgaggccgcggcgcgaggcagcccgtggcagtggagcggagtggccgccggtgatcgccggcggcgtaccacccggccgccggcgagggttttgtggatggggtgcggcggtggctttggtcggtgggtttgccttgcctttgcctcgcctcggggagacttggaatgggagggagtgggccccactctctccctctctctctccaagagagtagtagtagtagtaggacaaaacaaatataatatttaaaaaaaaacacagagagagacgtacatcaccacccttggccttggccggcatctttcgcaacaccaactccgcctcgcctaaaacccttcctcaatctcttcttctccggcgccggcgacggcgttgcaacttcaacgatgggaagaagaagaagatcatcaagctagtttttctagatcatttccacggccctatccacagtttcgtcaccactctctctccaatccagtgcttgaacacagcaaaagctcctgctcgctatatctatctactccgattcaaaccccccaaaccccttccgatcgatcccttgctggtaggggtgaaatcgggtcgggttcggtcggatctcatccttcccatatcctaacccacattttataatcggaatcgggtcgggcacggatattatcggatacgaatagaagcacggataatatcgggcataaatacggaacgaatacgtaccaagacggatacgaactctatcggttacgaatatttattcaaatatcaagtcaaagcaacaaccaaatataccacatagacaatagccattcagccatttcctatatgtctattatgaatatattaggggcttatggcatcataatgcctatcagcaaaactgtaccaaagtagtagcaaaagtagacattcattgcttgatagcttcagactcaatgctgtactgatctgaactgtgaagtgaaggctagggtttgtgcttggcactttgtttggtgggccttttggatgtgggctggctgttgcctgttgtgttggcctgttgggcgcttgcctgttgggctgttgtccatctatccgagtaatatacggatagattatcgggtaatacccgcataatttcccggataatccgtatccgtcggataccgctctcccgaacccgatctcatatccgcaaaaaattacccgtattcgaaccctgtatccgtgtaagggtccgggtacccaaattcccgacccgaatttgacccgaaataatgtggccgggcgggcggtcgggaaatacccgccccgttttcagtcctacttgctggtacgcaaaaatgcctccaacgaagaaggacaagggaaaggaaaagattaaggaggtagaatgataatttttttaaaaaaagcttcatgatctttattttttttctgtttcttcgcgcggtagcttgatgtgtgtttggtttgtgcatttgaaattttgcgtgtttcttcaacagcccaagccatcggatgatttctacttggatctgggtgatcttcctaagagctatgccaatctaatgaaagatattcctcgtcgcttggaagaaattatcaaagctgaggcgccctccaccagtaaggggaagaagctcttcaagaaaatctcggggaagctatatactgcccagagtggcacatttttggttcatctcacgcctgataaggatactgcagattctggaagagtgtctctgctattccgctggaaagacttgtatttcgagggattttactccaagggtacgtattacggtatatctaatctactcgctttatcatgcattatattactaacttattaagaacactagccatactgcctcttgcttgctggatgtgccaattgttgttggttgatttggtatgtatagtgctaacacatggagaatcggagacgcacgattgcaatggcccttgtccaggagtgttcatgcatatgcaccgcttttgtctggaattgtttcgaattgggaggttaaatcgttgcaaagttggagtactacaagtatttgaggcctggaatagttttgagtttccaaattaagggttgtagttctatgaggcatgattaatgctgtagagacttgcattagcattctgacatgaaggatgcaattaatcatgtgacagtactatatatatactcttgcttgcatgcatgcatgcatatgtcaattgtggttggttgcatgcatatgactctcactgctgggctacttactagcacactgacacactggtgtggaggagcattgcattgcaccacacccccttttgtcaatttggagttaatttgtttaatttgggaggttaattaaattgttgtacattaatgtgtacaatattgtgttaattgccctatctgttgctttcgcagggatttggttcaggctacaggattttcaggcagaactccctcctcagtctcagttgccatatgctgccaagggtgggaaaggagtggtgattctctcaatcgaatctaactatgcagggataggaggaaataccatatacatgggctctgatgcattcgacaaatgtctgaaagcaatgctgagagcacctgacctggaaggtcataggctctactcggttctaaaatcaaacagagttctagctgtccctgttgtaggaatatctgaacctttaaggttccctcaattccaggaatgggttctctcaaccctctcaccacctcctaccgatgctgaccactcctcgtcgtctgatgatccttctcctggaactgatgctgctgaatcgtactctgctggaatgggtacgggcagggacaagaaggttcctgagaaattctccttctacttcacaaaatggggcacgctttctgaaggattgttgaacaatagtgttccagaagaatttagcacgatgtccattgatgagatggctgcacttcttggcattctccgatggatggaggggatgtcattacctgcaccaaggagtggaactcatgatagtgaggcctccagttccagaccaagcagggctaccaagggtaagcataataccagtaaatagatgatagctaggcacaagatgtcaatctggaaagagtttgaagctggttgcggacaactaaggttgatgtttcgatcaggcacaaacgtgcttttgtgattgagtgagaacatatgcatcacacgtactaagttttcaactcaaaatacatgcaaataagttgtaaaaaatattgttcgaacatggtaatttgcgtgtgttttttattctttttatgatgcattttgagacaaaattttaaatgactgtgcatatcatcattgcaatctcagattattttttcttacaacaaaagagaatggcggacgcgacagggggctgcatgacccacgttaatccgtcttatatattactctctccgttttaaattataaatcgtttttaattcgattagaatcaaactattataagtttaattaaatttatacataaatataataatatttacaacaccaaattaattttattaaatctgtaattaaatatattttcataatatatttattttgggttaaaaatgttattatttttttcaataaatttaattaaatttaaaataatttaactttaacaaagacaaaatgattatagtccaaaacgagggagtactagttaattatctgagtaattaagcctactaatccactgcgcgctgttcacgtacgtaagccatgaccaccagtccgagtcttgcaagcaggcactaggcctcacccatatacgacaagacgttagttagacagtttggtgaatttaactaaactaaatcatttctttgattacttacagtaataatggtaatttaatcaaccaataaaagccctgatataaagccctcatgaattttagtccccatggtataatggcgaaacatgcccaaaccatctactctagtcgatagtattgtgttactagtttatttcataagcacacctatatttaatcatgcatgtgtgttcagtgttcgccacttaaaaggatgaccatttaagcgcatgtttatacattaatataaacacttcctgatccttttcaagtaacgataattaacctttgtcgtaagtagcattttttttactactattagtttctataaatccatatagtgtaacattataagatttatatttctaaaattcactagaagaaatttttttataatgtataattaaacaacattgacctgatcgatttgccctattaatctttagttatttgagtggttttacgtgtaatttcaaggttgttttgaaaacacccgatccactttgaaatctaacaaaagcgatatagatacctatacaactcaccatatatatatatatatatatatatatatatatatatatatatatatatatatatatatcttaaactttaacatgcaaaacatgtaatatgacatcttaataaagcacatacgcattacatcatcatccacgtttaatttccttctagtagctagcttaatttcacatctagtactacgaccttccatttcaaatatacgtaatattggattagcatacgtacgtaaatattaggggtggttggatgacctactagctagtagttctaaaagctaagcgaataaatatgttttcttgaatttaacacaattttattataattgactggcataagagagaaaatatagaaactgatttgatttgatttgaatgtctaaaacaactttatatttgtataagacttagcaaatctatgaaatcttgatgaggggatcggagactaaagtacatgcaagtcacttgagtacgggcaagtgcaatgtaagaataacaattaattaaggaggaaattgataatattgccactcgatttgttgggcttttcaccctctgcgtaaggaggatttgagccctttttttcactgattagtcacatatgcatgaaaggaccaattaccaatgactaccgttattagttgcgttaaactggtgtcagttcaaaaaaccggcacctataggagctttggaaccggcatcaataaaaatttttctactagtgatgcctgttcgatcatccacctgctgccattagcaccagctaccgactaggagaagcggctaagtgctaccgtcttgaagcaccctgcccttcaagctcctcaatattccccccactcccttctaactgagctccacttattgtcagaagaacacaaggagaagaagcaggactattgtcgatcaccccaagttcccctcccctaaggatgttgagatgcgccaccaccgtcaagagaaacaccaaacctcacaggcaggggtggatctaggatttgcttggagggtggactcatcctcttcttctcctttcagcccccctactattattcccccttccctctcatcttctttccgtggggatccaacggggttgaggggactcaagccctccagtattcac

SEQ ID NO: 53782 - DNA, 2482 bp, Oryza sativa
tgccggccaccagttccctcatcttcgtgaggtcttcatgagcttccgccaactcgcgcaccaaccggtcagcacgcgcgttcgccaacgccgcttctgaccttgcctctgcaacctcgtggccaatgctgcgggcaccagcttctaggaggcgccccatttcgacttggagctcctcccaggcgaggatagcagtgggcggaccacgacctgccgcgggatcgctgactgggccactaggcgtcacctcccggctcccagctgcgagtacgacatccgtcgaggccgcggtaggcgaggcgctggaagcccctcctgacttgctctgcgcggcctttgcccacgcttccctatgggacgaccacggatcatacaacgcttgaacagaatcatgggaacttaaaaacccaactacttacttctcgccgatcgtcacaagacgttgtcgtcgcggaggcgggggagatgcgtccaaagcctgaaagacaaccaacgcgaagtaaggcaaaatccctctggctgcgcgatctggcgataggataacttaccgagggggtcggcgctttgcgacgatgtccgcttacagaggagaacttcctcccctttgtcggagcattgccaccactagtagtggccgcagcagcatcagacgcctccttgacaaccttctcttttagagacgccgccacctgatggtccgcgagcggcccgatgatgtcagtcagaggaagagcctacgcttaatcaagtcataagatgatctcaagaggaaaggcgggatgtccatcgagtatacttacgttaatagcggcatcacgctccgtcgcccccttttcacaaaggggcacggggacgtcactcgccgttgtcggtccactgatcattaactgcccgacttggcgctccacggccctactgctcaaacctgtgaatcgaggaccaagtttcgataaatcaagaggaatgcgaacgtgagtatgtcaagataaatacgagaaagataccccgaggagaaacctgggtcgcgtcctcaggcctggaatagttaaaggctagatgggcccgagcctggagcagctggatccgcctaccaacgaagtccgcaacgacttcatacccggacaaggccccgcactcggagatcgttgatgaagtcgataaacgactgaagaaaggggtcaaaggaggcttggcggtccaagacgaaatcttgcccggttgttctgtgggaacgatgaagacagggttcgaatctttgacctcaagataaaaccatctattccgccatttgttgcgagaagaagggcactagaacgggatataacgcgacttcaggccatctcgaagtcggaacccaacggagccagataccctgttggactccatccaacgcagttcgtagtagaagcgaaaaagatcaagaaaagactctaccccaatgtaagcctcgcaaagatgagcaaagatgctaagaaaggcaatagaattggggttcaaatgaagaagagaaagaccatagaagttcaaaatcaggaggagaaattcggaaggcggagggagaaaaccgcagagaacatagtcttcgatcgcaaccatgcgacctaagacgggctggggattagtacctcctgcttccctctccatggctccacgaccaggaagggcgccgtcttcctgaagctccttcagcgatgcgctggtggaagatgacttgccgaggtccatcgctgatcgaagatcgccggtgaaaggacctaagttgctgaactagggtttttgcgggagtggagaagacgagaggcgcttgggggctggagaatttttccactacaggcggacttcaaatgaatccccaaaactcccttaaatagacgcacttccgacggtgcgaattccaaggaaagaagagagatggccgccggaaatttctgggtccgttacgcgcggcggtttttcagactttagtttaaactcactcgtgaccgttgggcttcacacggtgttctcgatcatgtcctgtctctacggttcccacaccgagaacgacatcagcctcgacatcagaagtcgttattggtcgcacgggttcatttaagcagaagttgggggctactgtcagggttacgggttaggtgtaccccttagcctttgatatgcgccacatatcgacatggcatacccgcgcatacatggacattatctgcatatactaaggaaatcttccacagtgtttaagtcctactcggacaagacagggtcgtcaatatatcgtgtagggtccgatgtctccgagttcgacttggagaccacctgatttgcgatataaaagggaccccctgggaggacctaaaggatggaatctgatagccaacacaacccccacagcctacgaagtcggagcctgcaggagccaaatcgccggggatctagtcgaatcaacttgattacgatctcgccggcttcatcgagtttcattggtccc

SEQ ID NO: 53783 - DNA, 1321 bp, Oryza sativa
  unsure (1)..(1321): unsure at all n locations
nnnnnnnnnnnnnnnnnnnnnnnnnnnnnnnnnnnnnnnnnnnnnnnnnnnnnnnnnnnnnnnnnnnnnnnnnnccgtcgacagcttgatatttagcacatgtgtgttttgcttatcaaatccatattatacatacatgttgcaaatgccagttctaagtggtggaattggtaggttggcatataatatgtttgaagtatgatttggctcatcagtctttaatatttatttaaagccaaatcgtatgtgtttttatgggtcaccatataagatatagatttattgcaccatgaaagttttgcttattagtaattcggctaatatcaatggtcaatgtgatgatttgttttagagttattttatttaggaacattggcattgttaatattttgcatacacgctcaagccaattacttacatttgtagtttattggaatctatgcatgtgacacatatgactttggtgattcattattgattatacttcaattggctaagtgttttgatgccatgatgattattgttttaaaagccatttgaattagtattcatctagacatgttagttggatgttatagtttttcatatgtctatagagaagaaaatttggtccaatagtttgatacaccaagcatctggctattatgtgaagaaaaattatatactaaaggccgatgcttgatttcaaaggtttggacgaaattggcaaagtcatagaccaggggcggtctgaccagcattgcacggccggtctgaccggtggtaccggtggtctgaccggctctggatggccagtctgaccgggcagacagggtggtctgaccgacattgcgtggccggtctgaccgatcccagacagaaggctgggggcacattacagttgattaaaaggccgaattaattgtgaattcggacatttgtgcccatgagttagaaatagcttggagaattcctttgattagatatttgaaagatcctacacttaaggttgattggaagattcggcggcaagcattcaaatattatatcgccgaaaaatagatggagtattgttgaagtacttagataatgatcaatctaaagttgctaggagaatagtacatgaagggatttgtggaattcatcaatcggcccgtaagataaattggttgcttaggagagtggggtttcattggccgaaaataattgatgattgtttcaaatactatagagggagtgaagcttgttaacggatcagcaatgttcaattagcgcctaccgctgtgttgaatcctatcattaaactatggctgttccgaggttgggctttggatttcattgg

SEQ ID NO: 53784 - DNA, 4254 bp, Oryza sativa
taaaaggccgaattaattgtgaattcggacatttgtgcccatgagttagaaatagcttggagaattcctttgattagatatttgaaagatcctacacttaaggttgattgcatgcctgcaggtcggcggcaagcattcccttatatcgccgaaaaatagatggagtattgttgaagtacttagataatgatcaatctaaagttgctaggagaatagtacatgaagggatttgtggaattcatcaatcggcccgtaagataaattggttgcttaggagagtggggtttcattggccgaaaataattgatgattgtttcaaatactatagagggagtgaagcttgttaacggatcagcaatgttcaattagcgcctaccgctgtgttgaatcctatcattaaactatggctgttccgaggttgggctttggatttcattggtcaaatttatccttcgtcatcaaaggggcatcggttcatgctagatgtaatggattacttcactaagtaggccgaagccgtgccgctcgagaatattacttacacggaggtaattgactttatttttgaagcatattgttcatagattcggtattccttaaactttgatcgaggagcttcttttatgtctaagaaggtgagaagttttgccgaaattttatgatattaagttgttgagttcttctctctactacgctcaggctgatggataagccgagtcgagtaataaaacattgttgaaattgccattttgccagttgaggtaaatcttggctttcttcggtattttaagaaagacgacttatcgattgaagattacaagaccttgatgggaagcaattttgaagacgtcatcgacaagcgtttgaagactttgaaggagatgaagacacttcaagacggtgttttcaaagagcaattaatgggaaatacttaaagaaatacttcccgagcatttggtaagatgcttaggaagtcctatggccggtaattggattatcgccctaagacaatatgttctatgcttttagattcacgatattcatcaaaaaggcaggggggcatgtgtttacaccaaaatttggcacctatggacgaaatagaggaaaattgccaaagtttggagagtgccgagtttccttcacatggccggtcagaccgtaggtatatgggcggtctgaccggctagtagggccgatctgaccgcaggtatgtgggcggtcagaccagcagattccgagtccgagtctgttttcgtcgggtctcgggtttccttgctcgggaaggcatgttttgtgtttcctttggtttctatcccgagtttgacgtagagaagggcctgtagagggcaagaccaacccctatttaaaggacaaggccggttcattgttaaacccccgaatacaatctacttgaatcgttcttttactatgttttctattttaccctagttttaatccatctttgtcggtttgcgccgtaaaccgtccgccaccactgcgagagtgcgacacctctttgtaggtttgtcctgaaaaccttccgttttgcccacgagacgggtagttatcctcatatcgatctaaatcggcctagagcctgattttgatctctaaatcagctccgctagccggtttagcttttctttttgcaaaacccatcttgatttggccctttggttagatcgaggtggttggcgactccatatcaccgcaaggcgtctaggtgttgcgatcgtgcttgtcgacttgtcacaaaaagttgccaacacctgggtccaagtttaactgattaattataaataatctttctaataatgagtattgtagtctctgtagatctacgtgagtacgtgcataccccctcgtcccaaaaaagacaaaccttgggtttccgtgtccaagtttgaccatccgttttatttgaaaaaaatatgaaaaaaattaaaaagataagtcacgcataaagtattaatcatgttttatcatctaataataataaaaatactaattataaaaaaaatttatataaaacgaacagtcaaaagttatacatgaaaactatggtttgtttttttaaggacgaagggagtatcatgcatggcagaacagattacgttatatgggctaagtacgtgtggcgcatgcacttaccattactccattctactcgtgtcccgatcgatcgagctggcaagtggcaaccacacgcaagcaatacgtacgtacggtacggacgtgtcgacgtgaccagagtgtcacggcaccacatgcttagtactgtttaaaacgttttgattttgatcaaagtttcaattttaaagtttaactaagtttataggtaaatatagttacattaataaaactaaattagtttcatcaaatcagtaattgaatatgacggagcgtggggctcctcaccgggagaccgcgcaggcccccctttgccggttcggccgggggccctgggtgagattctaagctcctagtctgtgtgtggaaggttcgcgagaatggaaaaagcacaagacacgggcgatgtatacaggttcgggccgctgaaaagcgtaataccctgctcctgtgttttggtggatctatgtatgaagaagctacaaaagagctggagaaccagagagctcttactctctccctctctgatcgttctgtatccgaaaaaatcaatcccccttctaagtgggcaaggtcctccttttatacctcaaggggataccacatgcaccatctctcttttttttttgtggggacttatcctctcttttcataaacagacggagacttgtatggttgtcgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctctggctagggacgagtgcttggaggctctcatcctgatgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccctgctatgctcacctaccccgtatacgcggcgcaaaacccacaaggggtcggggcgcctcggccctcgaggccgagacgggagcggtccgacccctcggggagacaaagagaagggcggccgtatcaccctcgggcccgacccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggtaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccagcgtcatggcacggggctccgctccgcttgacggtagcgtgctgccgccttcccgcatcgtgagcgagagacaggccgggctgccgcgccgcttcatgccggaatctgccaccggccgggagatagtctcgctgggcgagagatgcccggcgccacgctactcggggtggtccgtcttcttcctcccttttgctatggcagggctggttccgccattttcttctttcttcatggatgttatggagttttacgatctccagatggcgcacctcatccccaacgcgg

SEQ ID NO: 53785 - DNA, 1378 bp, Oryza sativa
tttgggacggagaaggtacataccaataaagtggaaataaagtgggtatatatcaacctgcatccaaacgctcatacttcatacaaacagcccttcattggcagggcatcctattaggtaaataataacatcgtataagaatcaggttgcatattttgaagaacctgatgaattgctacaagcctacagcagttttaaacttcaaatgactacaaaatacatctactggatctagttggtatgtatgttgtgctctgactgtttcgtgcccacaatagcacaaaatggtacgctaatgtatacccttaagttctttaaggatcattgtacaaatttcttccgtgttgattgatatgaagagaaaaaaaggaatgtatccaaggagagctggccaactccggcccggctaaaaaaaaaaaaagagctggccaactcataggagaagtgagagctcatttctcctgtatcacaactcagtctcaagcgtatgtaataactgttagtataatccttgttctagttagttatttggtttccttagacagtaagctataggctgcagctgttactcggttgtcagactgctgctattagtggtagtagtcaatttttattttacctctagcaggaacatagcagcagcagtattgtcggttcagcaaccgacctatccatgtactataaatatagctattgtgctaacataagtaagctttttcagctcattttcagtttcagtttcagctagactattgagtgtagttcagaagtgatcctaccaacaattggtatcagagctcaggttaaagaagtgtgagagagatggagggagtaccagctgctggagccaatgcttccaggtcgccacaacaccgcggccgccatcactcgttatcgccaacaccacggcgaggacgaggtcgaggcgctgctgttcgagaggttgttgtgcagcggactgtcagggaggttggcggcgctgctgctttccccaccctcacgcgaaccaactacaccgagtggtcgctgctgatgaaggtgatgctgcaagcccgtggcctttgggacgcggtggagcatggtgaatgcgatgagcaagaagacaggatggcaatggaggccatcctacgcgctgtccccagcgagatgatctcgctgctcgccaccaaggactccgcgaaggacgcctgggatgccatcaaagtgatgcgcgtcggcgtggaccgcgtgaggaaggcgaaggcgcaacagctgcaccgggagtatgaatccatctcgttccatgatggtgaatcgatcgacgacttcgccctacggctcacagcctagtgtctcagcttgggacattaggagaacgaatcgaggagcagaacgtcat

SEQ ID NO: 53786 - DNA, 3271 bp, Oryza sativa
  unsure (1)..(3271): unsure at all n locations
nnnnnnnnnnnnnnnnnnnnnnnnnnnnnnnnnnnnnnnnnnnnaccatgctatatcatgtttgatttttctcacggatcactccaactgcagcagctggacaagcaaaagtagtccatgggccagataattatgcttggcttgaggccttaaacgtaccggtgaatattaatatgcgccctggcatgtatactggcccaactatacaggtatagcctaaatttctgcattttgttgatagtcttctgtagcaaccaaaacatgcttgagagttgagactgtttttctgatggaatatttgtctttttgctaggaacatctgccataatcaataaaaatgggcaggacagagcgtcaaactgtgtccaagtgccatctcacaaatacagttcttatcatgtagtgatgtaaatgtaacatgttcatctttaacttttgatttatgttgtccttcattgaaaaggtgtggctataatggtgacatagtcaaaacagtttgtactagccactttgtatcttagttaccaatctgcaaattctgcattctaaattgcttctggagatattgtaaatgtatttatgttaatgcctacatttttctttctatttctatgccttcagagaggctggttgccatggtgtcaatatggtctggaattcaaatattcaacaacccttgttaagatggtagttgagattcaatcaaaatttttagattattgtgctccattttgtacctgttctttccgtatttttattgggattacaaagcaaactcaatgcagttcaagaaagagttaaagtgtgaaactgacaagctggcagctcaaaaagtactggcccaatatgtatgggctgaacatgaactacaacactgttctggcccaatatatatgggccgcatgtgagtcacattactcttccgtcgttcaagcccattaatttgggctcagcacgcaggacctggccttcttgggcttcttgcgggaagttcaaatttttgcaccacattggcgcgggcgccactatacatgaaagctacgtgaattgggacgtccacgcacgatccgacggccatcattacatggcgtcttcagccgatggcaagctatgctcaggcaggtctgaccgtctgagatatagggcgtgtttagttcacgttaaaattagaagtttggttaaaattgaaacgatgtgacagaaaagttgaaagtttgtgtgtgtagaaaaattttgatgtgataaaaaagttggaagtttaaagaaaaagtttggaactaaactcggccataacatactactcactggatggagcactagaatagcatctagtagctcattttcactttcaggaacatgaatcctctgatcctctatatctaaagtagtgtgaaaaaactagagtttttcaccatctcagtgcgccacatcatcaattaaatacagaccatccgatggaagaaagattcatttgaaccgttggatctggagtgtgtcacggtcaagcaaagaagcacaggcttcaggaagcttcgcccatcttcctggcactcccgtacttgccatatgtgatcagtgatcggttggttaagcagacaaataggctacttaggccgagtttagttccaaactttttcttcaaacttttaacttttttatcacatcagaacttttctacacacataaacttccaacttttccatcacatcgttccaatttcaaccaaacttctaaatttcgagtgaactaaacacacccttacatgatgtatgttaatatgcatatgtaacagtgtagcaagtcttcttttaagcatttttattaagtacttcctctgtcgtatattaagattatttttagctcatcccatttatctcaaaataaattgatttttagtaataattatatcaaagtttataatagtaaagaataattgcattggaagtagataaagtgataaatagttatattaggatgagataaagtagggtattttagtcttttgatgtttgtattggtatgtgtaggatgagtgaacaatgaactttttttggaacatctgtattactaatatgcatttgtactaatttttttaccaggtatgcatatatacaaattactccctttattttaaaatgtattgagatatatataaatataattaccttttcaaacaatcttttcaatactatactttaactactactgttttctttcgtttattatcaatacctacaaaatcaacgccatataaaaatagtcaaataaaaatctaacaatactactttattatataatgatataaaaatcaaataaaaagtcataacattaatcaaatatccaatcataccaggtatgcatatgtacaaattactccctttattttaaaatgtattgagatatatataaatataattaccttttcaaacaatcttttcaatattatactttaactactactattttctttcgtttattatcaatacctacaaaatcgacgccatataaaaatagtcaaataaaaatctaacaatactactttattatataatgatataaaaatcaaataaaaagtcataacattaatcacatatccaatcctgtacttttaatccattcattagacaagattttatgttttgatttttctcaaaataaaaatgccttatatattttaaaatagacggagaaacaagttagtatttctttatcatacaataatactctattgtcataaatatataacgtttgttttttcttgagcaaactttcgaaatttttcccatcaaggagatctcaacggcagggcactgttggcctgacctatatatacacatcttttaaacgggtcttaagagcctcgcaacgcgtggcttatgtggctagtttatatgaagccatgaagcccccatttccattaccagaaatgagaagttctacagttcttaaacctccaaaacaagagccaagaacagctacagttcaaactgccagcacctgaagaccctacaaactaaaacgagctactaacctccactgcatgtgtggagcaaaccagggccaaataacaggagctagcaactcaagccatcatcaacaaaacccaccacccaactgacaacagcaagcacgcagaaaaaacacactcaggttctggagacgctgagccacgaaaatataaagtctaggaaataaagtggaatagtttattataaacttgcaggtaggtctgaggaaataaagtggaatagtttattactaccatatgact

SEQ ID NO: 53787 - DNA, 3267 bp, Oryza sativa
taattaattatgagatcaagtggtcaagatatatgcaagggctcacatagtacatcatggaaatcaagttaagcctctccctttttcttcagaaaaatctcatgaagatcagtctaagggcttctgtgacgattccacccatctggtaaaccacacagatcaagctgattgtattttcaccaacagatgccacaataaccccaatgctgatgacaggcatgatagcaagcattttacagctcgacaggcatgatagcaagcattttacagctcatttcttcaaggccaagggcagctccgaggagaaacacagctactacaatgctcaaacaaagagtacattaacatcatattctaaattaatagaaacctataacttgatcaaaaaccagagagctcacatacttatttccttcaacatctgtgcaaatgcaacagatatgtaaaggtacgcactgctccctagcagtgtgtcattgaaaacattgctccaattgcaatgaccgactaacaatctgcaagtccaggtgtactggttgaattagatagaaatattgtagagcacctaaacatgtgctgctgggtagctacaaccaaatattgaaaatcaaacctttccaaaagagtacaagccaaatattgctgtgtgtggagattatgggtaccccatacccacacggcatggttatccgactagttataggggataacttgtatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcatacatgagacaactagatcgtcagatctataatacacccggcggattcaaatccccaaacaggagtagggtattacctctcattgagagggcctgaacctgtctaaatcctttgtctccacatccatccacttttaggtctcgtgcgctaccccgttttattattgccgaaatcatgtttcgacagttggcgcgccaggtaggggatgcgtcgaattacccgtcgaaaagtgagatggaatccacttcagaagaaacggcgagatcaatctcaccgaattcaatggctcgaactttggaccgggtttgtcggtccaatctattttttattagattaattttttttctatcatagatcaatcttctggtatattttcctgtgtcgatcttgtgtcggtcggcggagatcaagccgaagctgtcgacgacgccctcacgcatcgagactttcttcgtgctttgccggcggacatgtggtggccatcgctgggcacagtttaccaggagaaaacactgcatgagttgattcaactgatcaacatacatgcacgatccaaccaacatgcacattacatctacagagttaatctgtttactagttgattctaaccagcaattattttgttgctatctgtcttgcatgtacaccgccggccgtatctactgccggctatatccgtcagcgccgaccggctccaccgtctccgtagtcggtcgcctccgagctgttatcattaggctttacagctgccccggtcggtcatctacatgctgccgactctccgaggtcgcagggccgttgatggcttccgccggctactgctgatcgaggcattgcgacccaagctgatcgacgcgcacgacgtatccaagccacgccgtacaacttgggttggctgttccaatttaatttttattagattgattattaattaatccctaatcgccggccgttttgatttcctggcaatttttgttgtttttcacatgctggttgagatcacgacacggccgccatcgtcgcctactcggccactcgggtgcctcttgccgtgtccgagtgctcctctcttcccttccatgcagatggacgtgctgctagattggcacaggacacaggaatatactcggccaccaggagcaagcacgtgtatacgtcgatttaatctacatgtatgctggagcgatggttgttcgcatgcattggatggcagtcgagatcaaacaatcattcactgcttgcggcctcgctgccacggttggtgtgtgccgccgccgttgccgatagcgacatcgtcttcaccactggcttgcctccgtcgccgccgattggtgcctccgcctacacggctggtctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgtcttcgcctatatggttggttggtcacaccaccgttgttgggcgtctacatcttcaccgaccggccgtctcgtccgccgccgactggtgtttccgcctgcacggctggcctattatgccgccgctgttgggcgtctacgacttcaccgccggcctgcctccgtcgccgccgactggtgtcttcgcctatatggttggttggtcacaccaccgttgttgggcgtctacgtcttcaccgaccggccgtctcgtccgccgccgactggtgtttacgcctgcacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtgtacgacttcaccgccggcctgccttcgtcggcgccgagtggtgtcttcgcctatatggttggctggtcacaccaccgttgttgggcgtctacatcttcaccgaccgtccgtctcgtccgccggcgactggtgtttccgcctgcacggctggcctattatgccgccgctgttgggcgtatacgactataccgacggcctgcctacgttgacgacgactggtgtcttcgcctatatggttggatggtcacaccaccggtgttgggcgtatacgtcttcaccgaccggccgtct

SEQ ID NO: 53788 - DNA, 3191 bp, Oryza sativa
acacggctggcctattatgccgccgctgttgggcgtctacgactttaccgccggcctggcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcatcttccgtcgccgactgattatgccgccgccgactggtgcttttatcttcacaactgcgcgtcttcactaccggatttctacttggacatcttcaacacatatcttcaatcaagcaatgattactcgacgacaagaagctataattctcgactctatgttcagttgtttcccaactaaccaaagagtcgggggctacacaaatacaagactctcaaaattcgacaagatgaagcaatcaattaatcagccaacgagtcaattccaggagtcattatcttcgtctttgctttagagcagagttatcaaccaatcagctcagtttcgacgagttggacaacatcatctactttcctccaagtgaagcatctgcaacagctataacaccaatttgatggattattgtcactgacatcatcaccagcacctctgcttcatcgaccctgacatctctgctgttgctaatggatgattatgttttcgccgacttattatttcaccttgacggttgacctactatgcaaatgctgatgagcgtctttgtcattatcattggttgctacactgctattggctggatcaccgacatcgtcatcttcatcatgtcggttgcgtttgtcgtcgtcaactattttcttcatcttcatgattggtggatttcgccatcactgttgatgcgcgtctacgtcttcatcgtcggtttgcttttgtcatcaccgactgtttcttcgcctccatggttatgcaacttcattacctttgattggtgtcactgttttttactaccactgacatcttccgttacttctgatgagcaatttcgtcttcatgttggtcatttcatctccatgccgactgcgtcagctattgccaatagacaattttgactatgacagaaggacaaactatatgctcaggggctcatcaactcaagcgtgaggattatatctccaattgggacttgttccggatacattccacatggattcatagtcatgagtctatcttctatgctcaaagactggaccaattattattccccgtaaaggctatcaactgaatacttgcgccagtcgggattcaattattatatttattttggagtatcccataagggatagtcattcagatcagaagctattcatatgagctacacttggtctatattacccagaagatttgttactcgggagcatgtcacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgctttttgccacgtaagtgtgcatttttattgaccaatattatggcttaggctgattatatattgtggtcattttctaggcggttggtaaatcctttatgagtttatttattcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgtaatttggaggattcacaccgcatatgctatatattgatattaagtcgcttggttgactataattatcaaaaccactcggttggttggattatctattccttgactatatgtttggtttgttcgattaaccacatagtcgggggttacacctattaggtgcatctagtcgatacacctgactatatttttcagccctccacagtcttcagatttggtaaaagtactcgggagatcatggcgaagatgattgaagcactcgactttggagtaatctagttcgagagaaggttatctttccgactgtgaaggtctcaggggctactgtggagattatgggtaccccatacccacacggcatggtt

SEQ ID NO: 53789 - DNA, 1731 bp, Oryza sativa
ttgtgttaactccactgttcgacagtcttctgtcaatgtaaagccttcattatctaccaactatgtaaaactatctcccaatcttaatgtaattagccagcctactttggccggcccgactaaaaaaagaaagaagagtagaagcaagcctactcattacactattcagaattaagaaacatccatccaatcgagatccagggactaccacatttcaaatgacttctattatgttctataatcgcatgcctcttgacattaccatatgcatattcagttgctgccccagtcagaatctttttaaaaaatgtgaaacccgctcaattacttgaaatcttaagcataaagtttttttttcattaacaacaaacaggataacatttttttccctgtcctaagaggaggtttcaaggaacagctgtctaactgttgtccatttttttccttctctaacatgagatatatgtatctattttgacaaaaatccaacaatgtcagcaaggatataataatacgtcttcaacatatacatataaatgcataaactatattcctgctttcttatgtcaatgaaatggcagagctcctacccattccctcaaaaaaaataaactatattcctgatttgttcatatgaggagagacagacttgcaaatgctttattcatgcttcgatgggtcatggaacatgatatactgatgaaaaactactgtgcaaataagaaaatcttatatggttcatgactcgtatgtaggtagtcattccctcctcaatctatccaatctgggaaatataaggttatcggtatttgttgtaacatctaaggcagtgggcaagacctagccaaacagttcaattttagctctgataagaaataagtagatcaatcatatacttgcaagaaactttccagtcccattatctccatttctgtccacttcaccaactccagcaacaagaatggtcgaaggaaaatcagatgcctttatgattgcatcaatagtctcttgcaaatcagtcaccgcaccaccctagacaacaaaaggaaaaacattgacatcacggaagaaaaaatgattattttaggaaaacatgggtttagcgttatacatactgtgactattaacagaacgaagtacttctgctgattcctggcaagtgattggtgtgctattgcagtagtagtgctaattactggacaaaatagtgttggccagccaatgatacattaatacattatgaagtgcactgatataaactgacataatcccttgtgttccctcgacctaaggaagtttgatatagtcaggcactcggccaataggcaaacagctagcatataacttcaagaagcatttcaaaagcacaaaacactaagtacataatttcttacagaagaaaaggaaatgtgctgtaaatcaaaataagaaggatcagcttcttccaactaggcactagggttgaactcactgcaagaaattcaaatgtacatgaccaaaagggggagttctttttaccttttctgtttctgtggctggtcaatgagaaccagaaatctcaggggtacctgatccccttatttggcatcaaatacaaatcccaaccaaaggtgcggcaagttcaatattagctggtatatctaagcaggcttttatattgcatcttcctgttgtgatgaacacctcgagttgcatcagtatcttaatcgacccccatgcaacagtacaatg

SEQ ID NO: 53790 - DNA, 1298 bp, Oryza sativa
  unsure (1)..(1298): unsure at all n locations
nnnnnnnnnnnnnnnnnnnnnnnnnnnnnnnnnnnnnnccgtctgttaatgttataaataagtcatacccaataatcttgggttagtctctgcgggacccaccatatacccagttctatacggaatcatacattatatacggaagatattttggataaggaaggggaagtaaagttctactcgggcactataaggactactcggatcatattcatactttgtctctctagttctatttggacaagggggcacctgagggtataaatacatgaccccctagaaggagatgagagatggcaagccagaagatagatctagaacaaatctacacaagccaatacagatttagagaatccaagacaagccaacatatatacaccaaaacaagcctagacaaatccaatctgaagctacaaaggcaaacatgagggatctagagctacctccaatctcaccgagttcacattcgaagaaaaagactacactagctgttggctgcatgtaaaggtgcaaagccgctatgctaacaaagattggattaagtcatccaattattgcactaatgaaatattgatatataaaggtaactctggatttggctaatatgagtagggctattacttgtcagttaagggggcccaacctatatataaattcttgcctattgtctcttttaccctaatatcgcgtacaccctgataccgacgaacaccataccctacaaataccgtagtcacgatatagcctatcgacatcgtcaaaattgttacttccttcatcttaaaatataaacttttagttatctaaacaactatatatctaaatttataactaaaagttgcttataatattataggacggcagtaatactaccaacaaaagcacccatgcgctagtctatgactagggatcatcggttggcctaataagccaaagccaaatttaaattttttatcttaattttgaagctaattttaagatatttttaattttttatattggtatttaaattttatatataaattaatttttattttttaataaaccgttttgatttattagaaaatgtggacaaccggccgtagaaccccgtggtatgtcgcttcgtccagaactatccagacctcccatatgcatgatcatggagctagttaaacgcatacacagaatacaaaaagaagcgacacacactacgtacataattaaattggatttacgaatccaccaggggccgcaaaacggaaggttcgaagctaggcagcgcgcctaactatttatgggtaccgagctcgaattcg

SEQ ID NO: 53791 - DNA, 843 bp, Oryza sativa
ccctcgaaatacaagtctttccagcggaatagcagagacactcttccagaatctgcagtatccttatcaggcgtgagatgaaccaaaaatgtgccactctgggcagtatatagcttccccgagattttcttgaagagcttcttccccttactggtggagggcgcctcagctttgataatttcttccaagcgacgaggaatatctttcattagattggcatagctcttaggaagatcacccagatccaagtagaaatcatccgatggcttgggctgttgaagaaacacgcaaaatttcaaatgcacaaaccaaacacacatcaagctaccgcgcgaagaaacagaaaaaaaataaagatcatgaagctttttttaaaaaaattatcattctacctccttaatcttttcctttcccttgtccttcttcgttggaggcatttttgcgtaccagcaagtaggactgaaaacggggcgggtatttcccgaccgcccgcccggccacattatttcgggtcaaattcgggtcgggaatttgggtacccggacccttacacggatacagggttcgaatacgggtaattttttgcggatatgagatcgggttcgggagagcggtatccgacggatacggattatccgggaaattatgcgggtattacccgataatctatccgtatattactcggatagatggacaacagcccaacaggcaagcgcccaacaggccaacacaacaggcaacagccagcccacatccaaaaggcccaccaaacaaagtgccaagcacaaaccctagccttcacttcacagttcagatcagtacagcattgagtctgaagctatc

SEQ ID NO: 53792 - DNA, 1397 bp, Oryza sativa
  unsure (1)..(1397): unsure at all n locations
nnnnnnnnnnnnnnnnnnnnnnnnnnnnnnnnnnnntaatagatgcttgaaaagaatttaaagtgtcttgcaatacgaaacagtgggaataaataagttggaccgggcatgaatcggcttaatattatcatcaattctctggtgtaaactctcaatcctcttccctcaaggtaccaaacaagccataggcagactttacagcctccacgacacctcgacggcggcacgtggtacaccgtctccaccctcgatctccggccaccggtgcacgctaccggcggcgagctcgtcagctgggaattcgacctccacctctacaaatccacctcccattccaacgggtggatcaccaagcggttatgtctaaaggagttcgtcagagacaaggctatccctctacccaaatccgtcgacaggctgtaccacgagaccggcaagagaccatcgccgtcggcggcgaggccggcaccgtcgcgtttatgatctctctggcgcggcgtcttcctcgtcgacgagctccccgtgctctgggacatcccgctgacggcgccggcgaaggggaattggaataacttcctctaccaattcgatcctactccctccgtttcatactataagactttctagtattgtccacattcatataaatgctaatgaatatgggcaatgctagaaagtcttataatatgaaacggaggaagtagctatttccgcgacgtcaccgtgtctcgaaacagacaagtatgttgagatggaaatctggtcacgaacagagccaatgaataataatcctaccccagtttcttacgtggattgggtgcgcgatctcaataaaccgaagaaattcaaagaaatcgatcgtggatggaaggctacaacatatagcatgccaatgccggtgaattgttcttcttcgtgctgctgtgatgatgattggcagattgactgtgaaatcgatgataattaaacacatcagcttaagcgacagctgtcgttctaatctgagctgcagcgacgacgacgaaaacagagagacaattgaaacaatattcaaaaaacttccaattggaaaccccaccataattaagcatggatgaagatgtgattttcttgctttctataactagccccatgaaaacggataggttggaagttgtgtttgctgttgatgtgaggaagggcatgcttcaaggattagcaaagcttgatgttcgaccgaagaacttggctatcatggtcaccttatgcaccagcgagatttgcaggtatctagcctgatgaatattattacaggtaacttaattctctacgctggtaattaactttattgtgtgtttttatgcgtgatcaatatgtgtcattatgaatgccatgcttgccaataaagatctagggaa

SEQ ID NO: 53793 - DNA, 2173 bp, Oryza sativa
  unsure (1)..(2173): unsure at all n locations
nnnnnnnnnnnnnnnnnnnnnnnnnnnnnnnnnnnnnnnnnnnnnnnnnnnnnnnnntttaacaataaaataagtcataaaaaaattagtgtactttttttaataagacaaattatcaaattttgttgtcaaagtcaactgcgttatgaccagaggaagtaccggaatttctcttaacatacagttggcattgtcttaattgtattggacttgtcgagcttggtgtttttttgtgggcatttctgacatgattttccctaatctatttacaggaggaaccattaactttgacaggacctaataatcgagtacttggtgcactagacagaatagagttacatttaaagattagagacgatggtggtgttgaccaagatttctgcgagaagccgagaacacaatgcatcagctataattttttaggttcataatataaatttagtgaaagtggcaacaaaatgtccggaccagtatgtgaacaagtagaatcgaatggcaaattaatcttctgtagctgccataaaattaggaacaaaattatgtagctctgtgatggaaagcttgaaggagctcagaattccagtcaatttctagtatacaaaagaaaaactaaaaaaaagtttaaactcaaagcccactagtaaatactactaatacaactaaggcccatattgggcccacacggcccacgaacagcaacctaatcctcgcgctggaagagacgagacagtacgccacgcgccgcctgagccctcgcgtcgcgacaccgctcgccgcggcggcgctgctcctctccagcgaccacgcgaggagggagaagaggaggaagaaggcgagaagggagcaagctagaagagtgggagagggggacatctaggtcgtcgacggcctcaatggggtggggcataccgacgcggccgccggcgacgtcgacgccgtcgcgggtgcaggcgctgtacgagctctgcaagcgcaccttcccgtcgccgtcctccgtcgccgcgtcctcctcgccgtcgtctccacctcccgaccacgccatcggcgccatctcctctctcatgggtaggtcacctgacctccaccaactcctcttcctcccgacctcggcccaatttttgttttgttcttgtgttcagagttcggacagccaattgattgctctttcctctgcaaaatcgttcgtatgctgatgtattgaggaattggatgtgagttttgtgttcagatacaatcactcctgtggatgttggactcagagatgataatcttgaggatggaagaggatttgggttctttgaatcaaacttcttgaagaattcagcaagggttgctagatgggcgcaacccataacctacctgcatgtctacgagtgtgacgccttctctgtatgtggatgttcaaatgttcaatttggtcatcttcttgtaacacttctgtgacagagaatactactagaagttaatgaataattggatatcttctctgctaatctgcaattgcttcgtgtttgttctgtagattggaatattctgcttaccaacatcggcggttattcctctccatgatcatccgggaatgactgtgttgagcaaattactctatggttcgatgcatgtcaaatcgtatgattgggtagagcctgctgttctagcaaatggcaagccaggttatttttcataccctgtttcaaatatttgtttttatttatctactagtatatattgcattgcagagtgatgacttaatgaactcgttgtctctgagaatacaagtgtactgaaaacatttatttcttcagatggtttctacagtaccaagttaatgaacaatattggttgtagcatagtaatagtattgatactacccaaccctattggtcactagtgttgcactgttgctcaggcatcattttagattgctcatttctatgccttgatgatttttcgggttctggtatattaaggattttttttctttctcctgatgtgcagtgaaacttggaaagttacatacggatgatgttctgaatgccccttgtccaactgctgttttgtatccccaaagtggtgggaacatgcactgcttcacttcagtaaaatcatgtgctgttcttgatgtcattgccccaccatactctgaatcttctggccgtgtttgcacctattttca

SEQ ID NO: 53794 - DNA, 2197 bp, Oryza sativa
aaacatatattattagtcacagtgctgttcagtccttttctgtcaggaacagcaatcaccttgtacattatgttcatttatatgagaagaaaatttaatttgttgatatgttgtcaaaactcaaaagtgttcatattcactattctatgtcatatctgattttctcacggatcactccaactgcagcagctggacaagcaaaagtagtccatgggccagataattatgcttggcttgaggccttaatcgtaccggtgaatattaatatgcgccctggcacgtacactggcccaactatacaggtatggcctaatttctacatattattgttgatgttgtcttctgtagcaaccaaaacgtgcttgggagttgagagttgagagttgagactgtttctgatggaagtaatatttgtctttttttctaggaacatctgccataatcaataaaaatggataggacaggagcatcaaactatgtccaagtgcaatctcacaaatacagttcttgtcatgtagtgatgtaaatgtaacatgttcatctttacattttgatttatgttggaacttccttcatagaaaaggtgtggctatagtggtgacatagtcaaaacagtttgtactagctactccgtatcatagttaccaacctgcattctaaattgcttctggagagattgtaaatgtatttatgttaatgtctacatttttctctgtttcgacgccttcagaattcagagaggctggttgccatggtgtcgatatggtctgatattcaaatattcaacaaaccttgttaagatggcagttgagcttcactcacaatctgtggattatggtgctccattttgtacatgttcttttcgtatttttattgggatcccaaagcgaactcaatgcaatttaagaacgagtgaaagtgcgaaactgacaagctgggagctcgaaagtccattctgggttctggcgatagtgttgggcttgggtaggaactcatcatgggccatctataactattcgggcccaatatgtatgggctggacatgaactataatactgttttggcccaatatatatgggccgtatgtgagccacattaccattccagacggcgcagccgcgttcaggcccatagatttgggctcagcacgcaggacctggccttcttgggcttcttgcgggaagttcaaatttttgcaccacattggcgcgggcacgtgaaagctacttgaattgggaccgtccacgcacgatctgacggccatcattgcatggcgtcttcagctgatggcaagacacgctcaggctggtctcagatatactagatactagtactagattagcagctactagtagctaatttttgttaaaagaaaaaaagggggaaaaaagaggcaaaacgtggtaacatggattgagcagtaaatttgcaagaccatgaagcacccatttccattaccagaaatgagaagttctacagttcttaaacctccaaaacaagagccaagaacatccacagttcacactgccagcacctgaagaccctacaaactaaaacgagctactaacctccactacatgtgtgaagcaaaccagggccaaataataggagctagcaactcaagccatcatcaacaaaacccaccacccaactgacaacagcaagcacgcagaaaaaacacactcagattctggagacgctgagccacgaaaatataaagcctgaggaaataaagtgtaatacttcctccgtttcacaatgtaagtcattctagtatttcccacattcatattgatgttaatgaatctagacatatataccgtttcacaatgtaagtaattctagcatttcccacatttatattgatgttaatgaatctagacatatatatgattcgacagcaaattaagtcttaacatcaataacagctatatgagggagtagtttattataaacttgcaggtaggtttgaggaaataaagtggaatagtttattactactatatgatttgacagcaaattaagtcttaacatcaataacagcttactccaaaatgacatacaccctccgtcccaaaataaaccaactaaaataaatcaactaattaaaacatagctaggatttgaatctttttgggacggagaaggtacataccaataaagtggaaataaagtgggtatatatcaacctgcatcc

SEQ ID NO: 53795 - DNA, 766 bp, Oryza sativa
gccggtcggtgaagacgtagacgcccaacaactgcagcataataggccagccgtgcaggcggagacaccagtcggcggcgggcgaggcggccggtcggtgaagacgtagacgcgcaacaacggcggcataataggccagccgtgcaggcggagacaccagtcggcggcgggcgaggcggccggtcggtgaagacgtagacgcccaacaacggcggcataataggccagccgtgcaggcggagacaccagtcggcggcgggcgaggcggccggtcggtgaagacgtagacgcccaacaacggcggcataataggccagccgtgcaggcggaggcaccagtcggcggcgggcgaggcggccggtcggtgaagacgtagacgcccaacaacggcggcataataggccagccgtgcaggcggaaacaccagtcggcggcggcgaaggcaagccggtcggtgaagacgtagacgcccaacaacggcagcataataggccagccgtgcaggcggaagcaccagtcggcggcgggcgaggcggccggtcggtgaagacgtagacgcccaacaacggcggcataataggccagccgtgcaggcggaagcaccagtcggcggcggccgaggcaagccggtcggtgaagacgtatacgcccaacaacggcggcataaaggccagccgtgcaggcggaaacaccaatcggcggcggccaaagcaggccggtcggtgaagacgtagacgcccaacaacggcggcataataggccagcc

SEQ ID NO: 53796 - DNA, 928 bp, Oryza sativa
taatgttgcagcaaactgataattttgtcactaaagttgcagttttctaaaatttactcttaaaaatatgttttaggatatggtatgaccactatctatctgaatccaatccgtttttaccccagagttagacattattactttaatacttttaaacttttttttttgtttaactgatttgtattacctctctgttgtcaaatatatgtcgtcatgtattatcaaaatctttagatgattaatgaatgcaaaaaataataggatttaacacaataaaagactattagtagtagaatagtcatgaaaacacttttatatatgaattttaatacttttttaaacatataattagaaaaagtagtgatcagttttgtgcattgaaaactgtgttgtccaaaacgacaagtaaaaaggaacaaaggtggtactaattacttcctctagccattctaaaatataaggattgtttctagttgtttagcagtagtttaatcacttcaattgtcaatttttgaattttgaattgtttagattacctttccaagtatccgactgggctttggaattcatgatgatgggaaccatatgagttattagtgtagtactccttccgcctcataatataagggattttagagggatacgatatttttctagtactacgaatctggacaggcctattcagactcgaagtgcttgaaaaatatcacatccctctaaaatctcttatattatgggatggagggagtaatgtttatattgtgttatgaatttgaatcaaagaaaccttatattttgaaacgaatggaatataaagctatgtcatttaactggctagtcaacaagtggattggtaactctagtccacaagcgttttgccttttacagaatccatgagtgacctgaggcttctaaatggtccaaatgg

SEQ ID NO: 53797 - DNA, 3436 bp, Oryza sativa
ttgggctaacgataacaggtgtgtgcccactcgtcacgtgtatgccatgcctgacacctccagcttatctacagggcgagtcgagtcgacgccgatagcgtgatcgatcgatcgagctcgtcgtcggctacacattggtgggtcgatcggcggcatggcgcagcagctgggcctcctcgccgccgtcttcgtgtcgctcgccgtgcacgtcgcgctccactgccccatccagccgctcgccccgccgcccgcacgcccacccgccgccgctcgcttccctcccaacaacctcctccaggtacggtacgttgcgttctagctcgccgcgccatgccgcgctcatgtcggccgttggtggattcatggtttgcgatgtggcagaatctggagaagcttggggaagggatgctgagcgcgccggaggacgtgtacgtggacgacgccggcggcgaggtgttcacggcgacgagggacgggtgggtgcggaggatgcaggcgaacgggtcgtgggagcggtgggggctcgtcggcggcacggggctcctcggcgtcgccccgtccgccgacggcgccatgctcgtctgcgacgccgacaaggtaaatcaaaacaagaaacatttctacgatgatacgcttcactgcttcagatgaagataaccgaatgagagacagtgcaaaagttgtttactgttggtgtaaaatactccctcgttccctaaataagaaagtatttttaaacatgtttgaccattcgttttattcaaaaacttttataaaatatataaaactatatgtatacataaaaatatatttaataataaattaaatgatagaaaaagaattaataattacttaatttttttaataagataaacggttaaatatgtttaaaaaatgtcaacggcgtcaacatttagggacggagggagtactaattaaaatctgcagggattgttgaaagtggatgagaatggacgcgtgacgcttcttgcttcgactgtcgaaggctccacgatcaggttatcttcctgcaaattacttgtttcactgcaaactactatgcaatttgcacagtgcaaatctgtaactgcgactgcgaattctctactgttcttctccgttcgtcgtcttcaggttcgcggacgcggcgatcgaggcctccgatggcacggtgtacttcagcgacgccagcaccaggttcagcttcgacaactggttcctcgacttcttcgagtaccgcttcaccggccgcctgctcaagtacgacccccgcaccggcgaggcctccgtcgtgctcgacggcctcggcttcgccaacggcgtcgccctgccgcccgacgaggccttcgtcgtcgtctgcgagacgatgaggtagtaacaagctcaacttctcatctgtgaaatgacacgtgcagtgacctgagtaacattttaaggttacgagtgcaaatcttcttaggaacgaatttcagattggattgtttgtggggctaagttcctaatttaaatggctgcatatatctgattggatgtagaatctggatagaaaatacccttatctaaaataataataaaaaacgagtaattttacggttcataaggatgtaccatgaggtaaaaaaaattagtataaaatttggtatcttatagtatctagatataaagagatatcaaattaaaatagaaaaaaaatagtatctcatgtatctccttaagaacggtaaaattgctcataaaaaaaagagtctgttcactctatcgtcaagtgaccatgaagtgatattgtcaagtgcaggttcagatgcttgagagtgtggctgaaaggggagaaggctggggaggcagagatcttcgtggacaacctgccggggaatccagacaacattcggctgggttcagatggtcacttctggattgcccttctccaggtctctgctctctaacctttctgctgccataagcatctacacaacattttcagtgctcaaacttacaattttctgtgctcaaactgcaggtgaggtctccatggctggacctgatctctcgctggagcttgacgaggagggtcatcgcgtcgttcccggcgctcgtcgagaggaccaaggcgacgctcaagggagcagtggtggctcaggtgtcgttgaacggcgagatcgtgagggttcttggtgactctgaagggaatgtgatcaacatggtcacttcggtgacagagttcaacggagatctcttcctcggcagccttgcgaccaacttcataggaaaattatccctggctaaggttacacgggagcaggaggatgcagttccttcgtagacagttacagtttgaagtgttgatgtgtgatcatcagttggtatcgtaaatccgggggcaactcataattgacacttgacacagcttgagcgcagtcatacatatagctatagcgtacagtaatcagttagcggtaatggttttgcataacttccatgctgtaaaagatttgaaagactggtgatcgtcctatatcgagcactttgttctgctctcgtccttcacctccgcgtgcgcttgaatttcactgggtgcagagttacagttggatcccctttcttgataaatccaagctgacaagaaagtttgacttgcgtcgttcagtataatggcagtgcaaatatttcttaacgttttatttagagaagttttacattctttaagaattccaaaatttttagtacattttttttaccttacactgggatgtactaaattttacactagaaaatatggtatctttcggtatctcctcaagaaccgtaaaatcactcttttatttaacaatagtgagtgcaaacagaacatatctacaatagggctaagaatgagcactacctcaaattctcgggcatagaaatccccctccaggacatgtttcaacgcagattttgccaactggaaacaaaatcagtaaaaattaatcacaaaggggatcaaaatattggatcaccgtattgccaactggaaacaaagtcagtaaaaattaatcacaaaggggatcaaaatattggatcaccgtattggatagggcttgtgactacaaaagtgctaatgtacaaataaatacgcaacagcatgagggaaaaaagaacttgcaggcatgcattattgacagtagtctgtcgaagatgctgcacagatagacatcccaaaacgcactctgttgttaaagaaacagctaaaacttcatgtggtaagcatccaaagagaactaacagagtggtgcccttaataatgatgttctcaaattcagcttcagagaaaagggaacttttgttgtgttaaatactagttactagtatttaagcatgtatgagatttggatatcttgtactgtctgcaatgtgtggcttggtgttgaaccatcacatttcatatgaacatgctactgta

SEQ ID NO: 53798 - DNA, 1747 bp, Oryza sativa
cgaattcgagctcggtacccctctgacgctgatgattactcggtccgacgctcccttgaggcgtacctgtggtggtcgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacatccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactactgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagatattagttcatttttgtttcagcttttgcacgattatgtcaccatgttttaactgcacgtttcctcatcgcaggacctcgtctgccttcgag

SEQ ID NO: 53799 - DNA, 3071 bp, Oryza sativa
gcacagtacaaaatcgccctcccccagggcggcaagggggccgcctgcaaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgagagggcgattgggcggtaggcgactacttccgtcaattttcaaaatggaaaattatttttgtaaaacttttaataaaaaaaattataaataaaaaaaattcggtggttttcggtcgctcgttttggtggcactgaccgtccgaaaggcacatttgggcctggtttagttcccaacttttttttaaaatttcaacttttccatcacatcagaactttcctacacacataaattttcaacttttttcttcaaatttttaattttagtcaaactttcaattttggcgtggaactaaacacacccttggctccagttaaacactgatgaactgtagaattactgttatctgaccgtaacctaacgtaaatgcagtctctacgctgatcaaatcctctgaaccaggtactaaaaaatgttgcatcatgtcttagttttgtttttttatgggatgagtagtgatccacaccaattattggaggggcctcttccagacttgtctttggaccaaacaacggacttgtctttggatataaacagccagccagttctcactgattgctggctgctgttgtaaccacaggaaaatttctctgaacttcctccgcaaaagaaaaagaaaaggtctgaactgctgaaagcttggcaggattcagatacggcaaacaggagtagcaggacgagaccaaccctgtcaattctctgttgctttccctgtttccatcttctgcatgggccaagaagacctcgagagtgaccagtagagtagtacagtgtagatgtgtgtgtgtgtgtgagtgacccaataattggaggaggctatctcaatcttgcgtgctctcccgaggcgagggaatcagagccattttgtctctggaagacaaggaaaatggccatcacgatcaatcaccagagtttgtaacgaatggctgcttgcttctcttgctcaagaatactccttttgttaaagggtagtggcatcgtattcctatcatgctatcatatgtactcctttttatcaaaaataaaaataacctagaagtgaatttgatactaactagtacaactaatcatgatatactcgttccgttccaaaaaatatgaatctagaactgatgtgatatattaggacgtggcacatccagtactatgttggttttttatgggacggagagaatactcctattcaaattcattgtatagtgtcaaatttactcataggttgtttgtttttgcgatggagggagtattggtttgactggatgggtcatggaaaactggaaaagcaacagcggtatgcatggcaaaagagggacaaaagaacaagacgaaacataggtaggattgcaggatgctcaagtgagaacttgtagttgtagatgaagtgaagtgacaagccgaagtcccgtgaacgaagcaacaaaaaattgtgggagttttccatttgttgtatgtgtattatttgcgatttgaaatccaggctgtgtttagttccttccaaagttagaagtttgggttgaaattgataccatgtgactgaaaagttgtgtgtgtatgacaggttgatgtgatggaaaaagtttgaagtttgaattcaaagtttggatctaaacacagccccaatgtttaaagagaactttaacgattaaatttggccacgaccggtaagccgataaacaaaagatgagaataaagtactgtatatacaacttccagcctcatcttttcacttatgcttatgtttatcaactaaaatttaaattttcaaccttaaatttagagttgattttagggttttttttatcgaagtttattttttagcctttacttttagatcgtaggaacacgtatatgaaaaaattatttttcatttgcaattataccgtttgtcttattccctatataagcgaaacgagggaccttccctgtcttgcttgtgatcatcagtcatctcatctatccgctggatgtgaagttacgacagaaatgatccatcgttcaacttgaattacacttgtactactagcggtgtacgctcgcatgtcagcgtaacgaaacgatgacatcgccatcacagtaggagtattggtactaatctggcaggaccgaagatagagatttagacggtgaccatagattttgtggcaagttttggctataataacatgtgaggttaagggttaatatgcttcaattttagcaatgaatcaaacatttgttatggatggtcgtaacttgtactcctaacctctttctatatttaatgaaaaggcgcactcttgtaccgttttccgtttaaaaaaacacttgtactcctaactcaagtgccgcaaacttcagcaagcagccaaacaagtgcaatactagtactccatgtcgaccaatttaagttaaaactttgaaagccaacatgatttattggtaatgttggactatctgcaattaccagaccgactcaatcccgaatccatatcaattttggttatgtataattcagaatttcaaatacaattcttcaaatccctcttttatctttttttttaaagacaacagaaatgttttacatccccggcctcttccataagacacataacctccctctttgttttgtaatgagagggattttatcctcattttgtactacgagaaaatagctctatactttcatacaagagtgtctggaacaccgaagaggaattcaagaatatgtaaggagttaattagtattacaagccaaagataatttttccctcgttgttttcagaagatggaagtagcaagtacataccagacgtgcactactggtgaacaacacaaatacacaaatggattagagaagaaaaatatctgacgcagactgtggtctg

SEQ ID NO: 53800 - DNA, 976 bp, Oryza sativa
atgggtgcccatcacgcgtgtgaaatgtgggtgtcgtccccttcgggcccgtccttggccagcccaaagtccaacagtttccctttgtaatcttgaagggagggacaaaattcacaggcccaaaaaccataagcccatttgatgcgattcttttacttgggcttattactaatgaatgggctttaaagtgggggaaattcaagttgggcctgattttggcccatcttgagtagtaacccattaaaggcccaaacttaacatttgctttttctttcaaaaaaaagaacattgacacggtcatggaaaaaaatgtaaagatttgattatattttttagataataaagatttgattatatgacccgataaaattattttcagtgacgcttttcagtggtgaaactaaaatttgggcctccttttagcccaatcttgagcagaactcacttacggcccaacctatgaaccatagcccacatcactaagctttcctttccttttctttggtagagaagtacaatatgataataaccattaactagtactagttaagtatgaagtgatgcataacactataacagcataagtacagtatgatactaagtttctctgacataatcatgtcataaaatgcttcaaaatccaaactgtgccaagtacaatttcctagtcattactctaccttttcactgatgatgatgaaaaggtcattaggatgatactatatatatagtatatcatatgtgatgtgtgcatcaaaaactcctagctaactgagatgcatgcatatgagaggtgtcaatctacctaggaaaagctacagggcactcaccgaatcgagcaggatgttggaggccttgaagtcacggtagatgaccggcttctctgcgtcgtggaggaacgccaaacccttcgcggcgccaaccgcgatgtttaatcgggtcgaccacggcagcactgcaggaatctctgcagaaa

SEQ ID NO: 53801 - DNA, 774 bp, Oryza sativa
ttttaaaagaaacatttaaaaatgaaaaaaattcatggaaggctttacctcggccttcccgtggtttgggcctggaagggcattacatgggcccctgtgtcttttttgggcctctggagagttatgattgcaagacaattagcccaagtaacagaccaggtgcagtgctctgtttagtaccacaccgtcagttttcagagaaaggagcatcaggagagctataataccagggttagtatcacgcaacaactcatacctttctcggccttttggctaagatcaagtgtagtatctgttcttatcagtttaatatctgatatgtggaccatgtgcccactttgatattaaatttattttttatgggggagggctcacaatagtggcttgccactaggtccctcaagcgtcgtttaggcgttgcactacagcctaagcctggcgcaccccaaccaaatcaatttcaagtgttagcacgtcaaagaaaattcgcatagaaatttcagctgtcagttattgttcattaatattaatttgaagtgttgcaattcaaatatactacttagcaatttcagttttcattggcaagtgcacagtttcggtactgccaattttaagctgtgcattggcagggtagttatcaatttcatacccaaatgaatacataggataaaggccaaaaggctaacggggcctcgatcgctgccagcgatcgttttattcttcttttctcttgttagtaaggggtaccgagctcgaattcgccctatagtagtc

SEQ ID NO: 53802 - DNA, 2212 bp, Oryza sativa
ggcagcactgcaggaatctctgcagaaaaagaagaaaagaaaagaaaatatcttcagaaatctcagcaggatcaacgtcagctaaagccgcgcatgtcatcattataattaattaatcgatagctgatagccatgttatgtatacacatcaatcgaataagaaagctggaaaaggaaaaacaaagcagtttatgcgtattgttgcagcagaggagaaaaaaaagacgatgaacagtactggctagccggccatgcgtgttgtcgcctttgtggaattttggtttcttgttctttctgccttctgaattttcaagaaatgttattattgtaatttggagggattcgatatccagtcaacgagttaggagatttcgtcatgaccaagaacaaatcaatcagcttgagccagtgaggcagctgggaagattgcagcacactagattactatgtcaacctgaaattgatccaacaactacaggtgacctcactttcatctgacgtctgtaatctagcattagaaaacgtctagtagcataatctatagcttgtctcgcaagggtgagtgaatgtataattgacccttacctaatgaaatactattttccatgggttttgcaagctcataagtgagcagagaaggccagtcaaattcagtttggtcagaactctgaactctaataagctaaagaagttggctagccaaacgaaggaaaacatatccatcatccaagctgaaagcctcaaagacgcaaccaagttttttgagtagcaaagctacccatttgaagtagacttctgaataatggctttgcttctctctcattttgtgatatctataatccattattaagttggaatataacctcattttctcaatgaccatcagaccatggcaccatgccgtgccaggtcattgcgtttgtgtgagaatggtcaagccaacttctgttttaaatctccacttcacgaccgtaccaaaccactcattaaccatcagttaattaggtagtcctactcgaactaaagcttcaatttgacacacacccatgacatggtaaagagacatctcgtcagataaaaaattagcacaatggcaagttggcaactagtgctatagatcaatggaacagtagtacaaacttaagctgaaaatcaattagcgaaggatcagttcagtgcttacgtttgaagaggtggttctcgaggctgccatgctccatgtactcgtagacgaggaggcggttctcgtcctcgcagcagtagccgaccagcttcaccaggttgggatgccgaagctggccaaggaagatcacctctgcctgcaagcaacgacgtcagaatcatcagaaatcaggtagtagtagtagtagcagcgaatcagcagcatgatcacgtccatttcagtggcactgttgcattgggcagcatgattagatcactggaaacttatccgaccgtcgccggaaccgtcacatcgtccaactacccctcccttgttctttgcctcgcacgtcctaatcgtgctgcttaagatatttttaaacctgtttgattatgttctagatgatcgtgtgagtagtagtagtattagttgatctgaaattaaacaatctgtaattaattgtttaggccaagcgtttcagaaaccgggtttccgaagctactggcccctgacagttactgaattttaccagataaaatttcagattcaatttttttaatgaataattggtagttaactagtcataagtcgtaaaagttcaaaattttcaaatataaaatttgaataatacagtcttttaggtggtaacctctagtcgaccgataaccaaactaattaccgctgatcagtctctgtttgatgggaaactaaatagcattaggaaagaaacgattgggtaatttgactgaacattccctgttgctacaggagaaacgacacaactttgcttctatgcaataaataaaaggaaaatcgacactttcccaaagaaaaacaataatattaatttaaaaaacaaaatcaacgatatctcatatctctcaccctcaaaaagaaaaaaaaaatactgttcctcacctgcaaatttcagttatctagagggttactcaatgccctaggatattcatatactgggatacatatatttgagtgatccttgcaaggcaactactactctaccaattaagctatatttgatggccactcttt

SEQ ID NO: 53803 - DNA, 1638 bp, Oryza sativa
atcatttatgccctccttgagaagtaatgaaagcaccaagacatagctcattgcatcccattggccaactgaattttcaattgtcatattaacattccatcagcaaagggaacagattagtttgacgctcccttacatagtagtggggcatatagaaatatttgcagattgtatttcaaatttaagagaaagtagagtgtattctcgcttctagggaccaacatgaaactgtggggcttgggaatgtcaaaagaggttgtgaccaataagattcaaatgtcgcaacccagtctgcttgagaacaattaaaaggcatttatggcaatagaattcaaacactacctagtggcactttaaacatcatgagaataatatatgaaaggttggttacagaaaacatatacattgtcaaagtacaaagaaatttatcgctcaagttaaatattctaagaatttttaagaaatcagtgtgcccaacaagctacataatcacctgaatagtttatatagagtggagatttagattgccatttgatccaagtaaatctgatgtttaggaagtgataagagatcacatattagactacaaactgcagtttcacctccaatcggacacctataggctggaggtcacaatcaaatgcctataaaccctatcaggacggacattaataaaattaccaagaatttaatgaagcaatagacaaacagtataataactacttgatggtatacatttaacacagtaaaacaggtacgagaaatttagatagatatagattgtatggttgacaggtcctaccgaaattccatcacggaagttaaatgacttgtcaaggacactctgcaaacagcaaccagtagcgaacttctcaatcataaacactcggaagccaggaagctgaggaaaacaagaaatacatgacattatgagtaatgcaactgcccaagtactagatagactcttcaaaacatgacataagaagaactgaacacaacaataccttatcttcaatttcagagctactacaccagtctttgataaggttgacaaaagtctgtacgcatgtctacaaaacaataaccgagtataaaatagacaattctatttaaagtggagatggagaatgtaactcgcttaaagtggaaataagaaattcaagatcaattaaaccccaccttccgatgtgatatctctttatggctgcatgaagtaatcaaaagcaactgcattatgttctctagataatgcctacaactaggagttaggagaactgtagacagatcatgtgttgctatatgaagcaagaatgcgtaaaatctcttttccagctcttgcagctcacgcatttcctgcaatgaacaaaattggcatgaatacagtatacaaggaactacgcaatccatgaaatacctgtaaaagcctggctacatagattagccaaattggcatgaacaaagtagacaaaaggtagcaattcagatggggcctactagctgatgaagaaccaagccagctacaaacaatagtgtgtgactaactatgcaataagccaagaacattatcatatcaagatgattgccatatatgtagcatggttgttaaggcggtaaggctatagcagtaaaacgctaagg

SEQ ID NO: 53804 - DNA, 2952 bp, Oryza sativa
ctgttattaaaatatctctccccatggagcattattttgctgtatacatggtgtgcatcttcgttgggcactcccttgttgtcctcaccaccattagggtggtaatatagttgatgtaaagcttctggtttagcctatattctgtaatgatggagcatccgaagctctattcatacacctttcaatatcagtaatcatacctcgcattattgtgaaatctgacctcaatgcatgtttcagtgtagtttatgccagtggcacataactgatgaaaaattacccttgtatgcttgcagatgtatactgcgggaatatttttaccgagcctggctaccgtggcaaagttccttgatcaaggcatgttagtgagatgcaggggatacatccccagagtttctgctgtgagcatacagggtttcattatgtttgttttgatatttctctggaagtgatcattgttctgctccgagcttgaaattttttgtaaggcgattcgggtgaagctaaacagatgggataggcaaaagagtgatgtgtgggccgtgtttttcctgacagaaactgtcacaccgcctgttgtcgtgttaccaaattttggcagtggtttttcacccctttgttagctggggtgctgtacagattctttaatatagttgcgtcgttcgcattaataagtttccgtggtcaccttctcgttaccctgattatccagtgacagaagaggcatgctatgctgactgcaatgtaagagttcaactttgatctcttctccttttgaggtagtggaaattttctttttacccatagaggtcggtatttttgaacggtcgaaatctttcatccttgtttttgcccattctgtgactttcgtgcttgttcggcttcctttcagaatttggataaatttgctttggattagaccacgtaacagagtctagtcactgttacttgttaggcaggatggatatggctgtgaagtgaaggccaggccatcaaagttgggtttgatcatatcttctgttcttgttcttgtgatccaactatccaaggacttggccaggagcacatcagcgtgctagagacggacataacgatattgattgtctagcttatatgactgcacatagaggcccatatttgtaggttgacaagatgtttatggctttatggccatatgacttttgttgaaaatttgcttgcctgctgttggtgcatattatcaaatttgtcatcgaattctttcgcacgtcattggaatcatctgcaaaaaaatgttgttccctatggtggtggctccatgtatcttgcgagacccatccacgtagtcattttttatcatcttctgaaagtcaatgctaatccaatcatgcacattccgcaccgcacgaggaaatatggggttttaatttggaactttggagccaattttcgccctgcccatatttggtagtgtaacagtattggcaaacattgttatcaaactaaatattttttgtgatattattttagttaccaaaaaatttgggtgagcaaaagttgactctaatctaaaccatggtctgcttcctttcatcaagaatccccacattacagaagttctaaaatactcgtatactaatttggaggtgcagcaaagagcatgaaaagtgatttcactgttctcacaattttttgataatttctggagcttctacacattgaagcactaacttggtagtgaaagggagtgaagacctcccaaaaaagggaagggaattgaagcactggaattggattgttcatctgcactgcacagctagaaagggatcctgacaaaggaaaatgccacacaaaagaatgggacagttgcaaagtccaatagagaatgtagcaaaacaaagaacacaaatgccaaaagagttgacaaaaaaaaaaaaccctgcatcatccaaaatacacaagagacaaaagaagcactcaccaagatgagctaaccatgctcatcaactttttcataccactttagctgtttttcttggagggggcacttggaggttggaaccaagtgctctcacccaagagtagtaaaatatggccagctaatcagtttgagaagactagatatttgaagacagattaactttcttgtctatttggacagtagtttaatttgtctatgccttcaaaccctgttttaatcacacctaccatgagagtttgttgatcagcacacatgcctgctgctggtctaatgtccattgaaaatgtgtgaagacaaaccacttacttagaaagttaacaatgctagttaaagtaatgactacatatatgttaattgatggttgatattggagcaaggctggttaaaatgcctatattaaaagaaaagctatctgcttttgacaaagataatcaatttgattgcattatcaagtataagatagttatttacgactagcctggtgacttggtttttctgtagcggcatagacctgttttttcttcatttcaaatgtcaggtaatgtgtccattgaggaaggcagcattcgtattcaaaaggtgtggttagtattcagttcagtgtacagaatgggttgactaaatcaagctaaagatcgtctctaattaagaagtaatcaagctagtagctagatgttctctaattaaaaaatgattaagctagctactgcataacatttgcttgcttgtagccgacaagttgtgataaattaactaaatcctgcaccaatcaacaggcctgtgaagaatgcattactccaactaagattgatgtgcacaccaacagcactgcaaatccatatggatatatacggaagaaacatcagcagaacatcatcttaaagaattctgattgggaatagtgctcacgtaggggagcaagaatgaacaaaaccagtagctaatgcccatcctgaaccaaatcaagaacccctgacactgaatttttcccc

SEQ ID NO: 53805 - DNA, 3617 bp, Oryza sativa
ccagtagctaatgcccatcctgaaccaaatcaagaacccctgacactgaatttttccccctatcttcttgtttctctgatcaaaccaagaaaccatgcaatgcatttatgcatgtatctagagcattagcttgtttagtagatgataatgatagatgctttagggtcaaaatcattatcttaaggctgcggttgtacctgccgaagtgtttatcttcaggtacagagaagaggagaaactagtaacagtcaggaagcaagaagtgcatattgcataggaaagtaagttcagaaagtatgcatatgacgtagaggtcgatgcttagcagtttggtgaggagtctcgtgacatttgatctcttcatggaaagagattgcaaacctacccccgtatctcacgaagttaacctgtccttcacaagtgtttctagaacgtgtcaatttcatcaagctgattaatttcaggtttattgtcattgaggagaaaactaattctaattagatatacggaagatcatgtacggactaatcacattttctttccgaggaaagaaacttacagattgtttttaaaaacgaacttattatgttttttaatagataaataaagctttattgaactcaatgagaactaaggttgttaaaatcatgatcctaaatcagaggtctctgagtaggatcgcaaataaaaaatagtatatgtaggaattgtaaaatcgtggattctatctactagaatcgtagaatcaggttctttaattaggattgtaaagtcgtagaagtgtagagctgaatcaagatttttacaatcttcctgaaaatacttagtaagattgttttgtatcaccttattgtaattggttgaattcaataattatctcattatctaaaaataagtgtctcgattaactgatcacgtggtacatagccaagttgtttctctgaatcattttggctgacagagatcagcatccactgcaaaagtcaaagtggatggaaggattttatattgtatctctgcacacgcattgcaagcattccaaagcatatgcatggaacagttgactgtcatttctgaagcgatggacttctgctacgcttcaccagctaccggagaaaaacaagaaagtaacacaatctatacacaaaaacggcttcttaattagttgcatggctaatctctctttgatcatcgtgtgtacaagagccgccattaattagacgtcaaaactcaaaaccgagttttttttttcaaagatcctgaaattaagaaggtcgtcactgcagagttggtgcagatgattgatttcagaaacaatatagtacatatttgcattcgaagctcttcagttcttttgttttttcttcaccttgcaaagcacgtaggcacttggtttgatggtttccagaatgatgtttcttggaagcaagtagtccttggcaaataatctgttattatcatcaaatgcagattacaggattacccttaacctaaccccagttctgacttaatcagttcctactcctagtgtttgacaacctactgcagcaaagaggattacactaattaaacatttgatccttgcctgaattcatgcagcatgcatgcgtgcttgcacggccgtctcatcaggtcatgtactaatcaattaacagccattgacccattgtgcatatggttttcccactggacatatgtaactaaccagtaattaatttcctgattagttcttgattgggcaccaagaattagctaagtagctaaccaagaaccaggcttcaaaatttcagttttgaccatttctattgggggcaccgatggtaccgaaatttctaaatattttgatccgaaataatttaaaacttgaatagcttcttatcggatgaattcttttttgataagatatatactcgattacatggttagagtgtccctatcttcccatggccattattcagaggagcaactcgtggtacatgcatggcaattcctgcgccacatgatcagtggcacgattagtaaatcataccgacatcagatccatacatgagaagcctctttctctgtcaccgagcacacgtactttacaatatatactttccctctagaaggaaaaggaattgaaaatgaaacgagctttggttatgttctcacttggcttgtttggggccacatggtttgtttttaattactgtaacttcagttaaaaatgttaacagatcaatattgtttgaccctctttgacgaatttaatttcagtgtaccaagtgcgtgttctatttacatatgcttgaaagttactgaggcatacacatacccattgaaacacaactctgattgttgagctatagttggtatgcctaaaaaactgaacaagcaaactaaaaaaaaatacaggtaaaacatttatatttgtatcattaatggttctagaaccaatgctaaaaaaatagaccatggctatggctcggctaataagccaacaatctcctaaacttgctgggcaccaactgtaaggttttgagagtagaagatagagatgaaaaaatatctcgttttttacgtgcacgtttcccgaactactaaacacagtacgtttttctttcaaaagaattctatatgaaagttgaataaaaatcaaattattctaaattttaaatttaaaataattaatactctcaaatactgtactatctaactctgcatttgctacatttggaacttcataaccatgttgatgtcgtgaactcagattcccagcaaggtgttctcatctggatggtgcatgcagatgcagtcgcaggtcgcagctggatgcccggattccagtggtggcaacgatgaccaatcgacaacgacctgcacacacagacaaacgtcgttttggccgccatttgccaccattaagagcatgtccaatagcatactataaaccagctgtaaatatattttaaaaagataaatgaggagaaagaagaacagcgggctacagatttgtagccagctgtagcatggactccaagacttagtgtgtgtatgccatgtgggaccagatattaatagtgtagtatatatgtaactattatatgaataagctattagattgcctatagatgaattgaagctagtagtgggctatgctattaaacttgctctaagtacatcacatcgatgctgggcagcagcttgcacgcactgactgatcgacgaatagtgatcaaaatattcagtcagatcgaccaagaaacctccaaaccgacgagaatattggcatctcttctcgcgattgggactcttgcaaacacctctcgatccatccatcgtcggctcatttcctcttcctcctcctttgcttgttccgagtcaaaaacgcgtatgcatggactggaatcaagcgacctcctttacggcgcatttcttttttttctctgaaagtctgatgcgtttgcttgcattgcaacagacggtggtgttgcttttctttctttaatttgggggcagttaatagtttgagttggtgatcactggatttttctttctctctttctgatgaattggtcttaatttggctgcattgcctgaagctgggttgatgcgttcctttgttcgcgttggtc

SEQ ID NO: 53806 - DNA, 1482 bp, Oryza sativa
gtaatacttaaacatgttttggtcgaattttctatatgatgagaaaaatctaatacgaagtatgaaacacactggagtgtatggccatgcttgcttccatccatccatttccacgatacaaaaatgaacaagaaaaagatggacacaattaattagcacgctagtctttgcatgtcgcaatacaaggtaggtaaaggccgggggaagcacatcgcaccatcaccacatataaaaatcgtcacatcaacctcatccaaatttcgcatcatcacaaaaacaaatcaaatcccctccaaatttataacccattaatcaaaattaaaaatatcccccaatggtcaacacacacacaaaaacacacacgagatgatcaaaggccattccatcccgccctgacaggtgggccccacctgcagcctctcgccttcgcctatatatccactcgtgacacacacagccccctctcgcttgccacgcacaccaccaaatcgccaaccaaaaagcaaacccccgcgtcttctccgatcagctccgctcgctcgccgccgacgagctcgccccgccgccgacggcgacggcgcatgctagctgcgtatagcccgcggcggagatgaggtcatccagcgattgcaaggttgtggcggcggcggcgaggaagaaggagaaggagcggcggcgtggccgtggtcgctgtgggggttcctcctgaccggctgcctcggcggcggcggcggcggagggaagaagaagagcggggggaagaaggtgcgtccccgcggcggcggcggcggcggcctgcggcggctgtcgttcacggacctgacgggggcggcggaccaggacctgtcggtgtcgctggtggggtccaacctccacgtcttcaccgtcgccgagctccgcgacgccacccgcgggttcgtctccggcaacttcctcggcgagggcggcttcgggccggtctacaagggcctcgtcggcgacggcgtcaagccggcctccgcccgcaggccatcgccgtcaagctctgggatcccgagggcgcccagggccacaaggaatggctggtacttcacccctccacgtgtcccttttccacttaatcatcaaaaaaatagaataaaaaagtgatatgatttcatttgattaattagacatgcacgcgttaatcactttagttagttaatcatttaatgcgataattaaatcagattgatcgattatgtttgtataagattaacaattaagcttggagtaattaatctgagatagtgtaggccagcttccttggaagagtccctaaatctaatgcttgggggaaacaacattttctcacatggtttcttatagtaaaagagtggccatcaaatatagcttaattggtagagtagtagttgccttgcaaggatcactcaatatatgtatcccagtatatgaatatcctagggcattgagtaaccctctagataactgaaatttgcaggt

SEQ ID NO: 53807 - DNA, 1855 bp, Oryza sativa
tcaaattaagcactgaattctggatgccattctgttttcttcagactacatgatggtggcctggtgtcctgatttacgcggaggaaaattcgcagtaattttgatgccacaataatccccatttgttcatgaggttcagttgaatggcgaatcgatcgcacggcacaacatacagaaccgaatgcgatgcgcgacggtgtaattctgaacgaagatcaaacgtcgactggctggctagttcaatcattattggatttgagctgaaaataggagaaattttcaagctctgttatctttttctttttttcagatttcagatacagttggtgtacgtttcaccatatagtactactccccccaatgtatactccatttccattaaatttgtgggatacagcaacaagttttcatttcatttcatctgctagtgaacccctcatgctcttattctacctacccttgatcatctcaagaacattggtgcatgataaatatacaccagaatgtaccgaaacagcagtgcaactagggttcttggggcatgcccatggccgaaatcggtaagccaacctggagcagaggctacaaaattcccaaatctccatcggcatcctgaatttctctgatcaggggcaggccccccggccggcacatttgtgtgtgtttgtgcccaactttgggaaaaaaaggtggccaggagtggctgccaagcaacattctacacctttggcaaatgccgatgtgccattgaatatatatgtgatcactactcacttgtgtgtgtacatttatgtactgtatcttatgttcagatgtactaatatatccatatatgtactctactagtagactactagtatgctaaaatacattggtactcccactatccaataatataagagattttgagtttttacttataacgtttgaccacttgtcttattcaaatttttttaaattattatttattttatttgtgacttactttattatctatagtattttaagcacaactttttgttttttatatttgaaaaaaaaattgaataagatgagtggtcaaatgttataagcaaaacctcaaaatcccttatattatgggacggatggagtacttgatttggatgattgatgaagaggcccttttctctcatgagacatttggtctttgttagatgaggaaggatcctagggatccacaagatgagagataaacttaaataggagctatgcatgatactatgctggtagagtttgttatcaagagctaatagtccagattaatgtgcattcattaatctctgactcttgaagaatgtctggacagaaaagaggcacccatcatcattcaccgttggatcgatgaacaaaataaaagtagtacacatctgggtgtgtgtggagttctagaatgaaggctagagaagcagcgagaagctgccgcgatgtggtcctgaatcccgtgtcgcttttcggctagaaaagaaatgcatatatatctgaacatgcggtttctgaatctacaccgagcttagatatcatcgcattgcatgcagtcctatagattatctactactaatctatggtgttagggcacccacaatggttatctataggctctctataagagattcatgtcagcatattttcctacttggaatgtattaaatgaagagagagagcaaagctatctactaacttagagatagtctatagagaaaaacgagacaatgcatgagagagctatagataccaatgtagacatactattaaggtggtttactattaatcgagtctattgctgagatgtacatgttttatagatagcaccttactttaccattgcgggtgctct

SEQ ID NO: 53808 - DNA, 1484 bp, Oryza sativa
  unsure (1)..(1484): unsure at all n locations
aatcataattggcagcacaaaatagcattgatatatctgaagcatctgacatgaactggcatcgcttagtgcaaaaattctcataacgtacgtcttaacatgcaagaagtacagtagaaaacaaactaatcaagtcttcttaacgcaaatagcttgagacaagaaacgactactacttcagattaatagatctcaaaaaccaagaagcagaacaaaaggcagggccaggaccaaaccctaggcggtgagcacgacggcgccgccggcggccttgatcttcttctcggcgaccttggagatgagcttggccttgacgacgatgggcttctccggcagcagacccttcccgagcaccttgaagtagccgaactgcgtcacgtccagcaggggcgccttgccggcgccggcggcctccgccgcctgctcggcgggcaccatcgaccagagccgctccacgttcaccgccggggagtagaacttgttgcggagcctgtggaagtagcgcatgccgaccttgccgaagtagcccgggtggtacttgtcgaagaggatgcggtggtggtgcatgcctccggcgttgccccggcctcccgggtgcttccggtgcttcccgatgcggccgtggccggcggacacgtggccgcgcttcttgcggttcttcctcaggctcgtcgtcatcgccgccgccgccggcttaccttggggacgtgttcgggaatgggagggatggaggcggcgaggcggagttggtggattggataggaggaaaccttaggaggcgaggaatggtgagcttgatgggctattgggctggcccttgctttttttaggcttgtttctctcttggtttgttatgctgggatgttgggctgtggtttggggttttatcgccattttggtccaagaaggaaggagattttttttggaagctaaaaagaaattagatttttgtttcttgatgtgttgtcctggtgtttttgttgtggaatctccatgtagatgaactatgcaaatgcatcacaaggggatttgctattttaagagtcccatgtcacaccggacacacggttggagccctaaaggaatcacgtgacatagatgaaataggagaaagttgtctttcaaaccactatagtaagccagacaagtgtcgataaatatttttttcttgttaaaaaacatcattggttttatgtttaacattttggcagtaagattgccacatcccaatggatagaaagttagataagagacaacaaagaaaggggaaaataagagaagagaagcgtcttttgaaccattgtaagaactcggaagtggaatgtgttaatcacttgacatggttcttttctcgtcgagtaatatcactactattagtttatcttttcaacacatgtgtttgatgagaccaatcagataatatggtaatannnnnnnnnnnnnnnnnnnnnnnnnnnnnnnnnnnnnnnnnnnnnnnnnnnnnn

SEQ ID NO: 53809 - DNA, 764 bp, Oryza sativa
aaaaaaatagaggaatagaaaaaaatacatgattctaacagaaatataagtgcaaaacagataattgtaaaacatatgaaaaaatataaaaactaccgtttgattgaaccacataaaaaacacttaccatagaatggataaaaaagatagattcaaaggaatctcttgctaacttttctccaaaattttcataggattacctatttcataggaaatgataggatataattcaatccgttgtttgaaagatttttatagtaattatttttcatataattgaaatcctccaaaatttctatatttttttctataaattaaaggggctcttagcttttattgattttctttttgtttctccgggagtctgcaggatttttgttttagcttgtgtacgaggtgatgcctatgatgcacaagctaaccatgagacgccaatgtccaattttcgggcccctttaaatcgtaggaatgaaaaaaatagatgaataggaaaaaatcaggattctgacaggaatgcaattgtataacagaggattacaaaacacaggaaaaacataggaatgaccatttgattggaccaaggaaaaacgcaggaatcagatgagagagatagactcagaggaaatgttccaagaggttagacctcttgctaactttcctccaaaatatgcataagattacccattccataggaaattcataggaattttagaggattttattcctataggaatttttcctatatagccctttgaatcaaagga

SEQ ID NO: 53810 - DNA, 5619 bp, Oryza sativa
  unsure (1)..(5619): unsure at all n locations
gttacaagtgaagtgagagtgctacagagattaagtcagcgagccattggctaatctcgatcggtcgagcgagtttagtggccaaattgcgtacttgtttgaatgcatccatccattcataaggcggccactggattttagtgtgtgtatctagcttagccaatacatgctcatggtattcgttctcaaaggtacattgcataggttgtatgcggatctacaccttttttggacactgaaataccctgaattactattttctgcgtatctttttctcaagcggcaatatagttttatcagtgtaactaccccaagctttcaacaagcctatacccgatccgtcgtaaaaagccatcattaatccattatttctatattaaaataattcattactgctagctatcaattagaaacgacaacaacggttataaccagccaacaggacggtaacccgccaacagcagcaagtgtctaacggctagactgtgcagttgtaatcaaggtacacttagctaccgaacaaccccaattttttaaatcttttaaaatacaaccaaatttgatcccgaatcttaaattcctatttaaaaccaaatttattcagaatttcctaagccatccgatcatcagaaagatcctgaaaactagggcacatgaggattatctgcaaagctccagagccagtcctttaaaccggtagaatatccccaaccccgtccgtacgacccaggtgttccggtgcgggtagccaatagccaaagcccaaagagcccagcaaccgaagcggccgacgtggcgcatcctcagccgccgcctcacgccgatccaacggtggccagatcgatccgtgcaaagtatacgtggcttcgcacggacccatccatctgtgccctagtttaatcccccggggcgcgggcctaatcaacttgattaagcgccactaaccaccccctggaacgatctccccgatatttaggcggagattaacgaggcctctgtgcctcgtggggagtaattaatggcggagaaagttttggttaatcaaagagaggggggtaattagatcgatgagtggtcattaacaaacaggtgtcagcccgacacggaggagcctggtcgtgacacttgtcctccccgggatccatgttggcccatatgggtgggctctcattggccgaactgcaaaagctgatcatttcccttgtgcggaaatgtgttgttcatttttgttttgtttttgttttttttacgccttgtgagatattgtcaatatttcaagatgtactccctccgtattttaatgtatgacgctgttaactttttgataaacgtttgacctttcgtcttattcaaaaaatttatgtaattataatttattttattgtgacttgatttatcatcaaatgttctttaagcatgacataagtatttttatatttgtataaaatttttgaataagacgagtggttaaacgttggttaaaaagtcaacggcgtcatacattaaaatatgagggggtataaaatatgaaataaagaattattgtagttctagcttgggtcatgcgtgacaccatcatagtacggtagcagccgcagtagcaacagggtggattataaaggaagaagttgaatgcatttatgactctatttatcagggtttaaattatgacacatataatggaaaaattgtaaaaaccatctcaaatgtcactataagtttgagtttccccctataagacgatttgtggtaaatacacccccctctcttagttcaccttgatttgagattcccctgattgccattgctcgtccattctcgtgacaaacccccccccacatgtgttcacatgaatactaatacgggaggagttgtggtcaccactcatgttgatcaagcctaatgacacgattgtgacattcttacacatgacacgccaacaccttgttgggcagtgtgatcacgagtctccgcacttgaacatcagggttgtcgaaagatgagctactgcgcttgcctcatggggtttcgggtggctagtttcttcgaggattcaaaaacgatgaaaatgagctcagtgtgacactgtgctgctaagaaagataatgtgttcagggtcatatacatcaagagatgagctaagtcgtataacacatgagaaaagagaaaaaaaatagtgtgagcaactggggaggaatatcaaactaaggtgaactaggaggtgagtattcacaaaagatcatcttatagcggaaatcttaaactcagtgtgacatttggagtgatcttctataaatttccctaaatataaaatgtacgatcggggtttaaaaaaaatgtacaatcataaatattgtttcacctctgtatgttgatcgtgctgataagagtagtcatgagcaggggcggagacaggagtagggcagcttgggcttgcaaccctattcctagtcctaaatattcattgaaattccattttaaaactttaaaaactagaagataaaggcaaaattatatatattcaactaattgagccctaagtttagaaaaattttggctccgccactagtcatgagggtgtgcatgcacatgtatctttcgtgttatcgggcaaaaaaaaaacaatggtttagaatgtactaccaccatcctagaaagatcgcagttttgtacagtatatgtataatatttggccgttcatcttatttaattttttttataattagtaattttattgttattagatgataagatataaatagtattttatgtatgactaattttttcaaaaagaaatatatataatttttttaaataagatggacggtcaaacattagacacgaaaactcacaactggatttaaaatgggacgtagcaacaaggcagaggctgtactggccgagagtagccattgtttagttcatagtgggtgagtaaataaaaaaatgtaagtcgcaactgcaagttttaagatcattaagtcataaattaatatacattgttttccctcattaagactgagacaggaaaaaatcgatatataaccacatgttggccaatttggatggactctgattggccgtactagcgaactcactagttcctttgtggggaaatacgttatttgtcaatatctttttttccacgtcttgcgaattgcgatgtaggttcatgcatggcactacccaaatgaaaggagtagctgaccaggatgaaatacactcccaatggccaatgggcgttcgagtcaattgaccactcgattctatcgatttgttttgtccgagtaacaggaacagaacagcttgatctatcttatcgcccccatcatcccataaatggcttgattcctcaaaaccaaataacccacaaatgtctctaaaccagcaccagaacgtttggactttggagaggtccaaacctgaaacctgatggctttttcatgggtaaattgtacaaccaacgaccgacctgatcacctgaccaagtgaccatccttgatcaagctgtacagtatggagatgcacgggcttttttttcttcttcgcaaactctatctatgtacactcgaatactctcctctctccccaaattacaaacacaaaaccagacggctacgagtcggaccctgaacacagctcggcgcagcactcgtagcagccgaggcaggcgaacgccgcgcagacctgcgtcatcacgatggcgcactggtcgttcatcttgttgcaggccttgatgcagcacatgcagcagaggcagtcggcgaggcggctgcagcagccggcggccttgttgaggatctcgaacgtctccagcggcttcacgtcgccgaaacccgtgacgaggttctccctggtggcggcccggtcgccgaacccgagcttgaggcattggagcgggatccgtcgaggttcgtcggggcccttgtgacctttcagtttctgcttgacctgttcgagtaaacaggcaagttagttgggagttctgagctagcgtggttgtcacaagatccatttctcgtaaaccagtttataagcagggaccattggtattattataaaaacagtgggacttaccttttgtgctgcatctaccttctccaatgtttgaagtaggaccatgctcgtgtactctgaaggaatgctattttgaatgcttagtttcaccaccttcaaaaatcaaacgaaatggagttactgaaacccatatactgctaactgaatggaactcaaactactaaagaaagtaacatatttcaggggcaactgcaattcacaagagaatgtgacctataaagatttcaaactagttcagggaataaatgaaatggaaagcgaacatcaaaataatattcagcaccaacaaccacactagggctgagtttagttccaaactttttcttcaaacttccaacttttccatcacatgaaaacattcctacacacacaaacttccaacttttccatcacatcaaaacattcctacacacacaaacttctaacttttccatcacatcattccaatttcaaccaaacttataattttggcgtgaactaaacacaccctaaggctgtgttcggatatggggagttgggaactaaactccccgcacggaaaacggatcggtccattagcgcgtgattaagtatttactttttttttttcaaaaatggatcaatatgcttttttaaagcaacttttgtacagaaactttttgcaaaaaaacacatcgtttagtagtttgaaaaacatgcgcgcagaaaaagagaggggtgagctgggaactctgtgttcggcacaccaagttcccatctcctctccatcgtgtttcgtgcgcacgtttttcaaaccgctaaacggtgtgtgttttgcaaaaagtttctatacgaaagttgcttaaaaaaatcatattgacccatttttgaaaaaaaaagctaatacttaattaatcacgtgctaatggatcgctccgttttacgtgcgtaggagattggttcccataaagcccaagcgaactcaagcatttttcaatgtattgcccattaaatgcttaaatgcttcagacaagcaatgtgagaactttcaaacattaccgattatcttcactatatctcatgactccaaaattcagtggaggtataaagcgaagaacatgtataatgcaacccttagccaaaagcctgaaacataaactcacctttctctccagttgcttgtcagaagaaagccatgccttcgctgtgagaaggccaatctgctgtgccgccaaaacctagaaatcataaataaaaaaaatgcatatattattagtatactcgagaaatctatggccccaagtatgatattgtgcaagtttctcaatggaaagaagagaaaccaaatgtacacaatagtgagcatcttactttgtcaaggggtatatcctttatatgctgcaccttaagttcaatcgagatctctctcatgtcagccaagtaacctttagctgtaaccatatctgggaacttgcattggtatttcccagatatacataaaggactatttgatgaaatgtccggaatgtattcagaatcgatnnnnnnnnnnnnnnnnnnnnnnnnnnnnnnnnnnnnnnnnnn

SEQ ID NO: 53811 - DNA, 4951 bp, Oryza sativa
  unsure (1)..(4951): unsure at all n locations
acacaatagtgagcatcttactttgtcaaggggtatatcctttatatgctgcaccttaagttcaatcgagatctctctcatgtcagccaagtaacctttagctgtaaccatatctgggaacttgccttggtatttcccagatatacataaaggactttttgctgaaatgtctggaatgtattcagaatcgatctgaattggaggaaaggaacagtcagaagacaataaaactactgtttttttctagctactactagttacacctgcaaaaagcatacccacaaaccacccttccatacagcaaataattatttctatatacaggacaggctctttgctaggaagagcagtataagatggtatggcagcaatgaacacagcacacatacactaccagagaaaatgagttgggaaatcacaaatcaaatactgaaaaagagtcaatttcattatgaaacatgatcgcaatgcagccagaaccaccttgatggcattactcgtcttacatatccatctctacataaccaaatttacaatattgagtagttagtgatgaattaactcacttcaaattcatcaagatgtgctgtagcatcaatggagatgtttgcaactattgtactcgatgctttcctgaaccacctaagtacctgactctcaattgatcctgcaaaaacaattcaccaaaaaaaaaaggtttatgaagatgttacatggacttcataaaagtcatatttgtccaattaatgcatataatagaacagtattgcttagatatgaacttcaggaataaatccagatcaataacaataatgtattggtagaatgcccatgaaacttgagcagaggttgcaagatggagtgtcaacttaaacagcatgcagggatcataaagaaacagtgttacgtggaaaattgcaaaccaagagtacaactagctcttagattgcagagcaagaggatcccttcatagaaaacattattgccacctctaacaatatgaactgattgcagtttggtttttctattataatttggttgagataacagtatatatcgtgtgtctcaggaaaagctaagaaatccatggagaaagggtagactgtgtagatcattgttctaaccttcaagtttaaagaccaacataaaggtaagagcatactgtttgctatgatgagaacaaaagggtatangggcttggtacctgtctcaaatgcagcataataatgccccctgcctattgatgccagcatgcgcaagaaatagtggttgcaatacaaacctgttattccagtgataaaatgaaaagagcaaaaagaatatatcaggtaaactgtaagcaatcagtaacgaagtagtacaaaactaaaacagcagagtaattaaaatatggttcgtctcatcacaagctggcagcatatatcaccacactgactggtctgttgacttatggtgtaagcatttttctcttacacaagaaaggatatttggagatagagaaatacatgagcgttggtgcaaaaagtagggaggagaattttcatgtgatccaggagataagtcaagagttttgaataatgagataattgtatatttgacgctctccttaacattacctagtccaaaagtagaaatccgaggagatttagatcctctgctgatgagctccgttttcacagtttggcatatattatgttcatcatcaactgatccatcagtcataagaaagatttgtggaagcacatcatgagcacttgacaatgatgccattgcctttcatgaaaaaaaaaagtgagagtattaacagtaatagaataaaaaataatactacatatgcatctattcacaatcgagatttaatattcaataatacctcattcaaaggatgcataatatctgtaccaccaccagcaacaaagtttaagtttatccagtcaagtgcacttgctattgatttctcatttactttctccaaacacgatgagaatgagtgcagctcatcattaaatgttataatgttgaagtaatctccttctgtgagttctgacagagcagtagacatcgcattcttcacattctcaagcggatgtccttgcatgcttccacttgtatcaatgacaaacacaactgcttttctgaagacctattgaattgctcaggtgagatataggaacaaggagagagattttgtgaaacacagaagaaggaaaaagggaatgtacttctgtgtcaataaaccaaaagtgctatgaacaaggccacctcagtaacatccttatttactataactttaatgatttacaatcgcaaaatatcctgatagtatttgctaaaagaagtccagattgtagtttgcacatagctagtggaatttcactagaaaaagatcaccaaatggcagtttagaatggtgggtttgttgattggttctataaaaaagtagttctacattagcttcatcagaaaggtttctgctagaggccctcttctaaatataaaagttttgtcaactgcagatatctcactcaaggaagatatgcttaaataaataaaaataaaaactatgggacgaaaccccgcaaaagtaagagcaactaacctttctgttgccacctccaggtaaaagaaatatgcagaacctatctctatcatcataatcacgcaatgtcgatggttgaacaagcacaccaccagataagtcaccagaataacctataggaatgaacataaatcagacaaatctgaacatatatttagctattgcagttttgaaacagtaaacagttctcgagccagatttcagttacatctgcaactaacatatgctcacaaaaaaagaaaaatttgagaagtcttggaaagtcagattatcacaggaactagtgagctcataactacttaaagaagtgactaccgattacagctaataaagagatcacaaaagggaaactcacactgtatgaaaaattgaaatctttgcttgaccaattctcaacagttgcttcatgccggaaagacaacttctcaccctgcctacctttttcctgaaatagtaagggaaactcttttgaagattaaatgttgtaaaagcactgatgccaattgcccggaaatcaaaagagttctagcaaaaaaaaatgattaccttcaatgggtggcttgttccctgcagtaaaacctctttactgaaaccactattcacagtcaactgaattttctcccttttcatgaatacttttggcaatgggttaacataatatggaaaacggaacggtatgtccactgagaatcgtccattgtcatagtgtagcttctgagaccatctgattgtggcagaaatatccgccccaccctcaatctttatcggcaagatggcaatgaatcttcaaagtaagactccaattccaaaagttcaaagaagagaacaaaagacagttctgcatttagcatgtacctgtgatattgtcaaataaaataattggggtttcaagagtccgccactatcagcttttggagcattctctgtagtgtgatcttctacttcaattacttgagtattatatgatcttcttccaacggtaacctcggctcctagaattgaaccctattagccaaaccgttcataggttgagaacaagacaaacatggaaattaatgcaactcatataacataattaaacataatatactagtagatgcctaatgttcatttaatggtgatgtttcctacggatggaaagtagaatcagatgtttcaaaatatcaaatattagtgtatgtgagttatttattacaaatttccaagttgttgttaatcaacttcgctaggcaagataacaaccacccaacaccaatgaataatatgctatagtcatccaagacaaataacttcaccaccgaattatctccattctgcaagccattatattctacaaccagacataaaaggagcaatggagcatcatgtgtacttctagatgctgaagtaaagaacaagctatacaatatgtttccaaatgacacgaagcaacatatttcagtacacatcaacatatttcttcttcctagctgcctcatttttgatacacaagccaggttaccactctgctaaaccagcacattccttcttgtgtttgatttccataggacaaagcaaggaattactttcacttgcttatgccactttttactgaaaattgctcttgtaatataaccaaaggcatccatttagtcagctggaattcataaactagttataaagaaagtacagaatttagtgcagagcacgccatgatttgcggtcaaccacctcaagacaactcaatcaaacgaaccatatgaacaaaaaaaaaaaagagaacatattccacttggacaaacactgggttaagcaaacacctgaataatgttgccaccaaccattccaacagcacagtcaacaataaggtacaaaaccaacaaagcatccatgtgaagaaaacaatagaactaacggctcaatggagaatcaaaactgcaaatcgagaggcacatatacatgccgcaaaaacaaatccaacaaattcatggttcccaactatgtaataacactagccaaacagccggaatcatacatagcacagcaccaatcatttcgaacctcaccaaaccaaatctacgaggcaggagaagggaacaacacagctacactagggggtaaaacaaaaaaaatcgccaaaatgtgatccgatcgagatttacctggtcgcccatgggcacgacgatgcggacgtcgcagtcgcggctgcgggtgatgcagtgcagccaccaccgcgcgcggacggtgacagcggcctcgccgagcgcgcagtcgacggacaggtcgacctccttcatctggagcgggatcagcgcgggggggtcgaggcggccgtacacgtatggctggtagctgggcacgtcgggggtgtcg

SEQ ID NO: 53812 - DNA, 1107 bp, Oryza sativa
  unsure (1)..(1107): unsure at all n locations
tctacgtatttatattcattcattaggtctattcgttatttgtgtataggagtaaatggacatggatacacgcatccatacacacaagtattatagctcacatgtaatatcttgatttgctattggctagaaaatagtggggatggtgtatgtatcgagtttgttatatattatgagagagttattagttttcgttggttttagtgtacctatgaaatatttagatcaatttaaaatggagggaggatcatctttggagaagttgaggttagacgtggctcaatcacgacagccggccgtaataatctcatcgaagacaactcgccgacgagggaaacgacgttaaccataacgttgacgacgttgataccgtgaaaatgaaaataatattttaaagatctatttataaaaaaaaatttgaaaaaaactacaatgtgaaaaatactccgcgggcggtgagcggagtctcggacgacatcgcggcgcttccaaagaaaaggagcaacgtatacacgcggtcaaaacacagctgcggaaaaaggccctgggccccactttgtgggccccgctcccccgggccggccacgcgcgtcaagcacgcgccacgtggcctccaaagggacgacgacgcgcgggagatccgatcgtgacggctcgtttcggcttcgacggtcgggatctccgtctcgccgtcggcaacgcggcgtaacggctagttttgtgtcgttttctggggggaccgctccaggagccgtgcgtgtggtgtgaactccgcaagtccgttatacaggagtacgtacgtcgcgccatcaccagctgtgaccgcctggcgcccggtgaacggttttgaaacacgttctcgcttgttttttttaatggtgcgaagttctattgagcaggaaaaaattactccctccgtttcaaaatatttggcaccgttgaccttttagtacgtgtttgaccattcgtcttattaaaaaaacaattatttattcatatcatttgatttaaagcctcatcgtttggcatattttctgaatatgtcaaatgacatattttgcaaacgaannnnnnnnnnnnnnnnnnnnnnnnnnnnnnnnnnnnnnn

SEQ ID NO: 53813 - DNA, 2838 bp, Oryza sativa
ctcttcgccggctttagcgtacacgccagagtccgtcctcagtatgatcttggcgtcctgcgtgacgtagcacgcccagttgtccacgtaggacagcggcccggccctgatcagcggccgcgtgtcctccacgtcatcgtcctcgtcattgtgctccgtgtcatcctcacactcctccctcagtaggcgaacctgcttgacacaccacacgcacacacccacgagtcggtaaacttttgttcatattgatataagatgatgggctgtagtaatggtgagcagtagtagcatgtacctcattgaattttgtgagggcgtccataggatgcagatggtgcagaggaggaagaaggagatgagctcccacaccgcggggattacccacgccactcgccaccgctcgttgtgctcatcagtcgtcttaaaatggacctgaattttgattttagaatttttttcatacattattttgaagtgctaaaagtcttcttatgttaattaatttacgagcttgtactaatgtaccacatgaacagttagtgtcatgacgataaaagtcaccagtaatgtggacgaaaacaactaaggttgtgtttagttccacgcaaaattggaagtttaaagaaattagaatgatgtaacggaaaagttgaaagtttatgtgtgtaggaaagtttgatgtgacggaaaagttggaagtttaaataaatgagttgaaacagggcctaagaaaatgattagtcatttatgagagcaaaaacaaatgctgaaatgttcaggccctgtttagatgagactaaaacttttaaatccctatcacatcaaatgtttttggacactaataataaatattaaacgtagactattaataaaacccatccataatcttggactaattcgcgagacgaatctattgagcctaattaatccatgattagcccatgtgatgctacagtaaacattatctaattatagattaattaagcttaaaaaatttgtctcacgaattaactttcatttatgtaattagatttgtaagaagactatatttaatactctaaattagtattaaatataaagttaagtccctggatcctcagttctctgaagttgctgagccatcagaaaacagctaggactgcagcgaagttatacctcaaatgtgatccagccgagcgacagggccacggcgatggtgagagaattcgcgaatttccgatacatttcaagcttcgccgtcatcctcctcgcctgcaagaatcagattaatcacagaattcattgatgattctcgaagaattattcgaattttggtagaattttgaaagtgggaagttcaaatgatgctaccttgagcttgctgatagttcttgacagcgaggtgaagatccagtagatgaacaccgtgttgagggcggcgacggggagaatgaaaaaaagcctcctcgccggcgagtggtcactgacgatgccgacgttgtcgccgacgtcgagcacctccgccgcggcgaggaacgcggcgccgagggcggccaccctggcgttgccgcagcccagtgcgggcctcgtcacgccgtaccccatggccacgagcagcgccagcacgcggcacgccgcggcgcgcacggcgcccgacgtcgccgcccagaacgtcgtccccgccggccggacgcccgacgcgtcgaactcggcgaggtcgaggtaccaggtggtgaccttcaccatgcccagcgcgatggccgccgtcgcgaagttctgcagcggcgacacctcgcgccagaacctcgcgtaccgggcgaaccagagcgcggcgagcgcggcgaacgccaacgacattggcgccgtataacggcttgagcggcgccatcctccccgggaggtagccgcggctgttcttccagatggtcttcccctccgcggccaccacctgcccggcggcgagcgacgcgtcgcagtggacgaagtggaggctgtacatcccggtgcgcgccacggcgacggtctcgtcggggaacgccgcgacgaggctgcccgggaggaacgacgcggcgagcaccttgggccagcggccggtggcgttcgacgacgcgggggcgcggtacacgaccgccccctccgtgcacccgcctcgcctcgccatgcccggcgtgcagcacagcgcgcgctcgccgccgacgacgtcggacaccgccccgacggcgtcgcggtcgccggcctcgaagatgaccgccgccaccgtgaccgtccggttgccgtcctcctccgccaccgacgccgcctccggcgtcctcctgaacgccaccttctcgaatctgcaccaagaaacccccccatggcgagcgcgtcacatcccaagaaccaattcaaacaacgaagcaatgacacttggcacccacaaccagctccggccaccgtaccggacgaacgactccgccgtggccgacgcgtagacaccctcgctgccgccgtgcagcacgaagccattgccgacgccggcgaacctctcgccggcgtactcatgcaccgacgcctccgcacaaacgacggcgcaagaaacgaccaccaccgccaccgccgcgccggcgaggaggagccgccttatcgaaggcatcactgacatcgccggagacgggagactgctgctaccaccaccgccgccgcggcagcatcggcggcggcgtggagtagaaatacgagaggtggagggatcccgagaagtggagggagaacggaagagacgactttgacgttgggaggcaaccatgaattttgttaggtccacccccttaacttcagaggaaaagaaaaagaaaaaaatacagagaatccattgcaata

SEQ ID NO: 53814 - DNA, 7288 bp, Oryza sativa
acaaagatttcgagggaaatatcattctctaaatcaagtaagaatacacatagttatgatattatcggactaaggagaaaaaagaaccatgaccaaaacgcctattgttttaaaacgattttctaacctaaaaccgaagtggtaatataggttgtagctcaacattacaagggttatgtgggcaaatgtttggtaccttgagcagataaacatcgctcctgggtggagaagacctaggggtttgagaagagcagtgatattgtgacaagtttccttaattcctcttgctttgtttagtggcagttttacttgtggactaagggatgaccgtgagcttgtaatgccagagctgaagttgaggttttagtgacgtgccactggggttttagcggtttgaaagccacgtgtgtgtcctctcctgattacacttacaccatcactttcttggtcatgtcaagtcaacgacgatgttaattaccgcaataagaacaaatctaatactcctccgtcccaaaatataaacattcttagcatagtgacgagtcaaatgtttttaattttaactattaacagcaaaaaaataaaaaaaaatcaatcatgtaaaattgatattagtagatttatcattagaaaaactatcataatatttaactttttttatttaaaacatcttacttttatagatattgttggttaaaatagcatctcagagaccgtgttagagtaaaaaaaaatgcttatattttaggatggagggagtagttatctacattcactctaatagcttagtcatataataaatttataaatatatattttactatcaatatttgatcacctcgcatacacacgtaaatacatgatatattgaaatccgtgtgtcacagctgactatatctatagctcgtttttctcctctctacgcttatctcttcttgacatttacttgtagctaacatatagcctgttgtcttaaaaaaaacatatagcctgtatttgctacgcgttgttatatttctaccggtaccactgccctgagttcttgatttgtagcataaggtacaatatttttttcccataaacgtgatcattgaagaagaaaaaaaagggatattgcagatgtgctgactgagctaattaagaataagatattcaggcataaaccaagttagctagtgacttttgcatgcatttgacatgcataagtccactagcaaatatctgcagccaaaaatcatcctaatcctaataatcaaccaaaaaagtccaaaacaaaaggaaaaggtcaaaaggtactcatcgcaagcctgcaacaagtcgcacagcaagacagaaactcacaccagttgggcaggaaaccacatgaccgtgtgtactgcatgccccgtttggctcacaacctaaccaccagcacacgcctaattagtttaatcaataattaccttaccttgtttttgctttcagaattaagtgatcgtctcgtctaagcttcatgacctttacgcatccgatcgagtgacaagagatcaattggagtagttataaataagcgtgagtattataattaggagaagttttactggtgtttttatttcaaaaataaaaaaaaatcaacggtctaaaatagaagtattatataagggtatttaagtatcgatctaacagatgacatggtgaagggtgtcgacaaataaccatattttactgttgattaccctgttgtcattatttactgtaattttattttaaaaatggaggattttcccatataactatataaaccgatgttcaatgaccgaacgaaaatgggaaaagtttcaaaaaggaaaaaaacttttcgccttcaaccgggcctaattcaaaacagcccaactattttgcctctgtttttttacgtgatttttcaaatgttcaatttcaaaaaaaaaaggtcaagttcaagcttgacatgaattttgaccttgtttttacatgcattttaaaatggaaactgaagttcaaaacataggggagaaagcaatagcctagcaaacaaaaccattttccccctccaattggacctaatttgaaacaacacccaattgaaaatggaatatgtctactttgactcccttaactagtgtcttaacctaatttgtatctttaaaccgtaatagcggatattttgacccccaactattaaaactggtgtaatttgtctccctcaacggttttggaggactgttcactatcatggagcatacgtggcggtgttgtaagcgtctgtcgaggagtgatcctctctagcaggagatcgtgagacccccctttcgtgagttcggccggggaagaagctcgcctctagaaatcgcgtatccgtccccaaggctcctagctagctcgcacacaaccaaattatacaggttcgggccgctatgaagcgtaataccctactcctgtgtatgggatttagactgagagttacaatggttcctaaactcgggagaacactcttacttccctcctccacaagctcaggttttctgagagtcgtcctctttctcggtgggtaaggtcctccttttatacctcaaggggataccacatgcaccgcttctacctactcttttttcgggaggggacccaccatatcttgactggaactcgacccgtgccttcgcctggaagctaaaccatagcttgtccttgagcggggcccagcaccgtccctcgcctgacacgggggacagccctgtcattccctcattaataggtgaagacttgtggtggccgccgtccgaatgaccccccgacgggacgggccatacctacctccactccaccggaagcagatgtgacgtgggagcacggttgtccatccagtcagacgtgaccggcgtcaggccggtcacagaccggtcattcttgaccatcgcgcgtcagtttagcacgccgcacgtctgccccactgcattaaatgtgacatggggcagttgaggcgctgtgcggattaaaggaagttcagcctggggcccctcctcgcttgctccccccgccaaacggcggctgggcgagggcctcggggcaaagcagtgcaagggcccgaggggcatgacgtggcaccccgaggccccgacaccccggccgctcctgcggttcgtggaatgcggggacaggaccatgctgtagggacacgtggtaggatggaaaggtagattcccctcacttcgcatacccccgggcccatatctccgacagtttagggcttagggtttaatagttggagagtcgagatatccggtactgcgattcaagcatacgaatcagattcggcccaataatccagatgccaataggacggcccatcaatccagatgcaatacgacggcccatcagatcccgtccccgagaaggaatccccctcaccgttggatccgatccgacggctgagaccagccacacaaaccctcaatatatattcgctcgccccccgctgcgtctcgccgctcctacaccgcgccgtcgccagcagccgccgccgctgcctctcctcctcctcccctcgccgccgatccaatccggtaagcctcgccgccgcaagctccccctcgtccctcccccggatagttcgtcgcctcgtcaggcatctcgccgatttggcgccgttctgttgttctgtttggtggagccgtgcgcgagatttccggtgtttgttgacctgtttagctctgatggattcaccttgtgttagttagttttccgtcgaatggtgtggcgattaggtttggggggattggttcgtctgtgattttgtagctagattttttgaaatctagggtagtgtgagtggggaagctgctggccttagtggatacatgctgttcgtggtctcctggttcttgaaatcatgatgagttagtgctgtttgaaccttgaagcaaagttttaagttattggagttcctgtgcttagatttgtatactattagtgaagagatgcatagctgtactgctgtagtggatataggagtgttgtttttgatttgctggtgctcttccatagcatccggatgcggtgttcaattgtgtagttgtttatgtagttcaatgcactagaagcttttatttctgaatgcctagttattagttgggtatgaagtccaatgtgtgaaatgctgtcatgtttcaacttttagttaagatatgaaacttgagaaacaaatgaaaggtttagattcagtactgatgtacaacttaagtaacatctatggttgtaaattgtaccatgcattggttattgtgaattagctcttttggttgattgaaacaattctctatgtgccaacaggtcactttcagtcttttttcttgagggggagatggcggtttctttcaccaacgttagctcagaggcaggcctcaaaaagctcgatgagtaccttctcactcgcagctacatctctgggtatatgatcagtgtccactgtccaccttattttctgaattgccatttatgttcactggacttaaacccttcaattatctgtttccaggtaccaagcctccaacgatgacttggctgtgtactctgcattttcaactgcgccctcttcaagctataccaatgttgctaggtggtttactcacattgatgcactcctacgtctgaggtatgcatttttcccctttttttattctcttacattttatgttcagtgttgtgaattttctgaatgttgtatttcagtggagttactgctgatggtcaaggcgtaaaggtcgagtcgacagctgttccttcagcttcaacccctgatgttgctgatgcaaaggtcatacaaccctagccttgtcttgtttgcctgaaatctgtgaagtgttctagcatagtactgtgaattgtgatttgatgctgtttgcaaattacgtttttgtggttcaatggtgctggttaccatctctaatatatcatcatatcttctaatttcaggctcctgcagctgatgatgacgatgatgacgatgttgacctttttggtgaggagactgaagaggagaagaaggcagctgaggagcgtgctgctgctgtcaaggcttctggcaagaagaaggaatgtatgccatcctgcattatactataccatttttatgcaatgaataatacaattattcattttattttattctcatctgtagctgtaaattaagaccaaatcatcactattcattataatgcaaagtgctacttctaacttgtcaacacctttttattcagctgggaagtcctcagtgttgcttgatgtcaaaccatgggacgatgagactgacatgaccaaattggaagaagctgtgaggaatgttaagatggaaggcctcctttggggcgcatgtatgttactacattaaatttcttcctacgaatgtactgtcttttgcttttgctagtttggttagattgtgacatgaatatataccactgtttgcagccaagcttgtcccggttggttacggtatcaagaaattgcaaatcatgatgaccattgtcgatgatcttgtgtcggttgatagtctgattgaggactacttctacaccgaaccagcgaatgagtacatccagagctgcgacattgttgcgttcaacaagatctgtaagttattccataagtatcagagcccgtcgttttatttgctagcgttgttcttgttattatactgaagcaatcggatgaccagctgtcttattttaaggaatcgatcctatattattctttaaatgatgatgcatgccatatatattattctgtaaatgataatgtcctgatgtttcatatctagatacctcatttgctgcacattactctctttattcagtaggcttagatacctgatttgctgcatattactctctttattcagcaagttgctcatatctagatatctcatttgcagcacatcaatttgatttcatatggtcatgtaaatttcatctgccttgagccatccttgttcagaactaatgttttgattatgttttattgcagagatcttccttgagtcaggtgatggcgatcggtgcacaaagataaaaagaaaaatccggaagtttgaattaccgttgatacttcaatctagaagtttgaattaccattgatgtgtcgttcgtggtgtcaactagtacttgagcccgttttgtgttgagattgtagcactctacttctactgagatcgttttctcctcctttaatgtttaaagaccaatcaggttattattactgtgtctgcctgtgtcaccatagcggcattgttggtcgatccagttttgatgcggtcttcaattctcccgtctttcgctttgcttgattgcttcatcgcttttgcggctaaagtttttctgctcctaccaaaactgtaggggaaactttggttgtgctgtttgttctatctcttatgcattgcacagcctggttttttcgctcttctgaagtatagccctgtgcgctctcatcaggcctgtcctgaaatacgtgatttccgttcggtatcgatgttcggtttgtcacacatatcttctactttcttttctgtaatgaagagcattgtctactgttatcacttatcaggttcgaattggtgaattcacagctgagtgttggtgcatatatcacgatcaaagtaacaattatcatggcaaaataggtggtttcacctctcggtatcggttttcttccattggcatccctgactcgtggctcgtgggctggcattgctgaagcagcacttaggcaacatgcgataaataaagtttctcttcacaatcctcttgaaagctgctcaaggaatattcagcttacgataagcacatccgatctttgacctacataggcagcatatgatcctgagcagtaaaatttcctgcttcacctagtaaccttcactctttccattaattctttgtcagtctaccctggaaatcctcgactagtgtctactaggcactagctagtcaactgctagttcccagagggatacagcaatatctgagtgattcaccgcagatatgtcacccatcagaagttgaccatcatcagttactaagagcacccgcaatggtaaagtaaggtgctatctataaaacatgtacatctcagcaatagactcgattaatagtaaaccaccttaatagtatgtctacattggtatctatagctctctcatgcattgtctcgtttttctctatagactatctctaagttagtagatagctttgctctctctcttcatttaatacattccaagtaggaaaatatgctg

SEQ ID NO: 53815 - DNA, 3746 bp, Oryza sativa
  unsure (1)..(3746): unsure at all n locations
nnnnnnnnnnnnnnnnnnnnnnnnnnnnnnnnnnnnnnnnnnnnnnnnnnnnnnnnnnnnntcagcaaatcctcttggtcgcgcgaagtacgaaccactattctgcattccggacatctcctgtttggctgtctccatggcattagcggttcttcctcctcaccttgctgcgattatctccgtcccagcctctgaatgattgttaatccaaaccgataggtttaaatggcagaagcaatgctttgtcttcaactgttatcgtcgcctattgacgcttctggagcatgttctgtagttctaggatattaaggtcaccttaaatactaaaaaatggtttgcaaaattaaatgtgccaatgaatcgtagaacaaacaattaaaactgctacatgactgtggagtaccattgtttttaaggtggttttagaagatacaattatagctaatttgcgaacagaagcaaaaaagacgctttggccgagtggttaaggcgtgtgcctgctaagtacatggggtctccccgcgagagttcgaatctctcaggcgtcgttaattttttttcctttttttattttctcctgtttatatttttgtgttagccttttcctgtttgcattttttttggggtgagatttcagaggttaatgctcgtctagacgtctactctgtcgatgtgagactgacttgtgatcatctgttaaattgttgatccttgtgggatgtcaatgtgacgattttttgtgatcatctattaaactgtcaatccttgtgggatgtctgctatttctgtgaagtgctcccgaccccaatagatgattgatcggtgttcggtggtgggggttgggaatcatcacccacgcacgaaaaatggagtgatttattagcgcgtggttaattaagtattagctattttttttttaaaaaaattgatcaatatactccatccattccaaattaatctacatatttcataggtataccaagaccaagaaaagctaataactctctcatactatatttactctagcaacaaactcaatgcatgcaccatccccaatatttcctagccaataataaatcaaggtattgtatatgtgttataaatacttgtgtgcatggaatgcatgcatcaatgtccatttactccaatgcacaaataacgaatagactctaataaataaacacaaatgtgtagatcatttaggaataacctcaaaaaaaactatatgtagatcgatggaatggagggagtaatattttaagcaactttcgtatataattttttttgcaaaacacacgacatttagtagtttgaaaagcgtgcgcacgaaaaacgagaggggagttgggaacggctggtatcgaaaacagcgagtcatttatcgtaactcacgaacttaaatcaaacggttaagattttcctttaaaacatctctagcacttctcacttcatatggttctcacagaagaagaaacaaagagtagaaaataaaagagtcatttatcgtaactcccacgaacttaaatcaaacggttaagattttcctttaaagcatctctagcacttctcacttcatatggttctcacagaagaagaaacaaagagtagaaaataaaaaaagaaaacaaaaattaacgacgcctgagagattcgaactctcgcggggaaaccccatgtacttagcaggcacacgccttaaccactcggccaaagcgtcgcttgtgaatgcggaaagcaacaaattttacttgtttccatccaaccatgcatatacccgagcctcgaatttcatttttacctctcccgctcaaggggacgggagtttgatccgtcactctagatcctgacctaatggacaccggcgccgaccaggcaccacctcctcctcctcctccccctgtggcggccgcctccgccgccgccgacgagccgcgggacctgcgcgtggtgcgggagatcctccactcgctggggctccgggagggggactacgaggaggcggccgtgcacaagctcctgcttttcgcccaccgctacgccggcgacgtgctcggcgaggcgaaggggtacgccggccccgcccggagggagtcgctccaggcagacgacgtccgcctcgccatgcagggcaggggcatgtcttccgccgcgccgccgagccgtgaggtaattgatttgagcccgaagcccctcttcgcttttgtggaattttttttcgccggtgttgtttgctgcggaggacatcgaattttccatcgtcggttgcgaaatcgtcaggactgcgtggtttttggggttggatcttgcggttttgtgtccaaatcggagccttttagtcttaggaataggtgaatttctgcaaaaacggaatccttttgccttcggatcaggggatttgtgctatcaaggcagctcactaaccctttagcctttggatcagtgtatgttatacagatacgccatttgtagactaagacccctttaattctaaggatttattgagaaacttcataacatttgaaaaaaaaaacatgttacaaaagcagacactcattcacccctatgaacacaaaacctatccttatgaacaccccctaaaagactgaaccggcatgtgttgtgattcatgaagtcaccacaaagatgtctcgctatcaatggatatgttgcctatcaatgaaagaataattaatcataaatgcaagcacatgtaagtctagaacttgaacctgggtaggctgattccaccacaagaacctaaccagttgagctacgctcactttgctcctatttggccctttgatataaaggattggagctttttaaatcctataaaattcctatggaatgacttattacatatagattttgaaaaaaattagcaagatctcatatctcttggaaaattttcttcgagtctatttctctcttctgatacatgcatttttttcttgtggtttataaatcaaatgactattcctgtctgttttcctgtgctttatactttcattcctatcaaatttcgtgcttttcctattctccgttttttaatccaatgtttcaaaggagctttaataggtgtggatggtatacttttttggcaagaagatgatataactaaattaatgctgacaagattttttctttaaaatacttgagcttctaaccctacttaattgtcgagtgctctccaaaattcacaaagccgcaataccaaattggaaaccgctctttagcagttttcttggtttttgtgaaaaattgataaagaaatgatgaaattcagatatatttcatttaaaattggaaattcacttggttttctatttgactggttaacaaagctgttttgttaactcaagccagttcaaaacctcaaaattgcatgaaaatcaagcagtttttgttggttttgtaaaccgtgttggtcccttttattaaattttaatgtttctttactcactaggaagctcttcttttgagagcgtaggctagttcctctaaggttagttacaaggtggtgataggcatgtgaatattggataagcaagtcgatggcattgtctaaggaggaaatggtgtataaggcgacccaatggagaggaggatgaggttggaatgtggtagaggaggtcgggatacaaagaagtaggtaatagttccaactgaggatatgatgaatgggttttatggtggtgaagaagtatgcggcggaatctttgggcagcaggatgtgggagatagga

SEQ ID NO: 53816 - DNA, 1520 bp, Oryza sativa
taatgtttctttactcactaggaagctcttcttttgagagcgtaggctagttcctctaaggttagttacaaggtggtgataggcatgtgaatattggataagcaagtcgatggcattgtctaaggaggaaatggtgtataaggcgacccaatggagaggaggatgaggttggaatgtggtagaggaggtcgggatacaaagaagtaggtaatagttccaactgaggatatgatgaatgggttttatggtggtgaagaagtatgcggcggaatctttgggcagcaggatgtgggagataggatcacacttgggttggaggaggttgatgtttgtggcaaaaaaaaggagcattgaatgtggctctggtagcaaaagaagaagatcaatcacaagcataggtaatttgatggcatcaatcaatgtaaaaaaaagataaaatagcatatgagagggcaaaataaggaagtgaagctagaaaataagtgcaacaaaaggagaggcaattttttacaatggaaaataaggggcacggtcaattatagaggaaaaaataactctatattacttatcttttttttaattcataaacttcataagtagagctaaaaatatgatatgatgttttgggggttatatatgatgttttttagccaaccatacattgtcatgtcaatcctagaagtctcttatctattcttgttcaaattgaattattttgcaacgtagaaatgctcggttgggcctatacaaggtcgagaaagtgacctaaactagccaccctaacatttctattatattatgcaacaaaatcatcttaagacaagttgtttttttcccaataagccagcccattaagggctttttgtgggtctattcttaaggaattttataagatcctatgttcaatcattatttaattggttgctataacgtccatatacacatgaaaaaattgtcgtaacatgacggatatcttcactttggacaggagatgcttgatatagcacataaatgcaatgaaattccaatacccaagccttgtgttccttctggatcaatctctcttccacattatgaggatatgctattgaacaaaaaacacatatttgttcctcgagtcgagccaacaccccatcaaattgaggaaactgaagatgattataatgatgatggttccaatgctaatgttgcctctcccaattccaattatgaccaagatctttttggatcgatctctcttccacactatcaagacatgttattgaaccaaaaccacctatctgttcatcgagtggagccggcacatgatcaacttgagaaaatcaaagatgatggttccaatgacaatgctgactcttctcattccaattatgtccaagattcttctggatcagtgtctcttcaacatcatcaggatatgtcattgaaccaaaaccacctatttgttcatcaagtagagctgacgcttgatcaaattgaggaaattaaagatgatggttctaatgacaatgttgactctc

SEQ ID NO: 53817 - DNA, 993 bp, Oryza sativa
atagcatgttttgcttgtgtgtttgtttgtcgcgtagatttcggccgtttcgtcgatccgctgtttctcgaagacgttgctgaggtctcatcagtgcgagagcaaggcaagtcatgcattacaattgatcatattgtacccaatttacaaatatcccgcatttctattaaatgtcgcatacttttacaatgtcatgtgagatgggtcctattactcagccatttattgttcatatgccattgataactttggtatcaaaatgattagatgttggtttaggaaatacttagccatgcttagctcaactagtacacaaatggggatcacattattacatagactctgactatgagcatagttttggattggtgccaccgcaatggtgttagttaattaaaatacaccgaatggtgggttgtgggtgcatggttttgctggtcgcacccatggcaattaaggaccggttcacgggaaaccctgggagacttaccgtgcttaccacaagcgggagtgggtaactgcttgatctgaagtatagctcgaccctttcataggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattccaatagccgtgcccgcggttatgggcgatcaaccaggttcaccgtgattagtctcacccctagtttagcttaatgaactggtgtatttcaggtggttggttgggcatgttgcaacgtggtgtagcgttggacagtgattggttaatattgattaatt

SEQ ID NO: 53818 - DNA, 931 bp, Oryza sativa
tttctaaaaaaacgttctgattcgctcatatgccaaatctttggttctgtatatggcaagtgcctcaagtattaatgcttgatcttactgtgtctggatgctgtccttttttagggatttaatgaacggcttgtgatgggaagcaggccgacacttggcgttatgttcaagaaggtacattctgtcattctccattccacgtatatatatgctttttaattatcatatatgtgcataatttccatttttcgtatgtgatttttttttcgtattgttctcagacccttgatgtagttttgcaagtcctcatctcatttcctaatgtgaagcccctgcgatctaaggtaagtaactgttatcaacatcttttgcaatttactgcttggatgattaaccaatttgtaacttatgcaatgctgaaatacagatcatatcatttctccaccgtatggttgagatattaggcatttcggtgcttccatgtattccaattgcactgcgacagttgctcgttgataatgaggtatttcatgtccctgtttcctggttattggttttgcaagctattgcgatctctaatagtaactgtagcacctgtgttccctttttcggtaactgtcctgttttagctgtatttctctgaggaataataacggcaggactttggaaactatcgtactttgtaatgtttcttttatatacttatacaacaaaaaggtgcctctgttgttaatcataccatcaaaattatttcagccattggatcatagtattaaccattaaattagatcgatgttctgttctacaaggaccgctttagggccatacagtggattggcccagttagactccacatctcacttttccccctctttggcccatccctttgagcggacaatgtccactttatggactctaataataatttagt

SEQ ID NO: 53819 - DNA, 1029 bp, Oryza sativa
actatagggcgaattcgagctcggtaccctgtttttctagtacctgttgaactgcatattactatttgatgcaacatcaaattagtaccttattatttctctaaaaacaatattgtcgtacatataattctattttgcggcccttgctgacatcatctttttacaggcaaaagatatgtcggaatttctgtacttaataaaccaaataatatgcaagtttaaatcttcagcaaatgccttattggaggatgtgtttcctgccatcgcaagtcatttatctgtgatactatcacacgatgccttttcaaatggttttgcaagcaatactgaggtaaattgaattggtaaataagacccactatattactgcattaatttgtgtgttaaccaattagtttaatgttgttttctctaagcattttgttttgttgttagtcactaaatatcatggctgttaaggcgtcgctatggcatcgctatagtgctagggcaccctgagggggtcaaggcatccctccgccttagggcttaatgcagagagggagagggagaggtgaaggcggcagcaactacacccttttcccttttctctgctccatgtcatcaccattttgctcccccttagctctggtttccactctcttctctcccctgcgccagattcatcttgactcaagggagcagccgccagatccatccaagggaaggagcacatacagagagaagcacttgattcattctgaatcagggggaagggagcacagatagaggaatagagctagcatgattaagaagagccggtgcgaggaagaagcgatagagccgtgaggaagaaacgacatcgggggcggcgctgtgagaggagagacacacctggtgcgggtgttagggttatttctttgtctttgggctggtatgaaggatattgggcttttgtgggctggcctgctaggctggttttcttctgatcgctgctaaccacataggttatggcatcgccatgccttagcgttttactgctatagctta

SEQ ID NO: 53820 - DNA, 4708 bp, Oryza sativa
  unsure (1)..(4708): unsure at all n locations
nnnnnnnnnnnnnnnnnnnnnnnnnnnnnnnnnnnnnnnnnnnnnnnnnnnnnnnnnnnnnnnnnnnnnnnnnnnttggggacaatgtcaaattggcgtacttcatccaagaaaagaaaggcttcactaatcagcccttctttcatgaagccgtcaactagaatagtgcatgtaatgatattggggtttatcttgttgtcaagcattagttcaaataaccccaatgcttctttaaggtatctatgtctacaaaatgcatatataagactagtgtaattgtaaacatctggaacaaaattatggttaaccatgtcaatccaaagaccataggcaacctctatatccatatgtcggcaacaaccatgaagaacaatgctgtaagtaatttggtcatgcttgaaaccttgatatttgagacgttcgaaaagttcaagggcctcctcaacttttccagctttgcaaagaccatgcagaagtgaactgtaaatgacaagagtaggactgactctgtttctttccatttcatcaagcaaattagagcctaatgatagagcaccttgtttgcaaagcgcatcaactaatatgctgtagctatggacatctgggacaaccccacctttcttcatctcatcaaatacctccatggctttgtgaacctgattatcgttacagaaaccatgaatcactgcattaaaacaatagctgttgcaagggtagcctctctgccgaagcacttgaagaaagtcccatgcagattcgacttgtttggcacggcaaagtccataaaggtaggttccgtaggttgccgcagtcggcttcacgcctctgattttcatttcacaaagaagatcaaaagcttcctccaaacatggtttatcaccatgtgtatacatactcatcaaaactgaataagagtagacatttggtgagggaccagtgctcttcatatcatcaaacaaactcctcgcatacatgaactgattcctcttgactaaggacttcagcaagaagttgcaaagctgaagctcaactccaatcttcttggcctcgatgtaggtgacaagagcatcctcaaacattgacaactctataaaaacccgtatgagcgcagcataaacttgaagcaatgttatcgatccacccaaattgttcaccagcataagtgccaactcaaacaactccggaccagcatttccacagtaattgacaatgctctgaatcaagcaccggacctctatgactctccgaggcaagaatgactgtataagcaatgcaaacaacccaattgactgggaaaggccatataacctctcacactccctgaagcttatctttcttgcgccgtcccagtttgaagtccgcactgctagtgtgatcaagggaagaaggcactgacgtctataatcaccagaaatggtactctgagtgggctcttgatgatccaggttgttcaagcaacaagccagtgaagtaaatcgcgacgcctgtgggtggtttctggttatgagggctcgacgcaggaaccctggcactgccctgtgcatagacaagggacgcccaatcccctccttacattgacaggatatgagcaggaagaagatcctacacagaaattacacttcatggaccaggcctccgagaaagaattcgcccaggtttacaaatttgaatcaaatctcctgcaaagagaacaaaaacacaaaatcatatcgctataacaataccagtcaagctctcacttgaagcaaagaaataatttaaaaaaagaaataataaaatttgtgtgttccagagaatcccctggtcagtgagctcccgcgaacgagagcccggtcatcgctcaccgacgaagcagccgtccactctccgagtctccgggcgcgagctggatgagaggggcagggggtgggcgggcacagcggcgaggccatggggagcttaccgggagggacgacactgaggtgagctggaggaggagcacgccgaggaagtggcggaccgcagtccgtcccacgggagcagcgctagggtgaggcggcggcggaagggctcgccggcggtgggcggagggatccacggcggcggcggcggcggggaggcggggaagagcgagaggcgatggccgtgcagctcctggggtttaaggatgtggttgggccgtatctgctttccatgggtgggccggattgcgcggctcagaagatcggatgggctcctcttcgggtgtactgagttagtgggcctcaaatatgggcttcggtttacggaacatccagcccataccgtcgtgcggcccgtccgaccgtaccaaagctcatcagttcaagtagggtaggctgagtgggaaaagctaacgcgcgtgcccgttggcggttgagcgttccggatagtttagcctaactaactaagttattagtagataatgacgataattaagatacgatttcctttttcccggaagattttttctactacctgactgaaaactttcaagttagatttgaaaatttttgaagccaaattttaaaaactttcaaaactcaatttgaaaatttttaactcgaaatttaaatgtgtaagacaaattttgaaaactttcaactcagatttaaaaactttcaactcatatttgaaaactttcaactcgagatttgaaaactttcaagtacagatttgaaaatttttaagttaagatttgaaaaaatatgaaagctttcgactcagatttaaaaactttcaacttgatatttgaaaactttcgactccgattcaaaaactttcgatccagattcgaaaactttcaactcgagatttgaatactttcaaatcagatttaaaaattttcaagttaagatttaaaaactttcaaatcaaaacatttaaaaaaataagtgtgctaaagattaaaaaaagtaatcagaaaaaacgggaaaaaaagcgaaaaaaaatcgcaaaagaaaaaggaaaaataaatcacgaaaaaagaacaaataggctaatgggccttgggctgggagtagctggcgcgcgcgcgagactagcaacccccaggttgagtctcacttttccaacccacctatcttttttttcacgccaaactgctgaatggtgtgttttttataaaaagtttctacacaaaaattgttttaaaaaaatcatattaatctattttttcgaaaaaaagataatacttaaataagtatcacatatataaaatacagtatgagtattacacattggtagtttggtaaaggtagtacaaaatttaaaattatgttgtcattttaatatattttaataataaattgagaaaaaaaacatatatatactattatacgagagaaaatataataatactagctgcgcaatctgcacgggccaccatgctagttaattaattaatcaattaactagtcttgatttttgatcttgcaggcattcacgtcccattgacgggattggagtttgggacgttgcagtctacagataaaaatgctaaaagcgatgttgcaaaacaaaaaagaaaagacagagaaacgatgaatgagatgtttaatcgtgcgctaatgagttacttcggtttacttgcgtgagatgttagatcctactccctttctaggttaggtttttttggatttgggacggagggaatacatcctagccaagtttgtcaggccattttagattaatgccaaaacatactctaccaatatttaaatagttttctagatatattttggtatttggaatagtgcatacggtggtttatatcattggcattaccaatgtccaatttaaaatttctagattccactcaaagctttgctctaagttgacattaaaaaggcaactctacctcagaaaaaaaaattggtggtaccaaaatttatctaagttttggcactagcagggtatacaaactagctcgtcatttgtcaacattgacaatctttcaaataaaatcttagtgccctataaaaaataatcttagggagaagaaaatggagaatttaaaacatttagtatatacgcctaactgcaagtccaaatatactttctctagtcaacattactcgtcgtttccgagaagcaatttgcactgagtgtagtttaattgagttgtctgaaacgacgtatatttctgtccagagggagtatatatttatggcaaaatttgctacgggactcttaaaaaacgtgtaattagctgtgggacaccgtaaaaacgtgaattggctatagaacaccgcaaaaaagtgataattagctactagacaccggaggtattattttattatttcctataaaaacggagagagagagtgttgaaagtaccaaaatacccctgtgtcgttttgcttgttctggagtcccactgatgccgctgccccatgccagcgagctgccacgccatgaccggactaaacaaggagagaaagagataagaaatagaagaagaagacaagagaaaaaaaaaaggaagagcaacctgtagccatcgcgtggccgccggcgaacagcacgccgtgccgtgccacgccaccacggcatacggctgccgccgggcagcccacaccgagaccgcggcgctcacacgcgcgccttggcacgcactaccgtcgctcacgccgtgcctctgccctcgtcgtcgcacggtcatgccggcgccgtccgaccattcctcattgctccaccgccgcacatggca

SEQ ID NO: 53821 - DNA, 1464 bp, Oryza sativa
agttcccagctgcacccgtgcccgtcgcatccggccacgttgccatgtccagcgccccagccgcttacagcgccgaccactcacgacgtcagcgccggccactcgtgacgttggccgctcaccatgggcactcgcccactccaccgctcgtagcaccgactgtaccgcctcgccctggtgccgacaggccaccgcgactctccagccggccccctccccccgcgcagcaaggcggggcagatggagctggagcggcgttgcatgacggcaaggcgtgcgtccgcgccacgtgcgtgagggcaatctggtctttttcgatcatttctctctccatgttgtttgaaaataataaaataataccttcggtgtctagtagctaattaccactcttttgcgatatcctatagcaaattcatgtctttgtggtgtcccatagctaattgcacgttttctgagtgtcttctagcaaattttgcctatatttattaagaccatctaaaaagatgcactttttaagatgtagtagtataaattgccctagcaaatgttgccgctatcttaaaattgcttctggtcttatcatttgctcctttactcaggcttatggatggctaactttatttttttcagggaaaaagaacacatgctacttgagttaaccagctatccttccagccactataaataagtagtacatgactccactaaagcaatgacgtaaaaaaaggcaaacaagagaacacatcactatatatacatcaaaagcaatattttctgtggatatgctctgaataaactatgaactgagaactcattagccctaacagccacccttttatacggggaagaatatagccaaaaagaaaagaaatattgatgtcaaaagaatggtcctgcatgtttgtgtgctctgttctttttgggatgatttgctgatgtgatgcaaggttccatgatatgactttgcaattttgtacctttcttccctggccgctagttgccatttcaatgctgagaggtcatttccaagaaagaaatattaataatatcctatagcttatataattatcgttttgaacgagaacatggtattgaaaaataacttcgaccactattcccagttataatgtatatagaaatatcaataaatatattattttatttaaatagtttttaagattaatttatacatataatcttcatacttctaagatatatattttaaaatttatttttcttggtttttttctttttccagcggcaaaatttctcaaaagtgaaggaatctcgaataggcaaatataacttatggcccaagataataaaattgccaacaaagcataattcacaaaatatcctatacttgttccttttcttggagcaaccatcaacctttgtcacacataatttggaactatctccatatatatagttcttcatcgttattgtaattcttgaaaaaga

SEQ ID NO: 53822 - DNA, 781 bp, Oryza sativa
ctctagttgtacatgagttgtacaactggatctcatgagcaattttacggttcttaaggaggtaccaaaaatttagtataaaatttggtaccttatagtacccaggtatcaaaaggtattaaatttacaatagaaaaagtgatacctcatggtacctcctcaagaaccgtaaaattactcggatctcatacatatagcagtactcttttactttcctccctgtttatccctaattaactttacactgttaggcctaattaattttctctacattcgtcccgactggattctcaagtagacgacatgcgtacgtagcatccaaatacacgactcgtgcgcccgtaagacaccaaactcccctcttaaaacgacgcgacaatcacaagccgccgcgcccctgcactgcaccaccctctcgccgccatgccgtcgcttgggatcgcgccgctgctcgacgcctacttccgccgccgcttcgccgcggcgggcctcgtccaggcgtccgttccgctggacggcggcgccacgacggtgcaatgctggcgcttcccgccgggggcgagcgaggagctccccgtgctcgtcctcctccacggcttcgggccaccggcgacgtggcagtggcggcggcaggtgggcccgctctcccgccggttccgcctcgtcgtgcctgacctccttttcttcggcggctccggcacagcggccgccgacgcgcgctcggaggcgcaccaggccgaggcggtggcgaagctcgtcgccgcggtcgtgggggctgcgg

SEQ ID NO: 53823 - DNA, 3482 bp, Oryza sativa
caagttcttgtgcttgccatgatgccatctgacatcgagatcaagtagttcttggatcatctggatgatccgtgatgtcacctcatggaagtgtgacgtaccactgtagtatcatacaacaactgattgatcactgaatcgtcgaaagagatatggtccctgaattcccaaccgccttcgtagctagctagcactagcagtcactcacctgtcaccaactcaccaaccaatcatccctggatggagatgtctccctcaatttcccaaccgtttcgccgttcttccaatcaattcagagtttcagaccgccgttcgatccagcctagcttttccagttagagacatcctactgtttttgtgtagttgacaagcacagaggcactcacactgtgtgaatgtaattgccatctttgccaggctaataatcttccaatcaaggtgagactgaatgaactctgcgttttcctatctgaatttcaacaaacaacaggcctacctgtcacctttccccaacctatccgagctggattctcaaattaactcgtcgtcctttttcacttttttaagataaaatgccttattcattaattgttcctgagagtcattatctttgctgacagcctcttgactttagtaccagtaacttgttctctaaaagaatataagaaatagtaacatttaacactgttgcagtatctctacaccgacaaaatagaagaaaagaaagagctgatcaaggggataacactgggggacaaagaaaaattccagctcactccacttcctcaggtatgcatagcatttagcagctgacaaataattacagaagtgctttacttgccaagtttacctttatcaaatgtctctgtctgtctaatctttcaggaagttcttgtattatggggagagcatgatcagatatttcccatacagaaggcatttgaagtagcaaggtcagtacttattccttctaatataattgcattattaatacatatgaagcaaaacttttgccctctttttgtttaaaaaaaaaacagtagaattacatgttgaagttgcaccttgtaatgttacttacacaagatgaattaacgcaaatgcaggcaacttggtgcaaatgctaggttggaaatcataaagaacaccggccatatgccacaggaggaggacccgaaacggttcaatgaggccctcctgaacttcttgttaccagctccaaattcgtcgttgtgatggggatatcaatgccaacttcttgagcggctatctgtggagagtacttgatctaagttgtacattgtcttatggcacagggtaaaacttgtaccttttgagataaaagtgggaaatatgatatagagtatatgcattgtttttcttctcatatacaaaattgggttgaatcctctgcacttgctagtttctacagtaaaataagggggggaaaatgaagttccctggatttaataaggggaaaaaaaccccctgtaagaatgaggggttacatacattaaaccaagcactggtaaaaaaattctattctgcgctaacttatgcgacgcctgatttgtcggacccagccaacctttacctcctgaagtaagaggagtttcgctttgatatcttgtgctaaggctccataagctgatctgttgagatccctcccctcaagcattctcactacatctggattgtctgtctgtccgactgtccctaggtaacactctgacttccttggcctgtttcaattgctctcttgcatgcaattagctcagcaaagcaagcatcctcagccgggatgatggaagaagttgtcctgcaccggatcggatcgacaagcgctcttggcgcgggtggtgatcgaatacgctctgctcgggtgcggcggcgtcaagagacgcgatgcttttgctgacatgatatgtaaacgatgcaaaatcgtattagtgtgatcattagggaatgaagacaaaagtgcaattaaaatgcttgtcagcatcacctctttctttctttctgactagctgctttttgtctgcaactcggcttgacgcattgctttgtcacgcattgagaatagttcccttctcctctgttctcatccaaagaatgatgaaaattacattatgttccccccaaaaatatggtgcagcttgttggaaagatttatgcatgaagctaagccttcatccacactatcttatgaggattgctaccgtccagcaggttgtaccgggcggtactggtaccgcgcggtaccaagacacatctaaccgttgaatccgggatgggtaggatcgggagagaaaagatgagcaagggtggatgagggagtacctgtttcgagtcgtcgttcccggcggcggcggcgtccaagtcattgtcattcccggcggcggcgcagagcaacaagggaacgctggcagcgcgggagaggataaagtctggcggcggcgcgagagagaaaaaagggaacggcggcggcgcgggagaggaaacaagtccggcggcggaagaggaacaagtccggcggcggaagaggaacacggcggtggtggcgaggaagaggaacacggcggcagcggcgaaaatcatccagcttcgctagggttcaagccgctcgatctcgatccagacccatctattgcacgcgaaattacaatactgcccttccaccgattatcatcactcggtaccgcttcggggacaaaactggtaccccgcggtaccgatctacgccagccgttcgatctgcctcgatccaacggtcaataatcggtaccgcaaggtaccgttggactgtaaaaatcctcctatcttataccacttgcattggagctaagcttcagcgagttcggtttaggattagactatggtactacaaagagtgactgagtgaagcaaaatccaaacagcaaaagtatttttcatatgtactagttacacagaggtaaaattaatgcatctcacagtttccttgaaaaatgcatcttgaagctaatgctaaagcattaaacactcagggttttaatgttcatgcatgatacagcttttctttttatcatatgcagttaatattaaacaagaacaacaaataataactaacaagaacagatagtgtcacacagtattgcaatgcacatttctggagttactttgtatttctctttttgaaactaaagagtcagtgcttatatatttgtataaaaaaaggattgcacaaataattttaggaagacagctagaaaaaaaacaaagagatatgtgcgaagaaagaattgttagctgccagttccaaatggctaatagagcaactgataactaattagactgaagaaaagagcagataacattgcctacagtgctcctacggtgcagtttctactttgctacgactgctgtgcaatggcttacgactagccaggagagatcatatcaaactagaacaactttcatcaattggaaatcgaaaagccaat

SEQ ID NO: 53824 - DNA, 1065 bp, Oryza sativa
cccgatgtcgccggtcgcgactccacaccgtcgccggcctccatgacgccctcccgctgccgcacgacgctggcctccacgacaaccacacgccgccggcctccacgacgcctgcacagcaggcctcgccacccacgaggccgcacgaccgcctccacgacgcctcaaccaccacggccgttgcctcgccagccaaccgtcgcagtcgatgccgccacagccgtcgccaccgtcaccggctgccgtcggcagccgccgccgccgccagctagatctggctagagacgtcattgcctcctcccgcatcgccgacgtcaccaccggctctcgcggcacctccaccaccacacccgtcgtccggccacgcctccgtgctcggctaccggagctagctccagcagcgtctcccgccaggtcgtcaccgcccaaacccaccgccaaaactcgccgccgagctaccaggacgccgccgtccgtcgttgggggaccggatccgggcaccacagcaccggatctggacgccgccagtcggcgtcgacgccatgccctgagctcctaccgtgccgacgtcccgaccgtcttgaccgtgaacgcgggagagagagcccctccgccgccgtccttgcagccggcggccgcgaggctggggaacgttctcgcttgttaaagcagatttaataatatcgtcaacttgctgactataagacaaccacatcatctatagcctgttagtataggctgctcatatagcaatggtctttattactatcatatcatttgtagtaacagataatatatttttaagcatgaaccaatctccatcaggcttatttctttttctttattgtactgcgtgttgcagccggtgataattctttcgtcgactcgtgttctcgctctaccattccctgctccagcatatcagtgagactgacgtgatcacgctatcgccgatcttggttggcctattagacatgctcttacgctctccggtttatgttgtgacacgatgggggataaacgcgtgacgagacaactatgaggctgtcatatggatgtcatttt

SEQ ID NO: 53825 - DNA, 1294 bp, Oryza sativa
gggtgatggcggagtcgccggccgtgcggctgttccggcgaagggcggcggcggcggcgttgcgcggggggtgaaggtggtggtaagagggctcgtcggcagggggcccggcaaggtgttcggccggtcgatcccggcggcaaggttcggccacctcgcctacataaggtgaaggcgcagctgcgtcctgaaacgtcagtgatctgatcttcttctcctctctcactctctgccatcgagggaggtgtgctttgtactagcttttttcttcttcttcttcttcttcttcttcttcttcttctttttttttgtttttgggccaatgatactttgtgctagctaggtgctcgacaaaatgcgtccttgattgatgcttggtgattttcactagatctgttcatacgacttgtaaatagtagaacatgctaggtacaaggtacttttcagattacactgttcttcagttcttgtacttagtacgttttcttttttttttcttcttctgtatgaaatacgctcgtaataacatcgatcttattaaggttgtttaactttttggtgttctgttagatctgcagttccttcttttttttatatatatggacaatttgatggtcagatgaacagaaggcctttaccaagtagtttctgaacttctgatgctagatctatacgaaggttaggatggatgcacagctgctggtttctacaaacatcagtacatcatatcccgttgcgtatgtggttgccatgagtcttttctgttttaaaaaagaggcagattagaatgttcgatacagctatgaatcattgatttgcttctgcattattcatgcatgcagccatacagctcaagtattcgttgttttgtctaatacggtgtactctgtatctgggtttctttcagaccacagtctgcgtcagatatttttcttctctaatccatttgtgtatttgtgttgttcaccagtagtgcacgtctggtatgtacttgctacttccatcttctgaaaacaacgagggaaaaattatctttggcttgtaatactaattaactccttacatattcttgaattcctcttcggtgttccagacactcttgtatgaaagtatagagctattttctcgtagtacaaaatgaggataaaatccctctcattacaaaacaaagagggaggttatgtgtcttatggaagaggccggggatgtaaaacatttctgttgtctttaaaaaaaaagataaaagagggatttgaagaattgtatttgaaattctgaattatacataacgaaa

SEQ ID NO: 53826 - DNA, 1584 bp, Oryza sativa
ccatctggtcctggccccttcaggtctccaattgaatctattgatgtctttatttcttcgacaataaactcagccattaagcattcattcatctcttctgttactttcttcttcactttgcttaagaggcgctccgggtgctgacatccattggactggaacatatttttgaaatactgcatgatgaaacttttcttctcctcttcactctccacccagcttccatcttcctttttcagtcggccgatcctattgcttcgttttctctctgaacacgttgcatggaaaaaggatgtattgcggtctcctttttgcaaccatgccacatgcgcccgttgcctccagtaggtatcaacctgctcctccagtttctccagtttgtatttcagcaccccttctttcaccaccttctccttgcagatatttcccctgcggcacgcttccagttcctttttcagcttctttattctcttttccagatcacccaggacgtttgtactctagtttgacaaacctgaagctaccaccttcaccgcattcatcacatccttctgccaaagttgaggccatctcccaattctcgctcaccacttccctgcacttctcttcagccagccacgcagcttcaaacctgaagcttgatgatcccctctgcattacccccttccttcccccacatgtagtaatgatcactggccgatggtcagagtgcctcggatccccattgacaacccgaaagctcggaaacttcaccctccattcctgatttgccaccgcccggtccagatgctccctaatatagccctcttctgtgtggctattattccgccaggtaaacatgtctccctcaaaaccgatgtcaatgaggccacaatcaggtaaagtgtcccggaacttgtccatctgaggttggcacttcggcctacctccctgtttttctgcagctacgagtatctcattaaaatctcccgccatcagccatggctgagctggattcatcgccaagcttcgcaaagtgtcccatgtctgaatctaagatcactttgtgcctctccatacacccctataaatctccaacttccaccacccccctcttcaatatccacatcaatgtggtactttgacatgcttctaagagacacatcaatcctcctcctccataacactgcaattcccccccttccttgtccttcacaatctttcaccaccatattaaccaaacccaacatccacctcagacactgcattcttctcttgtctaattttttttctgacaagaaaagaatatcgatcttttccgacttctgaagatccagaagtccccgaactgccgggcggtttcccaacccccgacagttccaagccactagcttcatttcttcccgcaggactggatcgcaagtcccgcttccattgggttttgttcctcactattctttagctctccctccttccttcgctttccgaaacttcctcccctccctccatctatcttctctttcccgggatcaccgtccccgagcctgctggcaaaatcttacctctagtctcccatgtcattcttttgaaagttttctgtttgct

SEQ ID NO: 53827 - DNA, 2489 bp, Oryza sativa
  unsure (1)..(2489): unsure at all n locations
nnnnnnnnnnnnnnnnnnnnnnnnnnnnnnnnnnnnnnnnnnnnnnnnnnnnnnnnnnnnncatgttgagctggtttcagcatctcccctcctatttcgcccccttggggctgattctttcccgcactaaccatctccttctcaatggaaaacaatgctttcttagcctgttcaggtttgtgcatctgaaccgatttctttacaggactcgtcacttcctcctcctccccatttctggcctctcttccagtaactactgccccagaatccttcctcctccaagatggtgcatcactccccctactactgctatccccagatcttctctgcgctccccccccttccacccaattgtctcatgttacttccctcctcccacctcctcttttctgggatgaaccgcagttttttgctataacgttgctcttctccctcctttagctgcacactacacactttatcagtatgctatatgatcccacatgtatagcagaagtacggtaggaactcatacaccaggggacaccatatctccttcttccccttcgccaaactcagagttacaccacgcatcaggggtttacgaatatccagacgaacctttatacgaaggaactgccccacagcagtgccatccttttccgactccattcgcatgaattcacccacctctcccccgatcgctctccctatggccttgttcatcatgcataaaggcatctttgaagccctgatccaaataggaacaaaggcaaacaccatctcctccaaaacctttgattcatcataatccacgacgatcaccagatctttaccaaacatccagggtccatcctccagagcatgccgcttcccggatgctgatgaaaggtaaacaggaaatggttctcgcctagatctctgcacgttattcccctaatcagacaccagatcttccccagtgcttgcgccaaaccctccgcgttcaccactttctccgccaggaccttcccgatcgccttcggatcccctgatcccatacttccagactccgcctcgcagatccggatccccttcttctctgcctccgacaattgcatgcgcttcatcagtgcctgcatcgcctccatggtgccctccgaaccctaaaactacccctccccggctagcaaggtttggctcggctccaaaacagagaatctaaccgtggacacagaggaaggatgggatgtggactcaggatctagaccgaagagatcgatccgactcaggatctagaccgaagagatcgatccgatcaggcatgagaccgatggggttgagagaagattgaaaccctacccacgcagaacccaccttgagtcgcctaggaaccctaggcgccgaggacatggttggctaaaataaatttaatatcaaagtgaacacatggtacacatatcagatattaaactgataagaacagatactacacttgatcttagccaaaaggccgagaaaggtatgatttggttacaaaccctgggtcatctcatatacccatgtctcctctccaatcaggtctagggcgcgaggtgggactaatataaaaccacgcagcatatatgccatgttcgagcctgattgggcctcagattgacggcccaaaagaatcagtatatgtgggcttctcccgtgcgtaaaagcccagggcttcgtatgccgtgagcaacgaggccgagaccgagacgcggtcgcgcgctgccacgccgaccaacttcgcccacgcacgacgcgacgcgacgcgcccaccgcccaccacgccgtccgctggtcggcgccgtcgcccccgcccgcgccgcgccgcgccgcctcgcctgtccgccgtgtcatgtctacgtcgaacacgcacgtgtggccctgcgctttgcgcgtggaagctatagcgatctctccttctcccttgcgtacgtgttgctcgtgcgcacggcgcgcgtcgcgtcggcggcgtggcgtgtcgcccagcgtgcgtgcgcgcgcgcgccaccgcggcggcggcggcgaaagtcaatggcgacgcatgtcagcgtgcgtgtgaaacgaacgcgacgccgcctcgcgctcctccttccttgcaagtaaacgcttcatctgtagtgtaatagtagtggatagattaatagggataaacaaaatctccttactacctactagctgcctttgcttctagtactgattgttctttataatcttttagtacgtttcatcaaagtttcttacttcaagaaatgcatttcattgctccacgagaaaccgtgcaggtgcgtgcttaaattttatcaacagctgtaatggaagtctttcctcaaagtcaatttgattatttcgaatacactcatatatatacataaacaacaaagcaatcataacaccatgcgtctaccatgtaataatgtatagtatataatacctgtatttgtcattatttagtggactctgcttagttctcctaaaataatatcaaccagtgc

SEQ ID NO: 53828 - DNA, 1193 bp, Oryza sativa
tacattactgtctcacataggttaaatcaaacaagacaatagctcagtacagtagttacagtactggctcacattgtcacattaaccatttacaacctcagaaacacaaaataatgagagtatggtagtaaaggggcgatcgactgccaaataagtcagtatattgtgcaaccaaggccaagattccattctatctagtgcatactactaggatgtaggatccaatcacaccacagtggttcactcattcactgaacatttcatctaatcagcatgtatgacgtatcctggaagtgcatactactcctatactaaaactgattcaatatagggagtcagcaaaattagcatccagtcgaacaagcgcatcatcggtatgtaaaacatccttatcacatcgcaatgctctcatgaacaccaagagttgcagagattaattattggaaccggtttcgctgagacgttctacggcaggataaagtcgagtgatcctccaattcgcaattcgtaactcgtaaatgatattgtgccagcgggatccaaacgcgcgcaccgcatgttccacgcagcacttagaactgagaatctgagagagcaaagttgtggctcacctggcatcccggtggcgagcagcccaatccggtcggtgatcgcgaacaggttcgtgatggtcgtcgggtcgtgcaacttgtcctgatcaggggaacgaagcaaatcaaacggccgcagaatgaatcacaaatgaggggacaaggggattccgctctcgcgacgtgctcacctccttccgatgggtgaggacgtagacggagtcgtcgccgcgcacgccgacggaggtgatcccggccagcttcacggcgttgaacgcgtagtctgcgagagcacacagcacggccgcacggggaggcgggcggcggaattgaagcagcagatcgttagccaaagcgcagacaccagcagcgaatttggtcggcgtggagggggcatgtcgcggcggcgggcactcaccgagttggcagaggcggccctccggggagaagagggtgatgaagcgctcgtagtcggcggggccggcggcgcggctgccgcctccggtgaccaccgccgcggcctcggcttccggcatctcgctagcaaattcaccctctctctctctctccgccgcgtgaggcgtgggaatggtggcgtggtgg

SEQ ID NO: 53829 - DNA, 871 bp, Oryza sativa
cgttgttttggcatccctagggggcgatcttgtatgtgttcatttgttggtctaacggcggtcggtcacgcttagcggcggccggttcggtgctagccttcttccggattgtgtgttggcgctatcggtgtgtgggtggtggtattcagggttgtaatcttgtactccctccgtttcaaaatgtttgacaccgttaactttttagcacatgtttaaccgttcgtcttattaaaaaattttgtgaaatatgtaaaactatatgtgtacatgaaagtatatttaacaatgagggcctcatcgtttggcatattcatatgcttatgagccaaaatttgaattttcaacgttaaatttgaagctaattttggggttttttcatcgaagtttatttttcagcctttgcttttagatcgctaagaacacatatataaaagttttattcacaaattgattttcgtttgcaaaatatgtcatttgacatattcagaaaatatgccaaacgatgaggctttaaatcaaatgatatgaataaataattgttttttttaataagacgaatgggcaaacacgtactaaaaggtcaacggtgccaaatattttgaaacggagggagtaattttttcctgctcaatagaacttcgcaccattaaaaaaaacaagcgagaacgtgtttcaaaaccgttcaccgggcgccaggcggtcacagctggtgatggcgcgacgtacgtactcctgtataacggacttgcggagttcacaccacacgcacggctcctggagcggtccccccagaaaacgacacaaaactagccgttacgccgcgttgccgacggcgagacggaaatcccgaccgtcgaagccgaaacgagcc

SEQ ID NO: 53830 - DNA, 2291 bp, Oryza sativa
ggtggaggagcgacgacggcggggtctcgtcgcgggcgcgcgcgcagtaggcgagcgcctcggcgcgcacggccggggaggcggcggccgcggcgggggaatccgaggcgagcaggatggcctgctcgaggtcgtccatggcggtggcggtggtggcggaggaatctggggcggggcggaggggggaaaggaagaggggcgaaggggaggcggagttggggttgatataggagaggagagggtttgctcctcttcctctccactgcggtgcttttctttcccttcccttctttcttcctgtctaatcttccgtttttgccggatttcgtgggtttatggacggttttggttttgggtttgggtttgggtttttaggtttaggactagggaggggagggtcttttgatatttttttaatctaaaaataaattattttgcattgtcctttgagaaatatctagctctaaaagaaatattaaaggaatattagcaatacttgaaaaaaataacaatgtcgtatacatatgaattgatcatgtgtcactctcagacattattatgcaagtattttttgcgcattacatatataatatgagttttgaagtttttatgcaggctccaagttgacaattgcaatccttagggtttcgactcctcagctggttgggacgttatgtgcatggaataattattgctcggggtatagaagttacgtgtttccttaattacaacataccaaacctatcgtttctatgaaaacattcaagatttgacatgtatttattttggtgttggttaaatcatatttttggacggtcagagattccttgtttgtgcatatcattattgatacatgacacaattagtagggatgtagatgggctgggtcaacccatttacccagtgacccaacccacgatctatggggcaaaaaccatatgggtcaacccacaatttcacctaggctaacatgggttggtggcctcgtgacgcacggaccacgcatggggttgacccatatcttacaccacgtttacgcactcacaggctccagtagatgttggtgggtggaggcgacgacggcgtgcatctgcgtcaacactacagcaaaatcggtagcctacttctcatgctcattacctcatcatctatatctccacctctgctcaccccttgtgctcgacgtcgggctcggcatccaattcaacatgtgtctcttggagctccggtcaccatgtttgtgaatttcacatagagaagatcacgggaggctgaggctagaggctcttagtagtgcttgcttgacggcccagtgtcctcatcgtgttcctcattgctagcatcgtctttctgctagagatccaacaaggcatagactatgacaaaatcaagatgttgctccagaggatcaggggcatcggcgttgtgggcgacaagttggacaatatcgccactatgaaagccatgtaactagacgagatcgaaccttttgcagtgccagtactcatgcatatgcttattcaacttttgggttatgggtcgacccatgggtcaactgcctaggaacgttgcgggggcaagatgacccatgacccataatctagcacggggggcgtggtgggcagggtttcccttaccggcggttaccggacttatcgcggggtacggtaatataaataccgcggtaacctccttaaattcaaataaatttaaaaaataatttgaatttttgataaattttgcacggtttttcatggtttttcacggttaccgcggtaaccgtgcttaccgccggggcgcggtaaccccggccccggcggtttaagaaaccctgatggtgggtcaagccttggggtcgacctaccagtatccctaacagttattctttattataggtaacggtattaccatattatcttattgttctcatcaaacacatgtgttgaaaagataaactaatagtagtgatattactcgacgagaaaagaaccatgtcaagtgattaacacattccacttccgagttcttacaatggttcaaaagacgcttctcttctcttattttcccctttctttgttgtctcttatctaactttctatccattgggatgtggcaatcttactgccaaaatgttaaagataaaaccaatgatgttttttaacaagaaaaaaatatttatcgacacttgtctggcttactatagtggtttgaaagacaactttctcctatttcatctatgtcacgtgattcctttagggctccaaccgtgtgtccggtgtgacatgggactc

SEQ ID NO: 53831 - DNA, 4181 bp, Oryza sativa
cgtgctcaccgcctagggtttggtcctggccctgccttttgttctgcttcttggtttttgagatctattaatctgaagtagtagtcgtttcttgtctcaagctatttgcgttaagaagacttgattagtttgttttctactgtacttcttgcatgttaagacagtacgttatgagaatttttgcactaagcgatgccagttcatgtcagatgcttcagatatatcaatgctattttgtgctgccaattatgattcgttcgatctgacttggcatgcccgcgttatattagatcgtctgatcatgttatgtacttgtctgccaaattatgtggatggtaaggttcacattagttttgatctggcctctgcattatgcttcattacaaatttacaattatctgaaatatgttgagaaatgtatgatgttcctgataagaacccatatttataagttaactgtagacatgtactagtaataagcatgttgaatacttcgggttctgccatgttctggattatcttttagccatatttctgaaaattagatgtaaacctatagcaagcgctgtttgggttctgtgccacatgacaaacttctcagtgatttactgatttgcattttttttctctctatgaaaatttttggtccatttaggcattccatggttgtctgaattattctagaccagtaacttgagcactgattaattatgttattcattcacaaattattggataggatcaatcatgtagctgtcctttctggaaaattcatgtctgctagatactggatgattaaaatgtcatggttgtttgtcagaattattctattgttatttggggatttgttctactaggttgtctactgtctaggggcaggggctggatgatgatcatgttggtcattttgttgtctagtgtcttgtcattcaaccctgctcgcagttcaaatttctgtgggtgctggagtacatggttccgcacttgcactatagatgttgaaatgaaccagcgcgaagtgcagtcatgatgtttttgtgatgaagtattctgatgtttcatattgcgagatatcagtttccactcattttgaaattttgagtagcatgggtggtactgatttcttctcgtgtttcataagtagatcttctgtacggtgaagtcttggtaaatatttcaagaaatatggatgtgcgaaattgatattaggggtgtgtttagtttacgccaaaattggaagtttggttgaaattgaaacaatgtgatggaaaagttggagtagcatttgcccgttgcaatgggacaggcccatacaatcggggataggccgagagggtggattgaggaggtgatgagtccgctttttatgaactgtgatcgatcctgtcgttgttgctttgtactagtagtaaatggtaatgcttgacgtaatgacatgtgtcctagtggacaatgtttcaatctaagctttcaaacttagcgtgcctaacttcaaacaaacttggggtgtgtttagttcacgccaaaattggaagtttgattgaaattggaatgatatgatggaaaagttggaagtttgtgtgtataggaaagttttaatgtgatggaaaaattagaagtttgaagaaaaagttatgaactgaacctccattgcgttgtcgaactgtcagtcattgtctcatcaccatgcaatgtcttgttttgcatcacatcacgctattggtttttttgcgtgaatcagcgtaagtcggatacttcaacatgtcaatggctgtggttatatctaaagtttgatccaaacttcagtccttttttatcacatcaacctgtcacacacacaacttttcagtcacatcatctctaatttcaagcaaaatccaaactttggatccaactaaacacagccattaatatgtcattgtcctgtagcagtatacccttcaatgtttcctgattgatcattgcgtaatgcataacaacactgtcaacacatcatgtttagcccataacaacactgtcaacacatcatgtttagcccctttgaatcacaggaatgaaaaaacggagaaataggaaaaacataagattatgataggaatgtaagtgtaaaacaaaggattgcaaaacacaggaaaaacataggaatgaccgtttgattggaccactggaaaaacacaagaatttgaggagagataaagactcaaaggatttctatttgatgaggagagataaagactcaaaggatgaatttgaggagagataaagactcaaaggatttctatttgatgaggagagataaagactcaaaggatttctatttgaggagagataaagactcaaaggatttcttccatgaggttctacctcttgttaaaattcctccaaaacttgtatgggaagaggcattccataggaatttcatagtattccataggtttcattcctttgattcaaagggctttgtaggaaaaatttctataggaataaaatcctctaagggcccctttgaatcgcaggattaagaaaacgtaggaataggaaaaacgtcagattttgataggaatgcaaatataaaacagagaattgcaaaacacaggaatgaccgtttgattaaaccacatgaaaaacacaggaattggatgagagagatagactcaaagaaaagttagaagctcttgctaaattttctccaaaatctctataggattatccattccataggaatttcaaagaattggataggattcaatcatttgtttcaaagggctttataggaaattttcctataggattaaaatcctctaaaattcctatattttttctccaaatcaaaggggccctaaaatttctatgaatttcctttgaatcaaagggggccttacaaactccctgggggagagttgcagaatcgagaacgtcagtgcgtggtggttttgatccgttgatgcttctgctcgcaagagatgcgcctgcacgtttggttgaaagcgttggagaggttgcaaccgagcgccgctggatcgctggccggcctcaccggggcatcctcctccgtcggcgcgcagggcccggccggccatcattgccgccgacactgaatcacaaccattcgcaatcatgctgctgctatcactgtgcacacggttggccgatgcaggaggcggacagataccagtatccagtacatcgcatgccattcgcatgtaccgttccaaactcctccatctcacacacttttttttttcccttcaaaacgcagtagagacgtacaaattcgttttttttatgggagggaggagtagatgttaatcgtgcgtgcatatttattcatataatacacatgcacaatctacatccctataatcatctcatctcagatgattaggtcattatatcttcatatcgatgaaatcaccataggtttctcgctctcaatggtctacggtttatcacagaaaaaataattagtataaatacgaatatccttatcaagcctagaacttaaactcgaatggacatgtttcactatgagagacctaaccagttgaggtacgtttactttgttcatctcacacatttttgtgcttgagaaaaacacacactagtacatactacatactacagttctcatcccctgaagcaatatttatatacacatcacggtcgttttctggagtcgtcatcgaagaaacacggcgcaacgatctgatcctgacagtgaacggaagaggtaaaggaaagagcaaagggaaattagccaagccaggccaaagccgcccgtttcatctccggcttctgctgatgcttttgccgaaccggcaagcaacacctcgtccgcacgcacaagcaaccgagacgacgccgtccgtctctcgtccgtccgtttcccccggcgaaacggccgccgtcctctttcctcctatcggtccatgatgcgcgggccccaccgtgccgcgggacccacgtgacagagaggagcgggcacgtttcgccgtttctgcacgccgcttgtggacgaggaggggagggagtttccactgaaaccgtgtcgtcgttctaatccttttcccagtgttttgctttgctgatcctcttgcgccatatctttgcccaagacaccctcaactttacattaaatcatgtatggtcacactgctgacggatacttacgattgtttaat

SEQ ID NO: 53832 - DNA, 1609 bp, Oryza sativa
gcaaaacaatgaacaaacggagagggatatttcctgaggtaaatacttactagaaggaatgtcggagcagggactagggcaaagatgaccctcttcgtgatcgcattcgataggggtttcggagtcgactagatcaacgaccgtgcgagccttctccttgtccttgtcctcccatgcgagctcccgcagacgccgcgttatcgcggcgggcagactaggctccgtcgcagtagcagcatctccaccaccgccaatcaccgcagcgcgccaccgctcatccgtgtccaccatcgatctttgccgccgctgccagatgagatgatataagactgagggtaatctaaaaattctgaacgttcacaattgcattgggaattgcatccgaatatagaggattgattggcgtgagagagcgtacataccgtagcgggaacaccgatcctctccaactccggctgctcttcggggacgagccgccgccgccgccgccgagccagaggcggttagggtttggcaaagatgtcagatgggctattccgtctctctcggacaggccagattctctaaaggcataccctccttcctttcctgggcccgtttggcacgttacggctttctagttttggaggccgaataagttcacaataggtccctccatttatcgcattttcgtcctcaatccggaaaaccggatacaacacaattacaaaatcatgcaaacaatccagaaaaccagatacaacacatccttaacttacaaagccatgcaaatgagatccctcagtagtattgacccgggcttggctaatatggaacctacatagatcttttaacaaggttttcatcctatatagcattgacgtgacacttacgtgacaatttgatccagaaaaataatatattcatgggcccacatattagttacacactcgaaactataaaagcaatggtgaggcccatgtggcctcacatgtcatcctcgcgactctctgcttctctctatcctctcttttccttgcaaggagaaggccagagcaagcgacgagcggggtgggcgatgggcgtagcagaggggcagcggcgagcgagctcctcgtcccctccacttcttactccataccgcgcatcctcgtcgtaggagtcaaaggtggggaagggttctcgaaacaggcggggtggagaggccggcaaggagatgggtggcgcgcagtagaggagcggaggcacgccgaatgagggagaaggaggcggaggccttgaatgtcacgcggcacggcaccgagttggagtgtgtcgtgcagctaaggccggaggcggtggcgtggcaggcgaaggcgcttgccgaccagtccaccgtggtggcgctccacgcatagctccagcatgcggcggttgcggctattaacggtgaaatttggtaagcccctaggagaattatcgcatcgccaatagtcggattcctgctatattcggttaaggaaattgatctatttatctaaaagtgaccgagttcaagaatgatgcggcatagcaagttatctattaattaggaataatttgttagtttccttttatctttaggaaagtgtgtttagtgtcctataaggac

SEQ ID NO: 53833 - DNA, 2001 bp, Oryza sativa
caatcaatacaattcggcgcatcgccacacatttatacttttctactttatttaccatctggcggaacttggcacctgacacagggctgcatcggttttcgatctccggcgaaggggcaagtccaatgtttcgccggcccaagcaattgtctagtctacgtcggcgtcgttcaagactgcatcagtacgttcgacctcttggattgctccggtttggatgatatatttgtctgcctatttatcatatgtcttagttaatctagtcttagtatctcaatttagctctatcagttgtttctcgctttagggttcctgtcggtaccggctaaattgttttactagattagattagctaagacatctaccacccaaaaattagtcaaaggcttgattgtctagatattatgtttctattcatacttagtgctgcataagttaagtttgatctactaagtcgtgtttaaaaccataatccctagcctgctttttgactgccaataagtgtttcatcggggtttcagccaatgagttatctagacgttgcatcagcttacaaggattgcatacatattggatttagccgatggcaacaaagattttactgattatctaatcttgtggatttaatgctatcggacctccagccgatgtatgctttaaccttcggatcgatgcttatttaccatatcattattagccgaatggtttctactggactatattattgctatattatattatcatcaaccgattgcctttatattgttgtttacatcaagtgtcagattctacattggatatatagtcgatagctcaaaaccctatcgctatcggctgacataggcatgggctagaattactccatcggcttgtcagccgatcggctcattgatatgctatttgtatattttgtcagttgcagagtcaaactgactggcagacccgcatctcatcgtcctttggatatgcactggaactaagcagatctcccaggccagtgtgtgttttttgcgtcaacagcggcacgggcaagggataaggcggcggaggatgacgacaacaacgccggccctgtggacaacgctgagtctaggttcttcgacctggacagtgtggaggaggtgacctagccaccaccgccgccgcgtcgaggccgtgctggacgtgccaggtgaggccgtcctcccttgttgtggatattatgggtaccccatacccatacggcatggttatccgactagtcataggggataacttatatctatggaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcatatgagacaacctgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaaatcatgtttcgacagttgtattcctctcgtgcctccactgctgctcgatggagtggaggagtggtggcagcatgaagggcgcgacgccagcgcggtggatgatcctggcaggtggggcgtggtcgccggcacatatccctaccgaccgccgccgctcctctctgcgcacctcccatctcctcgcgcagcctcctgttaacagcggatttgaaggagttaatttggtttccaaggccaatgcagcgcatcggctgagagccgtatcgatcgatacaaaattagactcggttagccgatatggaaaagatagcagatacagacagtttccgactataagtcgagctcggatcaaggatttaaagatattgccaaacaaggagtt

SEQ ID NO: 53834 - DNA, 1585 bp, Oryza sativa
  unsure (1)..(1585): unsure at all n locations
gtcctcgtccaccaccaagcctactggtccaatctacccaacgaggatgccatggtgttgcaagatggatctacaaacacgaagcatgccaaaaccgatctaatcggatgcataggagacggctgcagccacgccgatgccttcctgccgtcctgcgtcgtgctgatggacaccaacgccgcccgcgactgcgacctccgcctcctccgctccgtctcggagtcagtcgaagagatcaatctcggcgagttttttccttttaatctccgacttcgccgggttttttccttttcaacttattgttgtttattagattgatctctaaatgtcagattaatctctcttggtattttctgctgtttgcatgtaacgccgcggcactactcttgccgactggtgtttccgtctacatggctggcctattaagccgccgctgttgggcgtctacgacttcaccaccgacctgcctccgtcgccgccgactggtgtccccgcctatacggtcggttggtcacaccaccgttgatgggcatcgtcatcttcaccgccggcctgcctccgtcgccgccgattggtgcctccgcctacacggctggcctattatgccgccgctgttgggcgtctacgacttcaccgccggcttgcctccgtcgtcgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctgcgacttcaccgccggcctgcctccgtcgccgccgattggtgcctccgcctacacggctggcctattatgccgccgctgttgggcgtctacgacttcaccgccggcctgcctccgtcgccgccgattggtgccgccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcgacttcaccaccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacaacttcaccgccggcctgcctccgtcgccgccgagtggtgcctccgcctacacggctggcctattatgccgccgctgttgggcgtgtgcgacttcaccgccggactgcctccatcaacgccgattggtgcctccgcctacacgggtggcctattatccccccgctgttgggcgtntacgactttaccgccggcctgcttcgtacccctcaattggtgcctccccctaacggttggcctattatgccc

SEQ ID NO: 53835 - DNA, 1210 bp, Oryza sativa
aggggcaaggcaacaactcaacaattgaggatttgaccagtgaggtatataaaattctgatttgtcatttaaaatccatttcaattgtcatggctagttgttattgatagttcgagtcttcaaaaatcatagattttgattcctagtttgctactttgttatattgctagattgcgaagatgtcaaaaagaacactgctcacatgttatttgacatttcttttgtataggttaccctgatgaagaataattggtgatagggtgtactagtgtcgcacatcatgtcattatctattggatatttcaatattgttttggtatggataatgcttatttcttgttaattctatatatttacactttgtattagacatatagtcaatttacataagacatgtctcaacttttctcggccacttttagttcagcccccactataatgtaatcctggctctgccactggctgttttgtatccccaaagtggtgggaacatgcactgcttcacttcagtaaaatcttgtgctgttcttgatgtcattgccccaccatactctgaatcatctggccgtgtttgcccctattttcatgattatccattttctagcttctgtaagtgaaatccctcactgtcgtcatattacatatttctgtcaggttcatgtttaactaaatcttttggcggaagcagaataccagccatctctggtattggctggtagttgttcaaaacatatattattagtcacaatgctgttcagatcttttctgtcaagaacagcaattaccttatacattatgttcattttatatgagaagaaaacttaatttgttgatatattgtcaaaacacaaaagtgatcattttcactatgctatatcatgtttgatttttctcacggatcactccaactgcagcagctggacaagcaaaagtagtccatgggccagataattatgcttggcttgaggccttaaacgtaccggtgaatattaatatgcgccctggcatgtatactggcccaactatacaggtatagcctaaatttctgcattttgttgatagtcttctgtagcaaccaaaacatgcttgagagttgagactgtttttctgatggaatatttgtctttttgctaggaacatctgccataatcaataaaaatgggcaggacagagcgtcaaactgtgttcaagtgccatctcacaaatacag

SEQ ID NO: 53836 - DNA, 1425 bp, Oryza sativa
gtcatcatcgccgtcatcgatgtcctcggtgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacgatgcaccacttgccggttgggcgctccctactgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatccttccaagagtggactgacgcggggggcaagttcattagccaaccccgtgcttgtcccttcagggccatgggaaagaaattcgccatgaccctgtcgtcacccccggcggcctcgatcccagtcgtgtagacctggagaaactcggcggggttgacgctcccatcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgagaaggcgccctccgttgcgtgggcagcacgtcggccattacgccggcgctcgatactgatgcgggcatccggccccccacgcagatcttcctgggtcggaggcgctgacgaaggagtggcggccgaatggcgagcaacagccgccgctcgccgcgccctctgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcctggagcgcgccctggggcgtgctgccgtcggccgagacgaggaggcgacg

SEQ ID NO: 53837 - DNA, 1209 bp, Oryza sativa
ttcaccgctccccgtcatcatcctgacaccctgttgcgcttacgccgagaagaagaaagagggagagagggggagagagagaagagggagagaggttactagagagaagggatgacaggtacaagaaaacaccatatttatatggacttagtgcttctttaatcatttgtatttagaattttttgttagttagtgtttattattatgtttatatatggtaaaatggtaaatttgaaattataaaggtgaaataaacatgttaaggagtcagctcgtgagccaagcctagttaggcttttagctcattaaggttaatgaggtgaggttgttactgttatagataagacatacctaatatttttatgttagacttagcaggacccaccgtatattaagtcttgtacagaatcaagcctcacacatgtaagatgttttaaataaggaaagagaagcagagtcctacttaggcatgacaaggactactcggatcgtacttggcaccctagttatgattggacaaggggacacctaatgatataaatacaaaacgccacaggtgaagaggagagatgtgaagacatgccaatacagatttagacaattcaaggaaagcctagacaaacctaatatggagtcatagaggtcaacgagagggatctaggcgacctccaatctcaccaagttcatattcgaggaagcgtactatactagctgtcgaccacatgtgagagctctatgccgctaagctgaccaagactagattagattatcccaaatttagtactcgtgtgatactgatatatataaaggcaacactgacttcagccaataggaatagggctattaggggacccgaacctatataaaaacttgtccatatcggacacgacttaaactttacaaaaataaacacaccagcccattacgaactctaacatagatttctaaaactcataaaagaaaactgactcttatcctaattaatagatacgattgtctaaaacaaactccttgtttggcaatatctttaaatccttgatccgagctcgacttatagtcggaaactgtctgtatctgctatcttttccatatcggctaaccgagtctaattttgtatcgatcgatacggctctcagccgatgcgctgcattggccttggaaaccaaattaactccttcaaatccgctgttaacaggaggctgcgcgagg

SEQ ID NO: 53838 - DNA, 3429 bp, Oryza sativa
tatataaaaaagtcagcgggccagttatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctataagaacgtgacaggccacacctgaaaatatgggctgcagacatattaggcctaggccaaaaaatatgccttcgacaccctttaaaggatgacgcatgtaacatgcttccgagtaataaatttggaacgggtgatatagaccaagtatagctcatatcaatcgcttctgatctgagtgattatcccttatgggatactccaaaatagatgtaacaattgaatcccgactggcgcaagtattcagttgataacccttacggggaataataaatagtccagtctttgagcatagaaaatagacccataatcacgaattcatattgcatatatccagagcaagtccaaattgaaggtatgatacttgtgtctgagctagtaagcccctgagcacgtagtcacaattgttcattgatggtagctgacgcaattggcatagagacaagacgacaaatacagagataatattgaccagcagaggtggcaaaaatattggtggtagtgaagatagtggtaccaatcaaaagtgatgaagttgcacagccgtggaggcgaagaaaccagtcggcagcagtcagatcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaagtgctggtgatgatgtcagtgacaatagtccatcaaattaatgttatagctattgtagatgcttcacttggaggagagttgatgttgttgtccaactcgtccaaaccaaaatatttcaagttgttgaagtagaatgtctgctctgaatcaaagatgaagataatgactcctggagttgactcgttggttgatgaattaatttcttcagcttgacataaaatttgtcaaattttgagccttgtatttgtgtagcccccgactctttgattagttgggaaacaactgaacatagagtcgagaactgtagcatcttgtcgtcgaatagttattgcttgatttaagatatgtgttgaagatgtccaagtagaaatcatgaatgttggagagccacttgttgtagtaaaataacacggcatcgcctgccgagatgtcgagattcacaacaacgtcatggttggtgatgtagcaaaacttgtgaagtagcagcaatagagtttgctggtaccgaagataataaagatgaagtcgctccaccatgatgacaaagttgtgttgccgtgatgaagtgaacacgagtcggcggcaacagaagcaaaccggtagcgaagacgcgcagttgtgaagataaaagcaccagtcggcggcggcataatcagtcggcgacggaagatgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgataccagtcagcggcggatgcggcggccggtcggtgaagacgtagacgcccaacaacggcagcataataggctagccgtgcaggcggaaacaccagtcgacggcggtcgaagcggccggtcggtgaagacgtagacgcccaacaacggcagcataataggctagccgtgcaggcggaaacaccagtcggcggcgggcgaagcggccggtcggtgaagacgtagacgcccaacaacggcggcataataagtcagccgtgcaggcggaagcaccagtcggcggcggacgaggcggccggtcggcgaagacgtagacgcccaacaacggcggcataaaggccagccgtgcaggcggaaacaccagtcggcggcggcgaaggcaagccggtcggtgaagacatagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaagcaccagtcggcggcgggcgaggcggccggtcggtgatgttctgactgatccattcctggagcgtaagagataagcttaaagccatgaatcccttttatgcatatctggatctggatcctgcagaacaaacatataggatgagtagtatctgatataaatataatacttgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcgtctctatgcttttgatttattccgaataatacttagcaccttgcgttactcggtccatccaacgagcccccgggtgctaggaatcggcccaaaggcaaccatccattggcaaaccaaacggaaagcataggaggatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggaggcataataggtcagccgtgtaagcggaaacaccagtcgacggcaacgaaggtgagccaacgg

SEQ ID NO: 53839 - DNA, 837 bp, Oryza sativa
gattggtgtttacgcgtgcacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgactggtgtcttcattgttattgatggacgactttgttcccacattggtcacttctgccatcaccaaggggaatattacaaagctaagtcatcatttattttattctttatatgatatttttccttttcctctgcctcactacaccaattggtcttccattgagtagtgagtcgagggctatagatgttatatcatattttttataatatttatcttgattgcttgcgacataatctgagtacaaaagtacctatcgagttatggagttctatcttcctatgctttccgtttggtttgccattggatggttgcctttgggccgattcctagcacccgggggctcgttcgatggaccgagtaacgcaaggtgctaagtattattcggaataaa

SEQ ID NO: 53840 - DNA, 4136 bp, Oryza sativa
ttgcagaggaaagagcaatcaatttgcagtccgaactctgaaccaagaacaaaaacaagattgggcggcgggtcaggtcaggtcaggtcacctacccatcagagaggagatggcgcggatggcgtggtcgggcggcggggacgacggtgaggaggacgcggcgacggaggacggcgatgggaaggtgcgcttgcagagctcgtacagcgcctgcacccgcgacggcgtcgacgtcgccggtggccgcgtcggcatgccccaccccattgatgaggccgtcgacgacctagatgtccccctctcccgctcttccagctcgctcccttctcgccttcttcctcctcttctccctcctcgcgtggtcgccggagaggagcagcgccgccgcggcgagcggtgtcgcgacgcgagggctcaggcggcgcgtggcgtattgtctcgtctcttccagcgcgaggattaggttgctgttcgtgggccgtgatgggcggcccaatatgggccttagttgtattagtagtatttactagtgggctttgagtttaaactttttttttagttttccttttctttttttactagaaatttgactggaattgtgagctccttcaagctttccatcacagagctacataattttatagcagatacagaagatcaatttgccactcgattatacttgttcacatactggtccggacattttgtggctactttcactaaaaatttatagctgatgcattgtgttctcgccttctcgcagaaatcttggtcaacaccaccatcgtctctaatctttaaatgtaactcaattctgtatagtgtaccaagtactcgattattaggtcctgtcaaagttaatggttcctcctgtaaatagattagggaaaatcatgtcagaaatgcccgcaaaaaacaccaaactcgacaagtccaatacaattaagacaatgccaactgtatgttaagagattcgggtactttcctctggtcataacgcagttgactttgacaacaaaatttgataatttatcttattaaaaaaatacaattattttttttgacttgttttattgttaaaggtactttaaacatgatatttttgcatatttttacactaaacttttaaatatgataaatgatcaaactttatgatcaaaatcaactgcattaaatatttataaagggagcacatactacgtacatataataattttaagtattttaccatcaaagttgggtttgcataaatagaaaatacaactcaactaatggttccaagcgagtaaagtacatgatttgttcttttcttcaaatgagagaacattattgtgcatctgcacatcagactgtctcactaatcaagaacaatgtagccaacaagattcaatctttttgtaacggattggtgtattttgagatggattcaatctttttgtggcataacactgtcatcaagccatggcttctgaattaagctctagaccctactgaaaccagaaaattaccaacacaacaattccctagatcttaaaaatggcaagcatggcattcatactcacacatattgatcacgcataaaaacacacaataaagttaattaccagcgtagagaattaagttacctgtaataatattcctcagactagatacctacaaatctcactggtccataaagtgaccatgatagccaagttcttcgggcgaacatcaagcttagctaatccttgaagcatacccttcctcacatcaacagcaaacacaacttcttctttttttttttttttgcgggggacagcaaacacaacttctaacctatccgttttcatggggctagttatagagagcaagtaaaccacatcctcatccatgcttatggtggggtttccaattggaagttccttgaacattgtttcaattgtctctctgtcgtcgtcgtcgctgcagctcaggttagaacgacatgtgccgcgcgctcaaggtgatgtgtttatcttataatttgtaattcttattatcttatatatgttacatccatccagcagcaaccaagcaagtaatcaggaatcaaacagggtaaactatacatatatatcaggctgctcacataatcaatacacatatactaattgtaatgtctgagttatctgaatgatagatatattgacgaattaattatggaataataataatgtacactagtactcaccataagagcaatacaatttctcctccactacctccatgtcgagggatcgattagcgctacaaggggaagaagaatctccatcttattcggcaagctcccgcttgcgcttgattgttgcaaccatgagccgatcccccgcaaccgaaccgtcgttgccgccctccgccatctgcgagcgttgctgctgatgcgcgatatgatggagataaatgaacaaaaaaagaagaagaggcgattgcatcgaattcggaagaagaggggatcgatgcagcgtcaaaaaaaaaaaaaaagaggggatcgatgtgcgcgcgcgtaccagggagatgtggccgccgcccgcagagagagggaaaggaaaactagggtaatataattattgtgatgtggcggaagaacataacggactaaactacttggttggatcggatcactcgtgagacaatttgttatcattttttgattttttgatttttttaatttttaaaataaactctcgtaaaatttgtttccaaaaaataaatctttttcactacgccaaaccccgtctaacgtggtaaaacagcattttgttttggcaccccagttaagatggcgtggtgaaacaatattgccacgttgggttaagatagtctgtctggcgtgaccaaaagttcgtggaaataagtttttgagagagtttatttgtaaaatttaaaaataaaaagttcactttaacttccttatcaaatctgattcaaattgcatgagttcgctttttgtgttgggatggcaaacgaaaacttcagagggcagcaggctttgacctgtctgccatgctgaaaacaattagtttaagcaatctaatataagatttctttttataacaaaaatatatactctgcagtgaagtagttaaaaaaaaacaggcttagatagagagcgtgcgcaatgccatccagttcctatggtgaacttcttgactcgagagacgacgtagcatgcctgtatggtcgactctagaggatccccctggattaggttcagggcaggagggtggcaactgtcactgcatctcagatattaatctctctgttttaggtcataagacgttttgactatggtcaaagtcaaattatttcaagtttaactaggtttataaataaatataataatatttataatactaaattagtttcatcgaatcaataattgaatacatttttataataaatttatcttgagttgaaaatgtcactattttttttctacaagcttgaccaaatttaaagcagtttgacttcgaccaaagttaaaacgtcttataacctgaaacggagggaataccacgcatgcatgtgtctaattaagataagcgtgatcatcatttacagactgagactagcaatacatatctaagagaatattcttaggaaattttatggatagatagatatgttttgagtgcaccgatcatatatgactctgataagtgcaccctttttacagccttcaaagtaacagtacaatgcaaccaatgcgcttccacatattgggccgtcgccgagtctttactgccgtccaaataatattaacttgaaactcataacagccttgcttgcaggtaaattcttcatcatagtgccctagaatgaactcaaagctttgagcttcatcttcaccctcaaacacacaaatattgagcaccagctccttatccaatgggacaactactaaaccacgatttagctgaacagatccatcagctgtaatctctgtccgagtgtctgcaacttcactgtcatagagaactatttcatcttcatcatttccagtagtccaagcagtcactctaccagtgaaaacagatgccccccctaacattttcaccgcaagggtagcttcaacggcatattgaacagtcacgaatgcaaattccactacacttagc

SEQ ID NO: 53841 - DNA, 2071 bp, Oryza sativa
tgttcgacagacgacattgtatggcagcaaacctttgctaaaatctttgtcaactccatcatcgcccttcatctttaaattgaactcgaaaaacatataatcttttgcaccaagacctcgctttgggcctgtcaaagttagcatgtcctcctgcaaagggatttagggaaataacataacaaaattacataaaaggaaccaagctcagtaatcaagcataattcagatgatgtcaagaccaggttcaacagaaacttgagaagataccaacaatttgatatttaagtgtttacaaccaaaacagttgctcaccaaaaccttcggtggtggtgagtctgacaccaacccaatttctataaattggtcggtctctcatgtatgtgtgcttgttagactaaaataagacatagtctaactaaaagatcaaacaaaaatgaaagccaactcatgcattttatgggcagtatggaccgattaaatgacaaagatatacttctctagatcatgcaatttaatcataagcaacttatgagaattcagttaatgtcattagaagatccaagacttgataatttagcactgtcaacttccatcatgccctgttaatcacattatatgcctcatttctattttcacaaaatgagataaaacattaagtgtatgtgtgaatcaaacttgctcactagtacattgaggaccaactgttcatttacacgatttaatgtgcaagaaaaaaagaatataacagagtgaaatgcattttctgagatgaattgatgaatcttttggtggtatgtagccaagccgatttgttcttacagtgtttataacaggttaaagcaagagaaaatatgtgcagacgtgcaaaccacttgataaacatttgatatttccaataatactgaaaattatctcatgtgtgggtgaggtgatattatgcaactatgtaaaagttcaagaaaaaaacccaatctagtttgtgagatatgaaacaggcaaacagcaagaaaaggacttattttttcctggtttctcaatttcatatctcacaaaacggattgagtttgatcctaaattttacatggttctataacatcacctccctgaacttttatacggttgttttgaccacgtagatggtttccattattccatcccggtaaaacttaaaaccagaacatattgacagaaacagtctaatctcataaaaataaggaaatatgctattgagtagtgaatggcagtgtagtaagagggaggacgaatcgaatacaaaccggtgaggtgatgatctggggatcgtccctgctacgcctgaacaaatacacacacctatagtcatactgatctctcgctaacacggtgccgaagatgctgatagggtaacccacgtcagattcgacaaccttgattgaaatgatattcatggaggtctccaaatggcgataatcagaggaagtgagcgagtgaatcggtggcccaagcccagccttagctgtaaaatcagagacatgagacttcaatcagacaaaagaatatgtatggtttttacacactaaaataaatccatcaacaaatgtgatgaatggatagagaggccgcatacgaatgttaagttgaattagatcatatacaaggaattgaggttaagggattgatgcatggtgaatgcatgtactcacactctttgtcgaggtcgaagaaggcggtgttgaaaaggcaaaggcgggtaggctcaaaccactccatcttggggtcgaattcagtcacctcccatatacgaaccatgtgaagaaccttcaacaccttctcctcccatgtgagctcctcctcctcccaattcttcctcctcggtttaggcttcagctccgacttagtctccaccaccttctccttctccttctccttctcctcaccatatgtgtgcttctcattacaattcaccttgcccatctcttcattgccaccaccaccaccgctagctgcaaccactagggaattttgaaaaaaaaaaatcatgtatccggcaaaacaatgaacaaacggagagggatatttcctgaggtaaata

SEQ ID NO: 53842 - DNA, 2534 bp, Oryza sativa
caagcacgccaaacacatgtttaactttgttggcaggatgctccttgagtggtgattctattgaactgttgtgaacaaactaattattggatgctgaattgatgagtacatacgtatacgtatacgtatataccaacaacctacctcagtacctctaattggcccgttggcttttgtttcagaaatcagaacaacattttctctacatttcaaatctaattcatcagtaaggatcatcaaaatcataatttgtgctaattagtaattttcatttgttttgcatagtagtgccgcatatcgatcagcttttacaaatcattgtgacatatacatttttcagtgtagtataaatatagtaaggcaactacacgattgctattggccagcaaataagagagttttttctcttttttttaataatggtatgaaacatcccggcctttgctcacaagagctatagtccattattacaaaagtagcacactaaaaagcttagtccaaagagttataaggctgatgattcctgcacgttaatgctaataagaaggcagcggaaatcacaccacagccaagctgtattaatgtccaaacctccaaatcgctttgcgcctttcaatttgcaattatttctcttgcctatgttttcattttgcaattatttttgtgctagacaacaaataataaatgaatcaacttctgtctatttataccatttccatgaagtgctcgacaactcacacccatggccatggtgcaatacgtcaccggctacctgtgcctctccttggctctcctcttgctcactctcgtcctccacaaggtggcgaggaaggcgaccggtaatggcgccggcaagccgaggcttccgccggggccgtggcggctgccggtcatcggcaacctccaccaggtcgcgatgggcggcccgctcgtccaccgcaccatggccgacctggcgcgccggcacgacgcgccgctcatgtcgctcaggctcggcgagcttcgcgtcgtcgtcgcctcgtccgccgacgctgccagggagatcaccaagacgcacgacgtcgcgttcgcgacgcggccgtggagctccaccatccgcgtcctgatgagcgacggcgtcgggctggtgttcgcgccctacggcgcgctgtggcggcagctccgcaagatcgccgtggtggagctcctcagcgcgcgccgcgtccagtcgttccgccgcatccgggaggacgaggtctgccgcctcgtcgccgccgtcgccgcggcgcacgccggcgcagcccgtgaacgtcagcgagcggatcacggcgctcatctccgactcggcggtgcgcaccatcatgggcgacaggttcgagaagcgggacgaattcctggagggtctcgccgagggggacaggatagcctccgggttcagcctcggcgacctgttcccgtcgtcgaggctggccagcttcgtcggcggcacgacgcggcgggcggaggcgaaccaccgcaagaacttcgggctgatagagtgcgctctcaggcagcacgaggagcggagggccgccggcgccgtggacgacgacgaggacctcgtcgatgtgcttctcagggttcagaaggaagggagcctccaagtgcccctcaccatgggcaatatcaaagccgttatccttgtaagttgacaagtacttgttcttcacctcttccccttttcccctgcgaaatcactaatacgcgatcggtcgctgaaatctcggcgaggccatcggttttttttcttgccgttacctttccatttttgccagactcctgtgctcgagatctttgttttttccgtcgcttttttggctgttttttttctgttaccgaatggtgacgcgcggcgatcagcccgttccccatgatcctttttttttttcactcgcattacttttctgtttttagtaagtttatataactaaaggtggtacacatcaaatttacacaactaaaatttatatacccaaagtttatacattccaaagtttataggttaaaagtttatatacccggttcaaatttgaattcaaatttggattcaaatatatttatatatatatatatatataatatttctatacataaagtctatatgtacggaatttcatcaagtttatacatctaaagtttgtatacccaaagtttataagttaaaagtttaaatagcctgttcaaattaatttggattcaaatatttttttatatagaatatttctatacataaagtttatatgtatgaaatttcatcaggtttacacatctaaagtttgtatacccaaagtttataggttaaaagtttatatacccggttcaaattcgaattcgaatttgtaagtataaagtttattcacatgaatatatttttcaagtgtattagatttctttttatattttttaaatggtttaaaattgatagtgtggtagaaaggggagacgtgtgcggggagggacgcgggtgctgatagtttttttttatcgcttaaccctccctccagcgagcgatcgcg

SEQ ID NO: 53843 - DNA, 2156 bp, Oryza sativa
tatagctatttacgatgggatttgactcatcttagaatatagaatttgaagagacctctgctcagattcgttattataggatgagtcaaatttcattctaaatagcaatattttaatattttagaacgagaacgcggtagcatcccagtatgatgcagcatgtaaccgaaaatgctgccattgatgacaaagacaacctggaagattactgttgcactttgtaactgaactaccgaagctgatggcagcggtagtagaattcttgaattgtctgttcatgatgccctgcaagctaatgcattcagttggagtgattaaagtaggcaataataccatgagtaatgtcattatttgtatcggacaaaaaaaatgtactacctctgttctaaaatctatacataatataactaaaatataaagatagaatcgaatagaaacaaatctgagcacgtctgttcaaatttatcgtattaggacgtgtctaatataataattataataatgtatcttatgttttgggacggataaagtaaattacttgatcagcacactctggtgacatgacagctgtaaagttgactactgaattcagtggaaagaccgtgagcattattgttcacggctgaacacaaatctgtgggccacatcgtgaccttctccggggcccacagaacgcaaccgggcccttctttgggcccaaggaaaaatgggctgctcttttgggcccacgtgggccattttgcctccgttttgggccggccgtgaaatggctagagctgaaattgcaggtgttgatgacgatcgaaagctggatgctaattcaaaaaaaaagaaaagaaaaagaaaagcttggatgctgcacttgtaactgaagctggtgacagcaatagtacaaccttgaattgtctcttctgatctgctgatgcatttctagataatgcatatccagcagatttgggtgattaatccaagtaatgatctcactccactgatagtggaaattgctggcttcagcatcaaaaactgcattgtatgtttgttttttcgttcttttttttggcattgtttcagcttctttatatgaagtacaaattctacactccagcttggccttaaagtgatcgaacacctagcttgcacggccatggcgcccatggcgcaagatgtcgccgagtacctgagcatcttcttggctctcgtcgtggcccctctcctgctgctcagggtggcgaggcgggcgcgcggcaatggcgccggccggccgaggcttccgccggggccgtggcggctgccggtcatcgggagcctgcaccacctgatgggcaagccccacgtgcaccgcgccatggccgacctcgcgcgccggcacggcgcgccgctcatgtacctcaggctcggcgaggtccctttcgtggtggcctcgtcgcccgacgccgcgcgcgaggtcctcagggcgcaggacgccaacttcgcgtcgcggccgtggagccccaccctgcgcgtcatgatggccgacggcgagggcctcgcgttcgcgcgccacggcgcgcactggcgcctgcgcaagatctgcgtcctcgagctgctcggcccgcggcgcgtgcggtcgttccgccgcgtcagggaggaggaggtggcgcgcctcctcgccgccgtcgccgccgcggccgcggccggggccgacgccgtcgtgaacgtgagcgagcgcgccgccgtgctggtcacggacacgacgtgcgcgccatgatcggcgacaggttcgagatgcgggacgagtacctggagggcgtggccgaggtggggaagctcctgctcgggctcagcctcggcgacctgttcccgtcgtcgaggctggccagcctcgtcagcggcacggcgcgccgcgccgcagcgagccaccggaagatgttcgagctcatggactgcgccatcaggcatcaccaggagaggaaggccgccatggacgccgacgaggacatcttggacgtgctgcttcggatacagaaggaaggaggtcacgatgccccgctcaccatgggagatgtcaaggacaccatacttgtaagcaccatggtttctctcttcactctacttattaattaattgtctttcatttcatcattgtgatacttcattgttactgctacatatatgta

SEQ ID NO: 53844 - DNA, 1994 bp, Oryza sativa
  unsure (1)..(1994): unsure at all n locations
gttgattaatttatctgacatctcttattaggatctttttgctgctgggacggagacatcaacagcaacactccaatgggctatgtccgaggtggtgaggaacccaagaataatgcaaaaggcacaagccgagctacgtaacaagcttcaagggaagccaagtgtgaccgaagatgacctagttggcctaacctacttaaagctcgtcatcaaggaaaccctaagactgcaccccgccgcaccaatgcttgtcccaagggagtgtggggagtcgtgcaaggtgctagggtacgacgtgcccaggggcactaacgtgctcatcaacgcgtgggcgattggcagagaccccaattactgggatgacacggagacgttcaaaccagataggtgtgagaataacaagtataactttagaggcaccgatttcgagtacataccgtttggatctagacgaaagatctgccctggtccggcgttcacacatgccatcttggagctcgcgctcgccgctttgctgtaccactttgactgggagctcccctgcggagttgctccaggggaggtggatatggccgaggagacaggcgtcgtcgttcgcccgaagaacgacctctacctgcgtccggtcgtccgtgtgccgccgggagctgcctcgagcggcaatggtggcacctagccgtgcaccgcatctactacctagccttaattatgtgaaaatgtaacctggttggatcgaatggattaagtgctaaataaaatggtttatgtgttcatgtttgtttgtgttcgtcacatgtcacatgcataagagagagaatcagactatcagagaaggcgaggtccagaagcaggatcaatgttatgcaccttgcaatgtcgatagcaattggcattagtcctaaactgctcagtcatcgtgcaggatattggtgcaggtatcccatagagtcatactctggttctgtaatcaccaggcattcagaaatcaaaaccgtgaaaactaaagacaggcatattcatgctccacataattctccaagaagaaatttggataaaaatattgatataaatttttaaaagtacggaacaatggaaactttcatctgataagcattcttttatcggaataaatatatcagtggatacgtacgatacaatgaacagatcctctcatgctttgtataaattgtattacatgctactacaatacagtgaacaggtcctttcatactttgaattacatgctacaatacatctcaccatactttacatacaatcaatggtctgagagaagggtcaagcactcaagcttcctggtgcacacattaatctacacctcaattgatgcttcaccgttgcttgcctttctccattttgaggatcgttgcttgtttatgatttggacgtaagggtgaatagtctaagtgtctaaccacaccatgagcaataggtcaaccccttgcatcatatgatatcttggtatgattgagtataagactatgagagggaatattgccctcaagatctgttaaaagacatcaggagggaaacgcccaggcatagaattgttctgctgagcttgcttcagatgcactctaagtgcataattatttatctgcaatgttaaatatacttatgtaagaacaatcaaaatcaccgggagtagtgttcgggacaaaagaatcaccaggagtaaggagtagtacctcaagagtttttatctgttcctgatactgcaaaaccagttgtttcaggctatgaacctcctgagtcctctcgtcaaactctttttgacgttcagttggatagcaaccgccctcttcagaacagcgttctctctcagatatattgccagttgctccttcagcatcacattttcctgcaggaaagcaaagcataactgcttaatttgcctaggagtacaagtactatggatgnnnnnnnnnnnnnnnnnnnnnnnnnnnnnnnnnnnnnnnnnnnnnnnnnnnnnnnnn

SEQ ID NO: 53845 - DNA, 991 bp, Oryza sativa
  unsure (1)..(991): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccgcggcgcagcccggcgaggccgtgaacgtcagcgagcggatcacggcgctcatctccgactcggcggtgcgcaccatcatgggcgacaggttcgagaagcgggacgaattcctggagggtctcgccgagggggacaggatcactccgggttcagcctcggcgacctgttcccgttcgtcgaggctggccagcttcgtcggcggcacgacgcggcgggcggaggcgaaccaccgcaagaattcgggctgatagagtgcgctctcaggcagcacggggagcggaggaccgccggcgccgtggacgacgacgaggacatcgtcgatgtgcttctcagggttcagaaggatgggagcctccagatgcctctcaccatgggcaatatcaaagccgtcgtcctggtaagtagacaagtacttgctgattaatactgtactaatctcccttaattgcacacgaatacttctgagcttagagtagtatttatcttaccaataattaatttttcaatcgtatctacaatcgtaccctaacgtacgttctcttccctaatttagtgaaggttcaatcacactttctggatctataatccattatattcgtgaaaggatgaaatataagacatattttaccaaacctcttttacctgagtgcactaaaatttgactactgttaatgtcaaaatctacaaagttttaccgtttaagaataaaattaaataactttaactgatgaatggagcgagtatatatgaaaatgggtaccgagctcgaattcgccctata

SEQ ID NO: 53846 - DNA, 784 bp, Oryza sativa
  unsure (1)..(784): unsure at all n locations
nnnnnnnnnnnnnnnnnnnnnnnnnnnnnnnnnnnnnnnnnnnnnnnnnnnnnnnnnnnnnntgcatgtaaattgtgagacgaatcttttgagcctaaatataccatgatttgacaatgtgatgatacagtaaacatttaataataacagattaattaaacttaataaattcgtcctgcagtttacaagcgaaatctgtattttgttttgttattaaactatatttaatattttaaatgtgtgtacgaatacttaaaaagatttggcccagcaactaaacacagccaatttcatgtgagcagtagtcaaatggtctccttgattaccgtcattagtcaaaatcgcagttcacatcatcacatattcacatggcgcgaaagattacgacacgctaccaattaccaaacccccaaacactttcccccctcaaagccaaacaatgattgaggcagccatggccggcggcgccatgccgctggtcgtgctgctccttgccaccatcccgctcctgttcttcaccatcaagcgctcggcgcagcgtcgtggcggcggcggcggcggcgaggggaggctcccgccggggccgtgggcgctgcctgtcatcggccacctgcaccacctcgccggcgacctcccgcaccgcgccctgagcgccctggcgcggcgccacggcgcgctcatgctgctccgcctcggcgaggtccaggccgtggtcgcctcctccccggacgccgcccgcgatatcatgaggacccacgacgccgcgttcgcgtcacggccgctg

SEQ ID NO: 53847 - DNA, 1676 bp, Oryza sativa
tcctccgctccgtggccgaagccacctcgtcttcctcctccgcctcgctggtcaacctcaccgagctgatctccgccttcgtcgccgactccacggtgcgcgccatcatcggcagccggttcgagcaccgcgacgcatacctgcggatgctccaggacgggctcaagatcgtccccgggatgacgctgccggacctcttcccgtcctcccgcctcgcgctgttcctcagccgcgttcccggccggatcgagcaccaccgccaagggatgcaacggttcatcgacgccatcatcgtcgagcaccaggagaagcgcgccgccgccgccgccaacgacgacgacgacgaagacgaagacttcctcgacgtgctcttgaagctccaaaaggagatgggctcccaacacccgctcaccacggctaacatcaaaaccgtcatgctggtaatcaagctctccctctctctatctcaaaaaccttcgtgttacttgcagagtccctgatcatggatcacttcccatgtttcatgatcctaggacatgttcggcgccggcagcgagtcgtcggcgacggtgctgcagtggacgatggcggagctgatgcgaaacccaagggtcatgcagaaggcacaagatgaggtccggcgagcactcgccgggcatgacaaggtgacagagccaaacttgaccaacctaccctacctacgactagtcatcaaggagacactccggctacacccacccgcgccattgctactgccacgcaaatgcggaagcacgtgcaagatacttggatttgacgtacctgagggggtcatggtgatcgtgaacgcgtgggcgattggtagggacctgacgtattgggataagcctgaggagttcgtgcctgagaggtttgaacacaacgggagggatttcaagggaatggacttcgagttcataccgtttggagctggacgaaggatatgccctggcatcacattcgggatggcgcatgttgagcttgttctctctgcacttctgtaccactttgactgggagcttccacaagggatggcggcaaaggatctagacatgacagaggattttggagtcacaacacaacggcggtctaacctcttggtgcgtccaatccatcgtgtatcggttccagtagagtaaacatacttgtaagatatatttataataaatgtaattgccaatgtacgtatattagtttcagtttaattttgtttttttataattggtaaaagtcgagtttgacattatatgtttgtggagtgatatatatatcatattaatttatttttattttttttataattatttaggtgacatgaaaaaagatataagaagatgtatcctcaagtgatgaaaatctctctccagatatacaatttctatgtatgtcattacttgttcaatcttctataactagggggcagataacttggttcatttgggctcattatcctctaattttcctcttgggtggtgcatcagtatattctccaatgttaatgttctctctgaaacctataaaacgttttgcactaatcagtaatcaagtataatcagttcggtttccgcattttgaaagaggcatgaataagttgtgtccagtgtggttttgacgtgagatgcacggacacagcgcacgcagaacatgtgcacatccgt

SEQ ID NO: 53848 - DNA, 1205 bp, Oryza sativa
attcaaagttcattcctttaaaatctatatggccatcctcaaatcgctcgggtctaaatgtcttagcgtcctcccaatatttagggtctctaccgattacccacatgttcacaagcacaatagtaccttggggaatcgtagtccatgaccttacatgtctcctgacattccctccctagggagaagtagtggcaccacaggatgtaaccttaaggtctccttgataataagtttcaaatacttcaatttaaccaagtcatattctgacactatttgctttccttggagggcatcacgtaactctgcttgtgccttcagcattgttcttggattcattatgagctcagccatcgctcattgaagcgtatttgccgatgtctcgctgccagcaccaaaaaggtcctatatgcatggtaaaaaatacatgatttcccataaagtgtagaaaatattgtatcaattccttcctatgttcactatgcatacttttttataaaaaggaaattcatgtactcgctccatttatccgtataagttattctttaaaggtaaattttatatattctgacctaaacagtagttaaactagatgtattgttgcggtagtggatttatattttaaagttgtgtcttactccatcataatggatgctatgtttttttagcgagattaaggatgaaaacaagacaatgatatcctctattaaataagcgaagatgatttcatggtggttgggggataagaaaggaacaaaattaagtgataggtgctaggtgcaattaaaacatgtccatagtagttcaaaatccctaatatctattgacaattggagatggccaaaatactttatatttgcgaaagggggagtagctattaagttatatttttgtgaccaaataaatttatagtttggtattaaagattttttaaaaaataaaataaatcctatcgaaattaagggagatatagtattagcatccacaggaaaagaaaaaaaaagggagaacaactagagtacttacaaggacgacagctttgatattgcccatggtgaggggcacttggaggctcccttccttctgaatcctgagaagcacgtcgacgatgtcctcatcgtcttccacagcgccggcggcggcagctgcagcagctgccctcttctcctcatgctgcttgagggtaccgagctcgaattcgccctata

SEQ ID NO: 53849 - DNA, 1631 bp, Oryza sativa
  unsure (1)..(1631): unsure at all n locations
tgatattgcccatggtgaggggcacttggaggctcccttcctctgaatcctgagaagcacgtcgacgatgtcctcatcgtcttccacagcgccggcggcggcagctgcagcagctgccctcttctcctcatgctgcttgagagcgcattccatcagctcgaagttcttgcggtggttcgcctctgcccgccgcgtcgtgccgccgatgaagctggccagcctcgacgatgggaacaggtcgccgaggctgaacccggatgtgatcttgatcccctcggcaaggccctccaggaattcgtcccgcctctcgaaccggtcaccaatgatggtgcgcaccgcggcgtcggagacgagcgccgcgatccgctcgctgacgttcacggcctcgccgggctgcgccgccgcgacggcggcgacgaggcggccgacctcgtcctcccggatgcggcggaacgactggacgcggcgggcgctgaggagctccaccatggcgatcttgcggagctgccgccacagcgcgccgtagggcgcgaacaccagcccgacgccgtcgctcatcatgacccggatggtggagctccacggccgcgtcgcgaacgcgacgtcgtgcgtcttggtgatctccctggcggcgtcggcggacgaggcgacgacgacggggacctcgccgagcctgagcgacatgagcggcgcgtcgagccggcgcgccaggtcggccatggtgcggtgcacgagcgggccgcgcgccatgacctggtggaggttgccgacgagcggcagccgccacggcccaggcggcaacttcaccccgccattattgtcgccacgccgcttcgtcctcaacctaaccaccataagagccaggaagaggaagcaagcgcaccacgccaccttctccatgccatccatggccatggcacacacagcacgcagatgcagatacatatatgcagaggtgttactgtttactactaggtggcaagtgacagaagcagctttgtcatggtgagttggattttgtcgccatgggagtaattgctagggatgaacttccaaagagagctgatgcatgcatggctgcaagagatagatggatgcatgatgattatcagattatgtaataacgtctattttgagttcagcggtggccactggctttgcttgacttttttagaattttggtgtcgggaaaatcaatgaaaaagatactctctccggttctataataattgatgttttagacaaggttaggttaaacttttataactttgaccattaataactttaaaaatatttactttaaacaaactagaacaacatatatagatttgtctttcaaagcactataataaaagtaaacatgcatttatttattgtatatattatagtagaaaaataagatcaaagatatattttgtaatccgtgtcattgtccaaaatgtcaattaaaatgaaaccgaatggagtaaatgagtgatctcaaactgtgaaaacgatgaattgagcccagctggcagagtggagttatgagagaggcaattgattttaggctggannnnnnnnnnnnnnnnnnnnnnnnnnnnnnnnnnnnnnnnnnnnnnnnnnnnnnnnnnnnnnnnnnnnnnnnnnnn

SEQ ID NO: 53850 - DNA, 1624 bp, Oryza sativa
  unsure (1)..(1624): unsure at all n locations
nnnnnnnnnnnnnnnnnnnnnnnnnnnnnnnnnnnnnnnaaaaaaaaagtatgcacactgaacaaaggaaggaagtaattgataacatatttttttacatatatgggaaatcatgttttttttcatgcatataggaactttttggtgctgggagcgagacatcagctatacacttcaatgggcgatgactgagctcataatgaatccaagagtgatgctgaaggcacaagctgagttaagtaacgtcatcaaaggaaagcaaacgatatctgaagatgacttagttgaattgaagtacttaaaacttattatcaaagagaccttaaggttacatcctgtagtgccactacttctccctagggaatgtcgggagacatgtgaggtcatggggtacgatatccccataggtactactgtgcttgttaacgtatgggcaatcggtagagatcctaagtattgggaggatgctgagacattcatacccgagcgatttgaggatggacatatagacttcaaaggaacagattttgaatttataccgtttggagctgggcgaaggatgtgccctggtatggcatttgcagaagcaatcatggagctcgttctagcctcgcttctctatcactttgattgggagcttcctgatgggatctcgccgaccaaggtggacatgatggaggagttgggtgcaactattcgaaaaaagaatgatctttatctcgttccaactgttcgtgtgcctatgtcgactgccctatagctgtttacacttaagagacaaaatatttgtctcatctgtacgcgcctatatgataaactatataacttttgatggattgatgtactcctactttgcatcctactcgttctacattattactttaaatttagttattaaactatttaatttatatatatgatcaagagtttaactcgtgacaataatttgataaataatatgttttaaatgctaaagtcctcctagcttgtcaattttgatggcggtcacctcattacacatatacatgtacttgcacgcacaatatctggtgtagactctgggatgccataaccatgaacaatatggagaaaggaggataatagtcgtgcctcctattgctggcagtagctctgctaacacacaatggcgttgtgtgaagagaagaggataagaggcgggttggagcctgagagttggaagggatgaggtggagaggggtgggacaaacatgagaaaagaggacttataattttgttttaaatttggtcaaatttaagaattttgactaaaaaaagttgaatgccttgtaatataaaacggagggagtaactattattaacagataaaattgtgtatagttgtattagtgccggtacgaaagtagtcgcgctgtccctctcattttgcaataatttctcttgcctatcttttcaaaatagggatagccgcactgtacctgactttttttttcacttacatgaatgaatgaacttctctatggaaactagtattttgatatctcgagcggatgtccacttgtctatttataaaccatccaaacaacaaagaaaaattctcaaatcgtctacactaacagcgtaaattttttaaatcattattcac

SEQ ID NO: 53851 - DNA, 1281 bp, Oryza sativa
gaatgcccttactttttacttgcatgaatgtccccatatcgtgcgacaccattcctagatggtcgtaaaagaactactacctgcttaaaacactagtaattcttttactagtgttataaatattgtttagatttcgtggtctgcgagtaaaacaattaccaccttcctctcgatatagcccatgatctcgtagctactatgtagtaatatgtttactgatatgttcagtacactgtataagagtaaaagctgagacttcgtggtctgcgagtaaaacaattactacttttctctcgatatagctcatgatctcgtagcaaccatatagtaatatgtttactgatgtattcaatacacggtataagagtaaaaaatgatactaaaagtattgttaatctatatcacaaaatgaccgtacgaataaaaaaaattacaggctcaatcacatacaaatgataaaaattactcacaagtgaatcaaactagaaaagaaaaaaaatgattcaaccaaaaatccatcgtgaaactaggattctggtggctttcttggatcttgctataaggatggagatgccggtctgtgtcttgtgacaggtagtggagagggcaaccagatggcgagcggtagtcgatgatggaataatagaagggtgtagcggcatggtatagagatgggctcgacattgcgcagtagcagccatccatcatctagcaagcacgaaaaaaatgcaagaacattctcgttcatgttatagagacgacgagcaaaagaaaaatagcaaaaaacctccatcatcggcaaactccaccctatcctctgcggcgaaccacatggagcatgatgtgcaaatgtaggacctatgcagcccatcaattcagatcaagtaatattggagattgcacgttaatctgatttgcaaaaaaaaattggggcttcatgcgtgaaggtaaactagagtatgcagatgcaaatcggagtgctatttccttacgtgcttgttctgtcaatgtcgccgacgtggagcagccgccgattgttgctcttgacctaggtgaacgcctctttactagttaaggtgttgctcgacgtacggcagcgaggcccgaagcagcgccttcgcatcaaccgccaccggccaccgctcgccggccatcgcctgtcgtcgtcctcctccatggtgcgtcaccgatctgtgggctgggatgatggatcgatgcatatcccaaaaaaaaagaggaaaaaataaagtgggggcgagagtggttggttgggtacgggaa

SEQ ID NO: 53852 - DNA, 1584 bp, Oryza sativa
agttggacacggaaaccagggtttgtcttttttttttttttgacggagggagtagatgcacgcgtcgcatcatatccgccgcggtagcgtgcgatgcctccaacctgcacacgtcccgtacgtctcgatctgcatctacctgattcttcggatgattctctacagtagttcagaacaattcttgtaacgatgaggaatatggtaagagcctgaggtgagactggagtcggaggggttaggagtaaagacgaaaagaagattgagcaggaagtgattgatcagacggtgcgcaaacgcagaaactttctgtactatatattggttgtgttgtctctatttgtttatgtggctacaactagatatggtggaagagatgtcctttaaatatttttaaaaagaaattataaatttgttagagattaaaaacgatacattggggttgaaaccatacgtcctttactattgtgctatcaattacatctctttattttttagctgttgcttgtaatttcatctggttttgcactgtcatgtatcaatctaattgggcatacaatctattatatattaaaagtccatcaaacattttcaggaatgctcttaaatcatcacattatgctaataaattagagaaaatcttaagaattttaagaaaaaaaaattcaaccgttaattttcacttagggctcattcgaaaggtagaatttgaaaaaaaaagtaggaccaaaaaatacatataaatgggataagaatgtttgtgtaaaatagatgattgaaaatcataaaaaagtgatgttcggaacaaaggaattgctaataagcataaaatctttttaaagcaatcacattagttgcttgcattgttctcaaattataaatcgttagattagattgatcctaagaatagaacgcccaactaaacccagctacagatcggttggctgtgcacggctgcgatggaggcctggagaaggcgcccgatcgaggcacggaagagactccgggatactatcactctctccgtttctataatataagagattttggataatgtaacacatcttagtacaatgaatctaaatatacggtacgtctaaatttattgtattagaatgtgtgacatccatctaaaatactttatattatgggatggggaatagtagctagctgtacgttgcctatatgcaaatcaaagactcgtccttccagtgaaacatgccactctatacatcaactgccctacagctttgcaaagtgcatgcaaacagtgtcctacagcttaatttgcgaagcgtaagaacagtcagcgacgatcatctggcctgccatacaaagctcgatcacccgtaaaccacggcctaatataaccacatcctggtaaaacaaaccacacaaacacaatgatcgatgaacaatgcgggcacatgatctcacctaacaactactgagattaaaaacgaataaattgatgaggaatagatatctaaggctcatgttgactacggtttttttttaaaaaaacattatagatcacatatatcatacaaaatgaggtctagaatatgtatatctcctccatcttta

SEQ ID NO: 53853 - DNA, 1990 bp, Oryza sativa
  unsure (1)..(1990): unsure at all n locations
cgatatggacatattttgtaattctcgggtataaatagacccgagccccatgtaatcaaactaacacacgttcaatacaatctcggcgcatcgctaccctttttactttcgttttgtttcgacgagttcttactttcgggttgagctgcatcggtttcgatcttcaactattgttatggcgtcttgcgttctcgggattagtgcttccatctttatgatactctaatcttgtttatataattcgtcgagttatcatatatcccatataatctccggcaatatcgttatctaacctccaatcggctaacgtctgttattagaaggcagccgattaggttaaataccgacgttgacttagattatataggatattcaccactctatgaaacatccaacggtttgattgtctagatattgtccttcttttcatacttatagctgcatcagttgggtttgaccttataagtcgtgattagaatctcaatctctagcctgcttttggttgccgattagggtagcatcggagtttcagccgatcttacctgatttaactacatttatcttatatgcttgattgacatgttaaatctgtcctttatgattaagatattgttgcatttatgtatattaggcttttgtttggtatattttacttgctttgatatcttaatatagagtactagtatcggagtattagccgatacatgctagatctatctgatcggctatgctatgaacatatatagtcttgttgttaatatatatttcgatctaagtgatttatactgtctcggcatggcgaccgatatatcccaatcacttgatttaagtatatatcgacatagagactatatattgttaatatctatagccgatcgaatagatttagttctttcttacttattcatgactgccgatcgattcacatatgacatcggctcaaagataaatgatatgtcatcggcaactagccgatcggctatcgtttatgaatttaaccgtggtttctttgtctttatttcttgttgattgcaggatcaaatcaactggcacgctcatacacctaaaagcaagcttttgaacctgcacttgagttaagcagatctcccaggcctcgtgttttcacatcaacatcctttacctcgtgaaattatacgtgaaaattctctagttattatattccaaaattttctgctcgatttggacaatttttctttggaaaatatgtggtttccacttctatattatcaacaatagcaacatgctcgtatagtccagcatgccaaaaaaaaaaaacatgcccatacaacttgtggaatgaattcaaaggccgtgtgcttaaaatcaattgcgttatctgtgattcgctctagcttgaactccttgggcagcctttgtcccaatatttagggtccccaaaaatcacctacacgttgataaatgcggtggtgtcttttgcaaggttttaaatctcctgctatagctatacaactatcccaggagatagttgtttgaggatctagctatttgctcccatgtactataatttaacaactatccggaggatatgcgcggcggcctcacggctacaaagccggcaatgtcgcgactcacgttcatgtacacactgtcgatcggtttttagcatcggttgcacttcgatagttagctgcctcctgttggagtcaatgaactatttttgttgattctcccgtaagtaaatcgcagtgccagaaatcacagcaatgaaacatggaaccttattaagaaagccaaacatagaataagagatttctgtcggtttattaaagccgaaacgagcagcgaggtacaacttgtgcgacctcatgtagaggcatcacaagcacacatactgattgccacatcaaggacggaaggtgctatgcggtaagagnnnnnnnnnnnnnnnnnnnnnnnnnnnnnnnnnnnnnnnnnnnnnnnnnnnnnnnnnnnnnnnnnnnnnnnnnnn

SEQ ID NO: 53854 - DNA, 2188 bp, Oryza sativa
atgtgagatgaaattcctcacacttgtctgaaatcttgaatgatcaatgaatgtggctaatcctatgctatgccactgcttaatttatagcttggttgactggttgtatggcttggcagtttctaaaatagcagtccaccgaaagatagtgggccaataataatggtatggctaataataaaggtggaatggcttggcatgcatgtaaacatgcaggaaccggtagagtgacatggcccaagaaaatttggacttaaaaagacattcttgctgcacgctagaaagtaaacatcttggacatcaattttagatctaatggctagattaatttgaagtgatgtggcaagctgtgaaaagagaaaattagcactagttgcacttagtgagaatgaaccatatagatatataaaattaatgcccttctcgattaattccttcataaaaagttaagaaggatttagagaggattacttaatctccaacattccttccggccttcacataagaattaaccgaacaagctttttttttctaaggcgtggaagaactctttttcaaaagaattttcaagcggatcaagaggatgttttgagaatgaaaagatcgaatgctaattttaaataggacctctcatgttctttttatagagcatgcatgtgtcatacgttcaaaacacgtcaattataaaaaaaaaaaaagaggtggtacactttaactgtatgatttagtgcaagcgcaacaataatgttcagatgatgatgtaatgctgtccgttcttaaactgcaagatttgcagacacttctttgccgactaatctcaaagacaatataagtatttattgatcaccgcttttcatcgaatcaatcactagctagtaacacaccgacacaggtggggcctggcccacgtggggagagccggagagagaccagcaccgcgtctagcttccacgtgcttatttttaaaagacaaaaatacaaatccatgtactcgcacactcgttagtataaatgcacgcgcgtactttatttttataagcaccttcaaaatacttaccggtactccctgttttaggttataacttcaaatttaactaaatttatagaaaaacagaaatattttcaactaaaaataaatttattataaaaatatatttaattattaatttaataaaactaatttggtaatgtaaatattacaatattaaatcttgagttgaaaatatttctattttttctataaacttggttaaactttaaatagtttgactttaaccaaagtcaaaatatcttataatctaaaacggagtatacctttagattgatgaagtcgtcattgatgtcacactatcgacgagtatattatatatcactgaaagatgaattagtcgtaaatgtgaacatatcaagtctagaatttgaattcggatcaactgattccacttcgcaacatccatgtgcttttgaattccacgtgaaggagaaaaagggtttgaaatattggacttttgcaaatttatcttctaaaaagacttcagattccgttgattaattatgtttgaaacgagaagttctggggagttaaaactgctaactggcatggttcagaactgagtcaagcacaccacaacatcgaccagagcaagaattccgaattccacgtttcgaaaatttcttaaaactgatcaaatcaattccactataagtttataattcgctgaatcgtgagcctcttttctcctctttccatccccctccttttcccttcctacttccaggctccagcagaccagcacgcctcttctcctcttctcttcacacaacgtcattgtgttagcagagtcactgtcagcaataggaggcacacgactattatcctccctcttacgtattgttcatggttatggcgtcgcagagtctacaccagatattgtgcatgcaagtacatatatgtgtaatgaggtgacagtcatcgatcaaaattgaaaagcagattattcatggaattattgtcatgagttttctacttgattataaaaataaattgaataatttgagaattaaacttaaataataatttataataggtaggataggaagtaggagtacacatcatcaaaagttacatagcttatcatttagacacgtacatacgagacaaacatactatttataagtgtaaacaact

SEQ ID NO: 53855 - DNA, 802 bp, Oryza sativa
cggctgctgcataagggaacacggtccacatgccctggtttcaaagcaaagcataatttgattagaaaaggtaaacaaagattttactctcaatttttcaggagaggggaggagatttaccacagctgccgcaacacttgcgagtgcaacaacaggccgttctctcaggaaaaacccaacagctagctgcaatgagacatcattagtgtcagctgtcgtaaatacagattgaagaattcttattcatgtatttaattcgattgatctgtaagatgtttgaatataacaatggtgtcagcctacagattaacaaggataaacattgtattgtaagacaaaacatttttttagttgccacaactgcattggaggaacatagaaataatttgcagattgattctatctagtaaaggtgaagataaaatcagcaacaatatggccaaagttccctgccagcaattaccacccaggaggccaggacagaattgaacataaaaggtaacaaaaaaaaaacaactacataggagtatatcctaaaattatagccatcacgccaagtagtaagtctctataaagttagatcaaacgtcctgagcaagtgacaactcagtaacttcagaagtaacagaaaattaaaatccaaattacctggataggaagagtaaatagacaaccacagcaaactccagcaaaatacagtctgtggtatgccctgtttgtaatcgtcagttaaaatatcgggtttatcagaaatttctgacagaatcactgtgagtgaagcctgggaaaatgactaaccaat

SEQ ID NO: 53856 - DNA, 2022 bp, Oryza sativa
tggtacgtcatccgtatatgagttggtttttaagttcgtttgcttttggaaatacatatccgtatttgagtcggtttctaagatcgttcacttttggtaatacagaagggatcatataataaatctgtttaaaaaactcgcatgctaacttgagatgatcggattcctaaccacagctcatgattttctatatatatatatatatatatatatatatatatatatatatatatatatatatatatatatccaaacgaactcctacagtaaatttcgtcttaactaaaccatataataataataagattaaaatagttttcacccgttgcaacgcacgggtatttttttctagttaagtataagagtcaaagattagtgttatcattggttacggcatggtacgggacttattgtcgaggtctagtaatgaaaactgcttgatatatcaaacaactttactactgtatttctcttttcaatacagctcgaatcttaataaaaacatacaaaatgactcaggatgtaagtgcacatgcatttgcagcgtcaaattcctcttcaactctacaaatacacacacattattactgacgagagtggaacatacagattaatattaataagaggaattgcacaatggactaggctttttttttctttaccacagttgaataatgggccatatatttacttcatgttttcacttaggactaggttttctcacactttattctcattggactagtttagacttggatctttttttctcatcgatgctgtccatccacaactcgaagcttgaccatgaccatatgcaattgagtctcttggtggcatcctacaggactttgcgtaacaccacattcaccttaggagaatgggcataaggtatagggctgacggataggccggccgacaacgatcatctcgagccacgggttcaaagtgtcaagtttggtaacaaaccatgattcaacgcaaatggttttctaaaaactagtctaatatgctacttagataataaaacatgacccagagtgaaatttggtcataataatatactccctccatcctaaaatataagcatttttactatagtgacgagtcaaacgtttttaactttatctattaatagaaaaaaaatattaatcacgtaaaattgatattattagatttatcattagacaaactataataatatgtaactctttttatttaaaacatcttacttttatagatattgttggtcaaagtagtatcacaaaaaccgtgtcacagtccaaaatgcttatattgtgggacggatggagtaaatgtaaacttatatatgttgtcggtcagcaaaattccaataaagcaaaagtcttttcaatttttcatctacaatgaaaaatgcagcagatacgaggagtggtaaaagaactagtaataacactctagtagtagctgctgcggaatgagttggcggctcagggtgtaacccatttataggtcaaaataagtggactcgcggcgcttattttagcatataagtaggtttcgcgggttagacacttacaatccttagcggccttcttcagagtcatagcaaaaggtttgtttgtgtggagagatgttatacaatttatggatatcttcacagtcatagcaaaatgtgaggtaaaggatgaagaaacctccttttgggggtgatgtatggaatagcatagtcagatcaatctctttcccaagagcatattcttttgtttccaacgaaaatgattcagtttgcatcgcaagtttaaaagacatatctcaaaccttcattctccactttataagaacatgcttatcaggaatatatccaaatgttctgaattacttgcatctataggaattcagtgccccttcagtcaatgattgttggttgaaacctgtaataaattgggattcgtctttaagctttgaagaaattctacatcaaggcagccaagatgtcacatgcttcttctcactctgttgaaaaggtcctatatgcaacat

SEQ ID NO: 53857 - DNA, 2451 bp, Oryza sativa
aaaataaaataaaatgaagaataaattacactgtgaactatcttttattaccaaagtttcattctagaccatcttttatttttttttcacttttcgctaggtatttttggttttttattttactttaaccacccaaactttcttgttttgataaatacatttgagagatccaagaaatactgtagaagaaagttttttaaggaaattaatttttagagacataaagcaaataatccgcaacaataatctagcgaagtagctaaacagaacatagccttaattcacgactagacatttctaaatatgagagctttcttagagggttcccaattagtataggaataaaaagatcaattgatcgatgtagttgcttctttaatcgtatgaatgaaaaaaaaatgtggataaaacttttatatgttattagcagtttaaaagcaaaatgctggaaatagagcacgatgaaaaaaaaaacaaaatcaactcttaactttagtttcaggtgataaattaagtttcgaggttgccactctcaagatctgatccaagggatcaaagatgtagtaataaatgtttcatccttgtttcatcaagttctacggagtactagcaagggtcagccacagatataaagaaatgaagtgccggggaaaatagaagtccatagatcgcatggtgcatggtgaaattaacccctgaaagtttgctgatcacaacaatattctactcctacttggttcagttctctgtcttgttagtaacatcgtacattactttacatgagtaagaaatgggcagatccgtaaaggataccgtatcacaggcaaactagaaaacgcagcttacaaagagtgcaatatggcggaaaaacaaaactattcttgaaagaatgaactaatcagtctattacctagcaactccattttgatgatttatggtcgatggtcgccaacttctctgatgcagatgctcaagatgacacctacgcacaatgatccatccagttgctgatatatgagcataagaatgaatgcatgttcagtagagcaccggatagttgtcagactccgcatcatattcatacggataaggctttcatgtttgtatctgcccagacttggatggttgaatttagtacttgatcacatgatgtcgcaaccatagttcatacataaccatgtggaacgcgtcgtaaggaagaggaggtgaatgccacacaaagtgtttctgtacctgcaatcccaattaaacatgttacagtatagtaccgcactgctgaaacttcagtgcctctaaacaatggctgaatcaaattatttacacgcaaacagacctgagggcagctaatgttctgaacaagacaagtgacacattacaatcttgaccaagtagcttatttgtactatgaatgtgatctactatatttattttccattacagttaagtacaacgctgaattacatgcttccttttgtaaataattcggcggcttcatagaaaaaaaggagggtcaagagttgcaaacctgaacaagagatttgtgcaattcaacaaactcttcctgtgatatagatttaagtatactttttagttgatatacatcacgctccttaagtacaacagcaaattttctccagtctaggatatcattgaaaggcaaatcgtagtagtctgacaaaataactaaaaggatgaaacaaaatggattagaactcaataatcagaagggtactgaaaatatcagttcccgtgaaataggaaaaacagcataagtagagtggcatgtattatgaatgtcactgggtagaaatactaaccaggaacacaaccgtagtgtattgaatcagatatacgggcactattacttgagagccacccaggacaaatacagaactttgtgtggtagaactgcttctggtaaaccagctctccaatagctctactgatccgattgttactgatagcaagctctgtatcattctcccagacttgtgccaaaatgactcttattttagaattgcgatggccagcccaaaatccaaggattgtcctgttgccatggcaaaagcaacaaaagacaaattttgtaggagtgcaaatagatgttcaaaccatagcatcgtcacaaatttatggtcatgacaactttcattttgctacaaggtgattcgttgcacatgaacaaagtgctgaactaaatgtaaaaccatgtagtcttctgaattaatcataggttgtaagattcaaggcatgatcaacaagataaccacgtgagtaagtgtgagtgttttacagaatttctcaagtaaacagatatttttcacttgaaggcactattactagaaaagtctagaatcatacatggaggcacacatatatagtcagtctaggaaaaagaatcattcagaagtcccaaatgaacaatttttttatgaagacaaccatagaaga

SEQ ID NO: 53858 - DNA, 2051 bp, Oryza sativa
cgacggggtgaagctgccgcctggcccgtggcggctgccggtgatcgggagcatgcaccacctgatgggcgagagcctcgtccaccgcgccatggccgacctcgcgcgccggctcgacgcgccgctcatgtacctcaagctcggggaggtccccgtcgtgttggcctcgtcgccgtgcgccgcccgcgagatcatgcgggcgcacgacgtcgcgttcgcgagccggccgctgagccccaccgtgcggcggatgcgccccccccccccccggcgacggcagctccgcaagatctgcgtcgtcgagctgctcagcgcgcgccgcgtccggacgttccgccgcgtcagggaggaggaggtggcccgcctcgtgggcgcgctcgtgtgtttggcccatgtggcccagaagtggttgtatagtggtggtttagtaccaccttgaaagtttaggtgggttaggatctgcttataagccttggtgctgcgccatgattggggccaggttcgagaggcgcgacgagttcttggagggggctcgccgagcaggtgaagtgttgttggcccaaccgggaaaaagcctgatgaaaattcaaattcaaattaagtacaaattaaaatccatgtgctaccatggtagattatacatgcttagttactctactactccctctgttttatattataagtcgtttgattttttttccagccaaactttgttatgtttgactaaatttatagaaaaatttaacaacatctaaaatactagattagtttcattaaatctaacattgaatatattttgataatatgtttattttgtgttaaaaatactattatatttttctataaacatcatcaaattaagtacaaattaaaatccatgtgctaccatggtagattatacatgcttagctactctactactccctctgttttatattataagtcgtttgattttttttctagccaaactttgttatgtttgactaaatttatagaaaaatttaacaacatctaaaatactagattagtttcattaaatctaacattgaatatattttgataatatgtttattttgtgttaaaaatactattatatttttctataaacttgatcaaagttaaagaagtttggctagaaaaaaaaagtccaacgatttacagtatggaactaagggagtagtagttagtagatggtacatctgatgttaatctcaatttttttcttgtttttttctcctaggatctctttagtggagggagtgagacatctgcaaccgtgatccaatgggccatgtcggagctcatgaagaatccaagggttatgcgaaaggtacaggctgagttgcgtgacaaactagcagggaagccaagggtgacagaggatgatttgtccgacctaaagtacttaaagctcgttattaaggagaccttaaggcttcaccctgcagcgcccttgcttgtcccgagacaatgccgtgagccgtgcaagatcatgggatatgatattccaaaaggtaccaccgtatttgttaatgcgtggctattggcagggatcctaattattgggatgatgctgaggtgtttaggctagagcggttcgcaaatagtaccatagacttcaaaggcatggacatggagttcataccattcggggcgggaaggaggatgtgctctggtctagcctttgcggaagctattatagatctactgttttctaccctgctcttccacttcgactgggagctcccttgcggaatgacagcaagtgagctggacatgatagaggagatggcccttactgttcggaggaagaacgaccttcacctccgccccatcctccgtgtgccgcaaactcaaacttcttctgcacttctattttgtgagagagctcaaacttcttctgtatttctgttttgaaagagagttcaaacttctgtttgttttgagagagtacttttgtttattttgttttgagagagagagagagcgcgcgcgctcaaacttcgtttgcacttttgttttgagagggggaatgcgcactttatttcggt

SEQ ID NO: 53859 - DNA, 1514 bp, Oryza sativa
tatggtctctatatttataagtgaatatacacaataataaatagaaagataagagatgatctatgtggcgcctccacctcaagatgacgtcaaataaaatgtatttttatggagactttaacaagacaactcaaacagtgctctccgtttgttttttttccttcttcaaatatatatatatatattctcgtgtaataaaaaaatattaatacattcgacttatttttaagcgaactctatttaatagacacttgcccaatcatatatatagccatcataaatacatatatatcttctcgtgtagttaataaaatacttatacactctatattaataaaatattaatacatatttatcttctccctcttcttcactagctagacacctgtccaaccatatagtggtgtattaactatgtgccaatgttctccaagagtccaggttggaagtctctgctgtcactaaccctctccagtgtataaatagccgggtgcatctcctccatggcactcacctcaccacacaccactccaccatcactcacagccaccacccgccgccatggagcaggtctcgtgcttcgccgccgccgccgccgccgtcctcgttgttctctcgctcgctcgcatgctcctcgcgccgcgcagggagtgggacgggctgaacctgccgcccagcccgtcgcggctgccgttcatcggcagcttccacctcctccgccgcagcccgctcgtccaccgcgcgctggccgacgtcgtgcggcagctcggcgcgccgccgctcatgtacatggagatcggtgaggtcccggccatcgtcgtgtcgtgcgccgacgcggcgcgcgagatcatgaagacgcacgacatcaacttcgcgtcgcggccgtggccgccgactgtccagaagctgcgcgcgcaggggaagggcatcttcttcgagccctacggcgcgctgtggcgccagctccgcaagatctgcatcgtcaagctgctcagcgtccgccgcgtcagctcgttccacggcgtccgcgaggaggaggccggccgcctcgtcgccgccgtcgccgcgacgccgccgggacaggccgtgaacctgaccgagcggatcgaggtggtcatcgcggacacgacgatgcgccccatgatcggggagaggttcgagaggcgtgaggacttcctcgagctcctcccggagatcgtcaagatcgcctccgggttcagcctcgacgacctgttcccgtcgtcgtggctcgcctgcgccatcggcggctcgcagcgccgcggcgaggcgagccaccggacatcctacgagctggtggacagcgccttccgccagcggcagcagcaaagggaggccatggccgcgtcgccgcctgacatcgccaaggaggaggaggatgatttgatggatgagctcatcaggatacacaaggaaggtagcctcgaggtgcctcttactgctggcaacttgaaagccgtcatctagtaagtatttttcttactcccctgaatgtt

SEQ ID NO: 53860 - DNA, 1141 bp, Oryza sativa
caatatatggatatagatttgtaaggttatggataacatatacctaatagtaatcaactaagcttggcggggctcatcatataccaagtcctatatggaatcataccacgtatatagaaggagttccggataaggaagaacaagtagagttctacatggaaactgtaagaactactcggattgtatgcatattggtctcctagttctacttggacaatgggacatctatgggtataaatacaagacccattaggaggagagggagagggagagagacgaagacaacatctgtcagaatagacaccaatacacgccgccggacatcaacatcagaaataagcctagacatacccaatctggcgcctacggaggatgacaagagggatctggcgctatctctaatcttgccgggtacttattcaaggaggaagactaccctgtcgtcgacaacgtgttggtgttccatgctgccaagttgacgacaagtagataggttatctcaaatattgtacttgtgtaattctgatgaataagagcaacatcggctttggccaacaggagtagggttattacctgattctgatgaataaggggtccgaacctgtatatactccgtctcttttacctcaatctcgcatataccctggtaccaatgatcaccttactatataaatacagtagtcgtgatctaaaacattgacaagatccgatcattgtatccataaattgatatacacaggtaatagatagatagatagatagtggatagagaaccaatctctatacacagccaagataggtagatataaatagatagatttagttttgataatggatagagatattgcccctacgttcacaagtggatatacacataaaagatagatagataatggatagagaaccagtctctatacacagccaagataggtagatatagatagatagatttaattttgataatggatagagatattgcctctgcgttcacaagtagatatacacatagatagatagatagatagatagatagatagatagatagtgaacggagtacaatctctatacaccgccaagataggtagatatagatagatagatttaattttgataatgcatagagatattgcctctgcattta

SEQ ID NO: 53861 - DNA, 969 bp, Oryza sativa
  unsure (1)..(969): unsure at all n locations
nnnnnnnnnnnnnnnnnnnnnnnnnnnnnnnnnnncaaagcgaactactgaactagtcgttatgattctatcagtttctttaatgagtaaattacctttcacaacaaacgaaacaatacgatgggtagaaatagaatcataaccgggtctcagaacaacaaagtcaattgcttcagtataaggacttcgtttggttcaaaccgggtctcagaatcataaatgactgaccagcttgacgggaacatatcctatgcacacaagcttctcgtgcacaccaactagtaaatttcacagaaaattctagaaaaattaaacacatattttcaataatattattaaattgtgcacgagaaacttgtgtgtataggatatgttcccagcttgacatgtcaactttcacgtggtttgcatttgtttccatcggagattcggagttcatctctactttcaaaaaaccgttcaaaatttttagactaaactagaaaggtagtccctacaaatacgcaggcatacaacataggccatgtacttaagaaacttataaaggtttagatatttttttctcagtctatttgttagctctatgcagtatattatttagtaaatttcaagaaacaattaattatctaaaatctgtgtcatcatataaaaagaagatagactagtaggatatgtacgtcggaaaaaaaaattgtatggcacacctattgagattctgtcacctggcgtgcacaaatcttggagcacttctaccttcaaaaccgcatgaaactaattaactggctatcgctaatctcgcgcgcggaaggattccggcggtcgcgtgcacgtacagtgcacacaaatttgtatgcattccgtatctactgagcacaacaaagtacatcaatcaaaattactcacacactgagggtgtgcttagttcacaccaaaattaaaagtttgattgaaattggaacgatgtgatag

SEQ ID NO: 53862 - DNA, 718 bp, Oryza sativa
cacttttatgactttttttttaaaaaataaatatgtatttttttatttcattatctatcaatattttttgggataaataatgcatcgaacaacaaactcataactataatagtcttatgcaagaagcttttatatttttaataatgtaattcatgaatttctttgttcatccaagggtaaaatggtcatttttatagaaaatagacggtcaactaacggtgaactgacgggaggggtatggaagggatcagaattaaaaggaagtaagtaaaatttaggggtatagaagggattaggtaaaatttgaggggtatacaagggattttctcttaaacatatagtagtattttgatctcctgcttatcatggctttaactagctaaagctaatgtgaaacaagagtcttttagagccaggagtaatggccatcctacttggaaggccaaaacatgaccaaaaaaaaaatcaaaaaatgaagatctttttgttaggaaaaagtaacataacaaaagccacgagataaataagcaaacgtccagcctctctcaaacctgccagctggtgtcaattaatcttttccccttttgtgatcgcccatttatcatttttatttattttccagccactaaaattctcgtaagcatagccagcgcccagcgaccaccgctgaagtcaattaattacaaaatcggacgaccttaattagagtacatcatca

SEQ ID NO: 53863 - DNA, 1027 bp, Oryza sativa
  unsure (1)..(1027): unsure at all n locations
gnnnnnnnnnnnnnnnnnnnnnnnnnnnnnnnnnnnnnnnnnnnnnnnnnnnnnntatcaactagtatcaaatttgaattttaaagcttagttttagagttaatgtggattttttatcatattcttttttaccttagtttttaatttttttataccctagataaagtagactaacaaatatttactcataaattatttttgatgcttgctcgtttttttcctgcactcataacacaactgatcactacttcgggtgcaaagttgtaaactcaactaattaccgtaagagggtcagggtttcaatcatttaggtggacgtccactcatttattgccgttctactatcttactgatggatcggctgtgggaagaggtgctcaattcacaatcagcctttccctttttcagatcagtccgcgtccaccgaagaaatcgcggcaaactcggcaaacttttgacgtttaccggacaggcaaagctaccatcacttcgttgtcgttgctgtatatccacgaccacgtcaaaactgatcccatggcgccaaactgaacaccgtgtcgatctccgacctcgtcgtcgccgcgacaaaaaccgctttgatcatcacctcgtcgtcgacgcacctccaccgcatatgtagcagtagacaagtagcatctgcatctgcgtgccatacacgattgctccagctagctgcacctgcacatcgccatggccatggccgacctggagttggagaaggttgcgagcttcttgctggcggcgctgctgccgctcgtgctcttcaagctggcggcggcgaagcgcggtggtggcgatggcggcatgaggctgccgcctgggccgtggcggctgccggtgatcggcaacctgcaccagatcatggcgggtgggcagctcgtgcaccgcaccatggccggcctggcgagggggctcggcgacgcgccgctgctgtcgctcaggctcggcgaggtccccatcgtcgtggcctcgtcggccgacgccgcgagggagatcatgagcaggc

SEQ ID NO: 53864 - DNA, 1786 bp, Oryza sativa
cagagggagtatttaacacgtaaatattccgcagcaatacgtgggggtgtcatctagttaatttatattttgaggtttgcccgtctataagggttggaacccctctcggcatacaaaataaacaacgtttctaccgtctataagtttctagacatctattggaatccatccaaatatttccgacattagaaatttacaaatgctgtctccggcgccgccgctcctgcagccacacttcagaactttctacttgctgtgtttctattgcctgtggaaccatcgacatgatgtggtcttttgaaacttgcaatctcttctcaaccttttgagacgatgtttagaagaaacaaacctctaggaacaccgtttcaaaatcccagagagaatagcagtccagtcttggaaagctatattttccaattctattttctctttgcatttgtaactgctagctgctagctagcttgaacacttcaattgtaccctatttttctcttcaatggaaatctaggtggggaacctctcccctccggtgattattaaaaaaaattaaaacaatgtatcagcgtatgattcattaagtattagtttaaaaattttagagaaagaaatctatctattatattattaaaacagctttgaaaggaggcaccacattcgctgtgggagctagaaattcccacattaatcggagaaaaagaaaaaaagaaaaaggagagtctaagtagaagtacaatttaaaaatagctaaaattcggaattaaaataagcaatattgaaagaagtttccacataagaacccaatacgagattaatcaaaattcgaaataaaaataaaaaaaaatctaaaactagaaaaggaaaggagagtccaagtagaaatacaatttaaaaatagatgaaattcggaattaaaaataaggaatattaaaataagtttccatataagaacccaatacgagataaatcaaaaatcgaaataaaaataaaataaaatctaaaattagaaaaggaaatgagagtccaagtatgaatacaatttaaaaatatctgaaattcgaaattaaaaataaggaatgttaaaataagagtccatataataacctaatacaagattaattaaaattcggaataaaaataattcccacattaatcggagaaaaagagaaaaagaaaaaaaaggagagtccaagtagatgtataatttaaaaataactgaaattcaaaattaaaaataagcaatattgaaagaagaatccaatacgagattaattaaaaattagaataaaaataaaataatatctaaaactagaaaaacaaaaagagagttcaaataggaatacaattttgaaacaactgaaattgaaaataaaaaataaaaacattaaaataacacaatacgatattaactaatttttttaaaaaaattctgaaattagaaaaagaaaaataagatatcaattaggaatacaatttataaataactaaaatttgtgataaaaataaagattattgaaagaaaagaccatctaaaacacatgacgagataaattaactaacatgcctataaagaagtagagtggtggcggttgatacgagatataaaaattgttaataaaacatcaaatagaatcctaatgacgattaaaaggagagacgtcaggcaggccgtgaagcaaacgagtaaggcgattgccgggacttctagaaagtaaaaaaaaaacaaaccccattgataatcatattcgatttttaaaatctcaatgataataaaaaggagaagcag

SEQ ID NO: 53865 - DNA, 1101 bp, Oryza sativa
agacgtcaggcaggccgtgaagcaaacgagtaaggcgattgccgggacttctagaaagtaaaaaaaaaacaaaccccattgataatcatattcgatttttaaaatctcaatgataataaaaaggagaagcagcaggcggggtgtataagagtacagttgcagagctgccgacggttaacaggacttctagaaaataaaaaaagaattctagaatcacaatgataataaagagttggcggcggacgggctatagaggggcatagtggcatcgtttgatgggacttctaaaaattataaaaaaataaaactacaagtccaatttttaaaggttttgaacttctaaaaagtaaaaaaaacccaatgataatcatgttcaattttaaaatctcaatgccaataaagaagggagacagcgggcgagccgtagaggagtacaatagcaaagccgctgacggtttggcgggacttctagaaagtaaaaaatgaacccaaacgataattatgttcgatttttaaaatctcaatgacaacaaagagaaaagacagtggacgggccgtagagtagtataatggcaacgtttgatgggacatctagaaattataaaaatgaaacccaacatgacaataaactctaaaaactataaaatccaatttttaaaggttccaagaagaatgaatgaaaatagtggtagatcgagcaagcaaataaataaggagatgacataagagttagcaactggtgtgacttttaaaaactatatgattagaaacacggggatagtaaggtttggtctttcaaagtcttaaagacaatgaaatagctagatagctatttaataaattttaagtaaaataatacttaaaaatatatgattttgtttaggtgctagccgcgcaattgcgcgggccacccagctatttaatatgaaatttgttttagaaaaataaatgtacatcattaattgttcggaaaacgttacgcatggaaacgagaaagtgataccatctaaaacgttgtacgatttatgctaatgaatactcgaagaagatgataacttgtaacccccatatggcgccaaagcgaaccgacgacggcaaact

SEQ ID NO: 53866 - DNA, 2440 bp, Oryza sativa
ccggttaaaaaaaattacctatattttatctattttcactatttatataccccgttagtttaaatttagacatctgtatcaagctaaatttgattcaaatcaaagtaaaacaagtaaatggaaccccttcgttttgttctagctccgccactgtgcgtcaccacatatggagtaggagtagatggagaaggttgcgtgctgcttcgacctcctcaaactcaaagctcacgacgaagctgaccgcggcaaaggcggatgacgatgaggcccgagcagcagcggcctccatctggacatgttccgtggctcgctctgccaccgcatactctcgtttactaacgctttatttagtcctttaaattcttttataaggttttttaaaaaataattaaatttataaaaatatagtaatatgtacaaaattaaattaatcttattaaatataccattgaatatatttttgataaaatatttgttttgtattaaaatattgatatattttttctataaacttaatcacactgtaaaataattaaaataacttataatataaaatggaaggagtagtattttttttctgatttactagtgataaatccctggccataataactttctattaaaaatgcatcattgttacgtaatattaatagaaatcaggattaatttaaagcttggtgagtcatataccacgactccattaccgtttatgtttgtactttctatctaagttttaattttcatttgtgataaaaaaataattttcatttgacaaaatgtaactcatctgctttgaacagaagacagcagcataagcctctaaacgtggaaacaaatgaaaatattaaattccattgacgggagaccagaaattagctctccgcctctccctccgtccttgaagttctacagctcaagttttgttttaaaatgaagctagatcacctaattagcttcattttaaaacagaacttaagcggtataactacgattaattaggggattgtgattggccgagaagagaagaggaagtaggtgaagaaaatgagtgaaaaatggttataattggttgcatgatccgctcaccattagtcgtagttgctgaaccgactttaccaatcattgaccaatatttccgatcaaaaccgaagtcgctacacatgtagcaaccaatatccaattgcaaacaacaaatatcaagcagtaacaatgtgcagtcaccagcaaggacgaagtgctactgtgctagcctccttgattcgccaccaccaagcgaatgggagaaaccatccctgctactaccgcagccaatggctgcggcggcaatggaggcggagtagataaggtgaagacgatgatggataggccaggttgggggtcagcggcccatgaggttcggaagtttttatgttcgattagtatcgatagacatgactccatagaacttatatgtacaccctcctagtcctctatctcctttctccagccaaaactgagccctggtccaagtatagatggccatatgatctgaggcccatggcttggcccaagcacggcacagcccgactagggtcgtaccgtgtcagcctggcccgacagccggaccgagcctgggctgcaccctcgaaacggtgggccggccggcacggcatgatcgaagaaaaatagtagaggaatccaaaatagacttaaataaccatataaggcaaggcccaaagacaagaggagtataaaacagacttatttttcagccattatggacatagccacagagtcgagggatgagaaatagactaattctgtggagaagcacgatggacccgagtcgtattggaccgtgtgtgtagcccgtgggctggcacgacacggcccggcgtgtaggtcaggccgtgcgggcccgaaaaggctcgaaaacctcggcccagacactgccgggcctaggccgtgctgtgccagacggcccatttggccatctatgggcccaagcaagccagttcaaccagagcctccctccacacatcagttgtgccctcctcatttgctggtttatcaactagtatcaaatttgaattttaaagcttagttttagagttaatgtggattttttatcatattcttttttaccttagtttttaatttttttataccctagataaagtagactaacaaatatttactcataaattatttttgatgcttgctcgtttttttcctgcactcataacacaactgatcactacttcgggtgcaaagttgtaaactcaactaattaccgtaagagggtcagggtttcaatcatttaggtggacgtccactcatttattgccgttctactatcttactgatggatcggctgtgggaagaggtgctcaattcacaatcagcctttccctttttagatcagtccgcggtcaccgaagaaatcgcggaaactcggcaa

SEQ ID NO: 53867 - DNA, 932 bp, Oryza sativa
atctgtgtgataatgttagtattatattagaatataaaattcatgctaaatggtagtaagaaataaatttacatgtacaagaatataaaatggatggtaactagtaagagttaaatgacattaacatatattgcaagtctttaattgcacctctactacttgttttatgcaacatgacttcatgaaagtttcaaaattttcccctgcattctataggacctttttggtgccgggagtgagacatcagctaatacactccaatggactatgtccgagctcgtgaggaacccaagagtgatgcaaaaggcacaaactgagctacgtgattgtcttcgaggaaagcaatcggtgtcagaagatgatttgatcggattgaaatacttgaagcttgtcatcaaggaaaccctaaggctgcatcctgtagtgccactgcttcttccgagagaatgtcaagagacatgtaacattatggggtacgacgtgcccaagggtacaaacgtgctcgtgaacgtctgggcaatatgcagagatcctaggcattgggaaaatgctgagacattcataccagagcgatttgaggatagcaccgtagactttaaaggcacagactttgagttcataccatttggagcaggacgaaggatgtgccctggtttggcatttgcgcaggttagcatggagcttgctctagcctcattgctatatcatttcgactgggaactccctagtggtgttgcgccaagcaatctagacatggaagaggagatgggtatcaccatccgaaggaagaatgatctttacctggttccaaaggtccgtgtgcctctatagtttggctcgtaactgcttcacacaatatgtgtctcctgtgacccgtacctgccaagtagcgatcatgagcattccattgtgtttcatgcccttatggtgtt

SEQ ID NO: 53868 - DNA, 1331 bp, Oryza sativa
aaacataaaattaaaaccgactcaaacatgatgacggaccgcggaaacatcttcaatttttataatagtagagataggtactaaaccagctcaataactgttacaccatcagttataaaatactcttattttttggaaagtttaacattgaatttttttactaataattaaattagtaacataggtttgacgtcatacatgtagcgttattagatccgtatttaaaaaatatttttatatgatgttaattccgcattagttgataatatattatgatataaataaacggtcaaattgtagaccatgtaaaaagctaatacgcctcgtatttgagaacaaagggattactagtctgtcagtttctttcaccacattcctaatatctgctgcatttttacatgaaaaattactttaagtgctttattgaattattactgatcaaacaaacgatatatatacgtttacacttattattgtttttctactgagctggccttggcactctcaaggcctcagccaggatgtagcagcatcagatggcatgatctgcagtgtcgccattatcaggagcagtgatgaagcaatcacttgatcaggatgcacctgattggtgagccctcggatccaaccagcctcagaggtaagcaatgcagcatgtagattccagccttgacatcgtctagcttcaggccttcgactaggatgatattctgaaagaacaaattcagcaaatcaaccaatggttacagccagtaatataatcttgcatgctagattcatcgtgctctaaatcacccattcatgaaggtgtaaacattctttgcagcaacatcaaaacagagtaaagcaagcactgtcccaaaacttgtcagtaagtaatgcagcaatggcatgctttcaaagttactccctccgttttataatgtactttctccgtttcacgatgtaagtcattctaccatttctcatattcatattgatgttaatgaatctaggcatatacatcaatttgaatgtgggaaatgctagaatgacttacattgtgaaatagagggagtaaaactttctagtattacctacattcatgtctatgctaatgaatttaggtatatatgtgtgtctagattcattagcatttatatgaatgtgcacaatgttagaaagtcttacattatgaaacggaggaagtaactatttagtcagtactcagctctgtaatgtttgtcaaggatttgttttgaagtagattaaagaagtgagaatgaccaatttacagatgtactgaaatagaacaaggatagcgtcgtaccgggaatttgaaaaagaccaca

SEQ ID NO: 53869 - DNA, 777 bp, Oryza sativa
  unsure (1)..(777): unsure at all n locations
aggacctgtccagcaaagaggaaatcgatcaacttctttttttttttgcggggaacttcaaatatctataactacctgacaaattttcactcaagtttcatttgcaatttccttaggaatgcattacattacagagagtgcacttcgaaagaattgttgaataggcatttcacagctactattaagtatttcacaacatttcttcagctaaactgttaattttgttgatcaaatcatatcaggtgaatcttcaatgctggaacaaagccaacgaaaaattgatctttgcaagcagcaggacaagaagctgtgctctgcaactctgcatgagagaagcaactggaacaatggcagactaatactagcacctaacactgaaatggagctgtctaattcacttgatcctgtcagctgtcagtatgcaaagggagatcgtgcaaaatcagaaagacaggtttggcttctatgctcatcttaatgattggtaggagaaaggacagacacagagcaccaactaggtttcaaattattttaaaaaattgtaggcatgtagcacacacccgatttggttgcaataacaaaatgactaaatgagtagggtgtgatgagaacttttgatgtagttaggtggggtccaattccaaacaaacgtctagacgccaaaccaaacagaattggttttccactcaggcaaaactgtaatcagagagcgatagacgtnnnnnnnnnnnnnnnnnnnnnnnnnnnnnnnnnnnnnnnnnnnnnnnnnnnnnnnnn

SEQ ID NO: 53870 - DNA, 3445 bp, Oryza sativa
ctatagggcgaattcgagctcggtaccctgtcaccgttggatgggtgatgaagaaccctggccgttggatcaaaaccgcccgcggtccaccgtaggagttctaggtgggccttgtccttcatctgggcccaaaaacgggagcgcacctactcatctagctgtgctcttttcagtgagttcctaactcaccccttgtttttagcatgcataaattctttgcaaaaagaaaagaaaatcttatgaaagttgcaaaaaggtgacatatttttgttctgctatttctgtcaaaggaagtaacaagtccagtctcttcaggagtagcaggtaaatagagatatctgagacataatttgctctctgaatgacaagttttgcatggatttgtttctgttcttcattttttttctgtttctggtgttcttagtttttcttcgcaccacatacagattctccgattctcatggtgtgcactgcaccatcctacactaaccctagcaagaatgaaatatgtatatcttgagaatcctttgtaaaagtgtaaaaccttattgtccctcgagaatctctatatcatcctgctatattaaaatattgtcccttagtcaccttcattctttcttttaaaaaatgtcagaaaaatggagttctacgtggtgaaaagatccttcctttcttggaatggctctggctcttcagtaccaacatgcatggtaactgcacatattttgcacataagagtatctctaacagcctctccaaatcgaactcctaaaacacccatatagccaactctccatctgatttagctagtcaaattaactgtatactccaacagcctctctattctaccctctctattttgactatgacaccgggacccatatgtgagccactcccttattctttctccccttccttcccctcttcctcttttcttttctagcgttgacaagaagcaggcggcggcagcaagcggggaggggacggcggtgaaggcagcgtcggcgggaggcggcgctgcgtggggaccggcgggctgcgcggcgggaggcgggcgccgtgcggaggcagcgggcggcgctgcgcggaggacggcgggcgcggcgagcttgtgccgcgcggaggccagcagccacggcgagcgggggcggcgggttgcgccgcgcgggggccggcggccgcgacgagcggccgcggcaagcggaggacggcagtcgcggcgagcggaggccggcggctgccgtgctcgagtttctccccatgcctcgtcgggctcctgtgcttggctgccgtgtggggatgaggaagatgggctctgtggggcccaccattggccagccaaataaagtgaccaaatttggctagtggagggagggttttggccagccgatagcttagccatccagttgaagaggctgttggagcacgtttttttggctagaattgctaaaatttggtttgaagagtgggatggagaggctgttggagaagctctaagtaaccgatgaaatactgagaatcacaacactgggaacaacatgttaactttggatcagcaccagatatgcagaattttacaagccatggtacaaccataccgaaaacagattgtaacaattaaccatacacacagataagtatatctgtgagatgacaagggaagcacccaaacctgccggtaaacaaggcataaacacgcatgcagaggtaaacacacaatgctccacggaaggaaaccaataactcctgctgatgaatgacagataacttataattctatgcatcaaactacctagctgaaggtactgtctcacttgaatcaactgcctcgtctattgtatctgcttttgagttcttctcttctgtgatgcagtctgaactatcaggatgagacgaatgagatgagtcctggaaggagctggtcagatcaggcttgaacatctcatcattctccaagttggaaagcttctcagcagattctcccttgagcagctcaacgacttcagacattatcggcctctgttcctgtttgttctgactgcatgcaagcccaacaagcaccattcgcttcagttcagcctcgacgaagacatccttgagctttggatcagcaatttccttgaactttttgtcacgggcaagtggaagtgcccactccgtgatagttagcttcgtagtggggtttagcttctcaactggcctctttccactggcaagctctagcagcagtactccaaagctgaagacatcacagctttcagaggccttcccaagcatggcgtattccggtgcaagataaccgagtgtacccttcacctttgtagtgacatgggttgcaccatctggaatgagctttgcaaaaccaaaatcggcaacccgtgcttggaaattcttgtccaacagaacattgcttgacttgatatcccgatgaatgatatgtggtgtcgcttggtgatgaagatatctgcatggtagagagagatttcagatgtaagattacttctgcatgtactgaaagttgtcatactgttacagcataatgaatatttcataaggatgtaaaacatgcttacgcaatcccttctgcagaatcaatagcgatcttcattcttcgttcccaaccaagatggcattcagctgcatgctgtccatgaaggtgggagtgcaagctcaggtttggcatataatcgtagactatcaggcgttcttggccttcggcacaatagccacgtaagctcaacaggctcttgtgtctcactgtcgccaaaacctccacctcaattgcaaattcagtttcagctttgttgctccaactcttgagccttttcaccgcaatctgtcccatgtagttaacagaagaagcgttaggttctggttaaagtgaactactttttcctgattttggattaaacagatagaaggtaaatagttccaacataatacttatgatttatgaaatgatgttcaaaaacatacttgtcaaaacgatagtttgaatttgatattgtaggggctgttcagattgatgctattttcaaccataccattttttggtaaagctgccaaaaaaatgtctatgtttagtttgttgtcaaatttggtaaatacataagaaatcctgccaaaattttagcaatattgtcatcttaaattttggcaacattgccatcttgctaaaattttggctacaatctgaataggcccgtatttttttttcaacccaaaatgaaacacaactcaccgggatgtagcagtttgggggttatatcaccatgcaacaaactaacaagtaccaatgtagaacagtttcatcatcttcataataaatgtgcaactgtctgatggaataagtcttacgctgttggtcttcttgtgctaattggtctttgtgttctttttgcttttcagtgcatctttcttttatgacagcatctcctttcacttt

SEQ ID NO: 53871 - DNA, 2192 bp, Oryza sativa
ctttttgcttttcagtgcatctttcttttatgacagcatctcctttcacttttactttttagagtagcaagccagctataaatatatatcccaacccccctcccctgcgtgatggtatggcacttgtgagaaataaacagaaaattgccccaactctccttcttgagctcccctctgtcctcagtcggcagcaggaacaccggctgttcctacttatccctcttcccctgcgctgacgagcagcagctcctcaaaggcagtctcttccccacgcagcagcccctagtggcgtgccatgtccgcaggacagtctcagcgcttggtcgcctcgagcgcgcggctccggcaggaggccgagttcaccgcggcagaggaacgcgagcgagtggtggtagagaccgctgcgacggcagcgagggcgtcaaggctggcggcagcaaaattggcaacggtaagggcggaagtggaagcggcggcggcggcggcacgacagtagcaccaacagctctatctccgcctacggcagctccgatgatgagctgacgagggaggcagctcgtgagcgggcggagcagtgggcagctgcgcaaccccacgcgcgcaatggcggcagcttagattggcggggatgcatgtggcggcggcggcccagacgggcgtggacgcgcggcccggttgggtcgacggagatcgcagccgttgcaagtggcatggctctccctcaccggaccggtaccatggtcaccacaggatttaggccgtcatcagggaagtcggccctggcggtgtgtggctaaaccctaccctcaccaagaccaactacgtcgagtgggccgtggtgatgaggataaggctccaggtgcgacacatgtgggagccagttcggcacggcgacgtcaactacgacgaggatcaacgggcgcccagaagcggactgccaaggaggcttgggacgccatcgctgcggcacgcatcggaagcgaccgcgctcgcaagtccacattgcaggcacttcgcaaggagtgggagaacctggccttcaagcccaggtgaggatgttgatgactttgccctccgtctcaacactctgctgtagaagttggtgtcgtatggcgacgacacctacgatgaggagagagccgtcaagaagctcttccgctgcatcccagagaagtacaagcagattgctcgctcgatcgagtctctgttggacctctccacgatgtcgatcgaggaggcgataggtcgcctcaaggtcgtcgacagcgacgagccacagcctctctcgaggcttatcaccattggcaggaagcttcatctcactcgagagcagtgggaggcctgccagggtgacgggaagaagagggagtcctcttcctcgacaggccgcaagcgcggcaagggacacgtcctgcgaggacgcacccagggtggcgcccgcggaggcgcctaagccggcgcgagatgacgcctgccgcaactatggcaagtttggccattgggccaaagactgccgacagccacgacacggccaggccaacgtcgcacaggtggaggaggaggaagagtcggctctgctcctggcacacgcaagcatcgagctatctccagcggcaccggccgcagcggctttcctccaacttgatgagccgaaggtacgcgccttcctcggagatggctccagcaacgacaagactgatgagtggtacctcgataccggcgccacccatcacatgactgaccgacgggagttcttcaccgagcttgactccagcgtctgaggttccgtcaagtttgggggtcggctccatcaccttcaccgccaaatccctgtgctcaccggagtctactacatccccgctttgaggaactctatcatcagcgtgggacagctggatgagaaagattcatgcttgttggtcgagcacgaagtcatgaggatttgggattgccgtcgttgccttcttgccaaggtaacctaaggcaccaatcgactctacgtcttcaacgtgcaagtggcacaaccggcctgcctccacttcgaggccctgaacggctcagtgccaaggagatggtgcgaggcctgccgtgccttgaccacgtgaagcagctctgcgacgtctgcgtgttaacaaagcagaggcggctcccctttccccagcagataagcttccgagccaaggagcggctcg

SEQ ID NO: 53872 - DNA, 1549 bp, Oryza sativa
ttacttcatgctgctcgtcgacgacctctcccgcttcatgtgggtaatggttctcggcagcaagggagaggttgcggacgccattaggcgcgcgcaggctgctgcggaggcggactgcggcggcgaattcacgggcggctgaattcgcatcgtactgcgctgatgagtgcattcagcaccactacttcgcgccgtacagcccgcagcagtacggcgtcgtcgagcggcacaaccagacggttgtagggatggctcgagcactcctcaagcagagggggatgccggccgttttctggggagaggcggtggtgacggctgtctacatcctcaaccgctcgactaccaaggcccgtacgaggcttggcatgggcgcaagccggcggtctcccacctgcagtttttcggttgcctcacgttcaccaaggagatcggccacatcggcaagctcgacgacaggagcaccccaggggtgttcatcggctaagcagagggctcgaaggcctaccgtattctcgacccagagacacagcgtatgcacacggcgtgcgacgtagtgttcgacgaaagacgagggtgggcataggacaaggcggtggacgacggctcgactccaacgtacgacttcactgttgagtacgtccacttcgagggagctgggggagtaggtagctcttattcactgagtgtgcctacctagcccccgagcctccaccgactccagcagcgacacgctctcgagctacgacttcggctgcaatgagttcttcgctgacaccatcacaaccggcgaccccacgcactccagcaccaacagccacccctccgggcacatccactccgacgccaggttgtgtcaagcacagcccggtggagttcgctactccgctctctcacgacgaggagcgcatcgacgcataccacgacagtgagccgctgcggtaccgtacgacgggagcctcagtctttcgcagaggccgagagacacgcagcatggcgtgccgtgatgtagtcggagatggacgcggttgaggaaaaccgcacctgggagcttgttaacctccctcgtggtcaccgcgcgatcacccttaagtgggtgttcaagctgaagagggatgaagccggagccatcgtcaagcacaaggctcgcttggtggcacgcggtttcgtgcagcaggaggggatgccttcgcccccgtggtgcgatccccggcaaggagggcaaggtgctcctccttgcgctggctgctcaggaaagctggtgcgttcatcacatgaacgtcaagtcagcgtttctgaacgacgacttgaaggaggaggtctacgtacaccagccgccaggatttgcgatccccgacaaggagggcaaggtgctactcctgcacatggctctctatggcttgtggcaggcaccgagggcgtggaataccaagttggattccacgctcaaggggatgggcttcgagcaaagcccgcacgaggtagccatcaaccggctgggcaatggaggaaatgtcctgctggtgggtgtctacgtcgacaacttggtaat

SEQ ID NO: 53873 - DNA, 1692 bp, Oryza sativa
cgaggagtcagtcaccagttgactagctgttcgattcggccatggccaccgagctcactgagtacttgctgctcctgccgcttctcgtcgtaccgctcctctacctcgcggcgtcgtcgtcgcggaggtcggggaggctgcggctgccgccggggccgtgggcgctgccggtgatcggccacctgcaccacctcgccctcgccggcgcgcccacgcaccgcgccatgcgcgacatggcgcggcgccacggcccgctcatgctgctccgcttctgcgagctccccgtggtggtggcctcctcgccggacgccgcccgcgagatcatgaggacgcacgacgtcgcgttcgcgtcgcggccgatcgggccgatgctgcggctcgtgttccagggcgccgagggcgtgatcttcgcgccctacggcgacgggtggaggcagctccgcaagatctgcaccgtcgagctcctcagccaccgccgcgtccactccttccgccccgtccgcgcggacgagctcggccgcctcctccgcgccgtggcggatcaggccgcgtcgtcgtcgtcctcgccggtgaacctcaccgggatgatctccgccttcgtcgcggactccacggtgcgcgccatcatcggcagccggagcaggcaccgcgacacgttcctgcggctagtggaggacgggctcaagatcatgccggggatgagcttgccggacctgttcccctcgtcgcgcctcgccatgctcctcagccgcgtgcccgacaagatcgagcgccgccgccgcggcatgatgggcttcatcgacaccatcatccaggaacaccaggagagcagagccgccgccgaagacgaggaccttctcgacgtgctcttgaggctccagaaagacatggactcccagtatcccctcaccaccatgaacatcaaatccatcttgatcgtaagctctcctccccgaactccggctacttccccctcgtcaaaaacgaaatcctcttcatgtaattcgctcgaatccaggacatgttcggcgcgggcagcgagacgtcagcgacgacgctgcagtgggcgatggcggagctgatgcgtaacccggcggtgatgcgccgggcgcaggacgaggtgcggcgagagctcgccgtcgccggcaacgacagggtaaccgaggacaccctcccgagcctccactacctccggctggtcatcaaggagacgctccggctccacccgccggcgccgctgctcctgccgcgggagtgcggcggcgcgtgcaaggtgttcggctacgacgtgccggccggcacgatggtgctcgtgaacgcgtgggcgatcggccgggacgcggcggcgtggggcgccgcggcggaggagttctcgccggagaggttcgagcggtgcgagagggacttcaggggggcggacttcgagctcatcccgttcggcgccgggaggaggatctgccccggcatggcgttcgggctggcgcacgtcgagctcgcgctcgccgcgctgctgttccacttcgactggaggctgccgggagggatggccgccggcgagatggacatgacggaggcggccgggatcacggtgcgccgccgttcggaccctactggtgttcgccgtgccccgtgtccccgtgccagcgcagtagacagctggtgtatcttatttaagccaatatgagtaatcgc

SEQ ID NO: 53874 - DNA, 1166 bp, Oryza sativa
gttgtgtccagtgtggttttgacgtgagatgcacggacacagcgcacgctgaacatgtgcacatccgtgcagggcttcgtacttgtagaacgcaaacctgttcgtccatgtcgcgttctcccagacatccgagccgtgtcgatcgcgtgagctgccatggccggcgaactcgcgttctatctgctcctcgtaggtctcgttgccgtgccattgctcatcttgctcggctccgagcggcgcacggcggcgaggacgcggctgccgccggggccgtgggcgctgccggtggtcggccacctgcaccacctcgccggcgggctcccgtcggaccgcgccatgcgcgacctggcgcggtggcacggcccgctcatgctgctccggctcggcgaggtggaggccgccgtggcgtcatcgacagacgcagcgcgggagatcatgaggacgcacgacgttgcgttcgcgtcgaggacggtcgggcccatgtctcggctctggtccagggcgccgacggcctcgtgttcgcgccctacggcgaggcgtggcgccgggtgcggcgcgtctgcacccaggagctcctcagccaccgccgcgtccagtcgttccgccccgtccgcgaggacgagctcggccgcctcctccgcgccgtcgacgcggcggcggcggccgggacggcggtgaacctcacggcgatgatgtccacctacgtcgccgactccacggtgcgcgccatcatcggcagccgccggctcaaggaccgcgacgcgttcctccggatgctcgacgagctgttcaccatcatgcccgggatgagcctcccggacctcttcccgtcgtcgcgcctcgccatgctcgtcagccgcgctcccggccggatcatgcgctaccgccgccgcatgcgccggatcatggacagcatcatccacgagcaccaggagaggagagccgccgccgacgccgccggtgacgacgacgacgacgacgacgaggacttggtcgacgtcctcctcaggctgcagaaggaagtgggcgcgcagtatcctctcaccaccgagaacatcaaaaccgtcatgatggtaagctcgacgccgccatggccgaacaccgaaagctcgacgcgcgcgccaaagatgtctccaccatttttctccctcgcttctttcacagga

SEQ ID NO: 53875 - DNA, 950 bp, Oryza sativa
  unsure (1)..(950): unsure at all n locations
ggcgttcgcgccgggggcggtgacggggccggtggtgcggctcagggactccatggcgaacgggacgctctacaacctgtcggagctcaagatggagtgccacatgggcacccacgtcgacgcgccgggccacatgaaccagggccacttcgccgccggcctcgacgtcgacaagctcgacctcgacctcctcaacggtacgccctcgccgccgccgccgccgccgccactttacttgttccccttcctgctcgcgcggcgacatggtcgaggttttgtgtggtgcacgtgatgccaccgatgccggctgcggtatccgtaaaggagattagtacagggggaatttgggataaatttggagatgaactcgaagacgagatggggaactatagataactattttgttctgctacctgcagcgctagatcagatcctctaccttaagtcacatgaatttattactaacatagtgacatgtgtgtccaataggtaattgttagtgacaaaggcacggtgacgactttaaaggtagatgatctcagtccgtacccaatacgtaatttgcacttacatatatatgtttttttttaaaaaagagaggcaaacttgctaaaatatgtttccacaaaaggtgtggagaaatactacgatttgtatagttcacaaataggataaatggtacttatagtacatatatcgctcaaaatatcaaatacttcctccgtttcacaatctaagtcattctagcatttccctgtctagattcattaacatcaatataaatgtgggaaatgctagaatgacttacattgtgaaacagagggagtacttctcaactttagtatgtgctaatacattaacatgttttacgtannnnnnnnnnnnnnnnnnnnnnnnnnnnnnnnnnnnnnnnnnnnnnnnnnnnnnnnnnnnnnnnnnnnnnnnnnnnn

SEQ ID NO: 53876 - DNA, 712 bp, Oryza sativa
acctatggggatatcgtaacccatgacctcacatgtctcccgacattccctagggagaagtagtggcactacaggatgtaaccttaaggtctctttgataataagttttaagtacttcaattcaactaagtcatcttcagatatcgtttgctttcctttgatgacgttacttaactcagcttgtgccttcagcatcactcttggattcattatgagctcagtcatcgcccattgaagtgtattagctgatgtctcgctcccagcaccaaaaagttcctatatgcatgaaaaaaaacatgatttcccatatatgtaaaaaaatatgttatcaattacttccttcctttgttcagtgtgcatactttttttttattttcatatatactcgctccattcatcagttaaagttatttaattttattcttaaacggtaaaactttgtagattttgacattaacagtagtcaaattttaagtgcactcaggtaaaagaggtttggtaaaatatgtcttatatttcatcctttcacgaatataatggattatagatccagaaagtgtgattgaaccttcactaaattagggaagagaacgtacgttagggtacgattgtagatacgattgaaaaattaattattggtaagataaatactactctaagctcagaagtattcgtgtgcaattaagggagattagtacagtattaatcagca

SEQ ID NO: 53877 - DNA, 2283 bp, Oryza sativa
atttatcttagaattacggagattatatacataattactcttaaaaggtactccacttcaatagcattatatatttattgatatttttggagatcatgttcttgtccaaaacgatggctcgatgagtatatcagtccaatgaaagtaagtattaattgcttatatggatatataaatggagcttacagtgcaattaattgggataacgtattgttagctcaccttgcttgcatggctcactgcttagtgctcactattatgttcgcttgtagctgctcactattcttcggacttgagctcaaggccatccggcatccgccacatatagcaatcatctaccttaaatcacgtgactttaggattactgaaatgtagatccatatcaaaaaagttccacatgtcaatgactcaaaatcatgtgacttaagatagaggatctccatcctagctcaataccctactactattggagttggtgtttatatcaaagttgttgaatgatcagagcacaacaccgtatggcaatgtcatccatgataacgtgggttacttcgttgatgcaagctacaaccatctcgaatgaagaaatataggagacgagcaaagagaaatgatcgtcgtcacacgtagttggatagtgaatctgtgaatgtgccaaatagtaaacattgttgttccttttcccaaatactatatggatcctcacgagcatatatgtatgagttttgaaacatgattgaaccatctttaattcatgttttcaaatcctggaataattaacgttttgccacttttacgagtggttctaaagaatttgccactagacccacatatcatagatatcgatatcgagtggcaaatcattaattggcacgtgacaaataattatgccctatttgtttaggcttaggcttattggcttagatttttaagtcagcttatttgcttatatgatttatatattataagctggtggatttaatgtcttaagtttaatggtggagtcatgcatctacctcacgtaagccaaaaaaagcttctccaacctagcttttggcttaatagtgttagagtggcttatggcttcaaaaaagacaaacgaaaaaactatttgtttgttcaggcttaggccctgtttctttcagcttgagattattataatccagattattgggagtaagctgaaagaaacatacaacttattgaagcagcttattataatctggagtccagcttattataatctgataagctcatttaggtgagctttttccagattattgggtgaaaaattactcaccatgccactccactccctctttagacttgcaaacccaataatctaggctctaataatctagaaaagaaacaactaaccgcttattctactacagattataacaatctagcttatagtaatctgactcaataatctagattataataatcttaagctgaaagaaaaagggtcttagacttttcggcttataagttggcttataaccctaaacaaagagggcctaatgtcccttcaatctcatgtcattcttaacgctgattttacacttaacaccctcaacttcccacacccttccgatccaccctcgcatcactcttccagcctcccctccccccaactccggcgatggccggccgcctccccggcgccgcctccgccgccgcggcgcccctcccccgagcgctcctgctactcgccgccctcgccctattctccctcaccttcctctccctccgctcgctccgccccgccgcggccccaccctccctcgccatcggcggctcccgcccttcctccttcgcgcggccgtcggtgtaccactccgccgaggccttcgcggcggggtacgcggagatggagcggagcttcaaggtgtacatgtacccggacggcgaccccaagacgttctaccagacgccgcggaagctcacggggaaggacgccagcgagggctacttcttccagaacatccgcgagagccgcttccgcaccggcgaccccgacaaggcgcacctcttcttcgtccccatctccccccacaagatgcgcggcaaggtccattctccgctctacttctatttacacttccatagcattgtaaggccatgttcttttcagctcgttcatcggattattgaaacagattgtttgctccatgcttcgagaaatacgttttctcaaaaaaaaaatatcgtctactgtattgtatggtttagaactttagatcacttgtttcaagctattttgttaagtttatttcttaa

SEQ ID NO: 53878 - DNA, 978 bp, Oryza sativa
  unsure (1)..(978): unsure at all n locations
nnnnnnnnnnnnnnnnnnnnnnnnnnnnnnnnnnnnnnnaaagtagaacgatattgtagatgtgccgataggtttctagtcagcagtatagtctggtgcaagatctttggtttcggaaatttgtcggcttacaacattgaaatgcatttttcttttcatctgatacaggaacgaatttcctgttattagatgtgactgaaattgtatgttggttgtccatatcttttgtaattgatcttttataattgttgacgtgcatatgtctgtctttgcagggtacttcatatgagaacatgacaataatagttaaggattatgtggaaggcttgataaacaagtatccttactggaacaggacacttggagcggaccatttctttgtcacctgccatgatgtaggtgttagggcttttgaaggacttccattcatggtgaagaattctattagagttgtctgttctccaagctataatgttgactttataccgcataaggatatcgctcttcctcaagtattgcagccatttgctctgcctgaaggaggaaatgatgttgagaacaggttggaatgacacttactgcttcttatgctatatatgtgatcttatattcttctatggttgtcttcataaaaaaattgttcatttgggacttctgaatgattctttttcctagactgactatatatgtgtgcctccatgtatgattctagacttttctagtaatagtgccttcaagtgaaaaatatctgtttacttgagaaattctgtaaaacactcacacttactcacgtggttatcttgttgatcatgccttgaatcttacaacctatgattaattcagaagactacatggttttacatttagttcagcactttgttcatgtgcaacgaatcaccttgtagcaaaatgaaagttgtcatgaccataaatttgtgacgatgctatggtttgaacatctatttgcactcctacaaa

SEQ ID NO: 53879 - DNA, 1869 bp, Oryza sativa
cttttttaccataagatactttatattcgttataaataaattttggtccatactaatacctgagatactaagactactaaggctgtgttcggatgtgaagttggaaactcacctcccacgcacgcaaaacggagtaccatattttcttataattaattaaatatttacttttaaaaagatagattaatatgattttttaaagcaactttcgtatataaaccttttgcagcacaccgtttagcattttaaaaagcgtgcacgtgaaacacgaggaaggtgagttgcgaaagttggggaagaacacagcctaaatggctgtcgatgacagcaaaattactctaaccgtatgtaatagtgtgtaaaacagattttgctgctcagatttaatgtatttatcgtggaaaattgtatgcatttctcgaacagcataatccagctagcttccagtttcaaaacacaaatctctatggtagtatggttccatcgaggtcatcacagagctagaatgtcttaagaatgaaacttgtcgatgcaccaacttttttctgactcatttaatactgaagtttctagtcttaaaactttcccctattatatgaaatcatattgtaacccattttatttatctacacgaagtgcctctctctctctctctcaacaaaactacggaagtttgaccttacaacacacggaggatgggggcggaggtgaaggtcattcttcctccggacggtgatgcccatctcctctgtcatatccagctcgctcgctgccattccattagggagttcccagtcaaagtggtagagcagcgcagcaagcagaagttccatgattgcttctgcgaatgccataccaggacatattcttcgtcctgcgccaaacggtatgaactcgaggtctatgcccttgaagtcaacagtactgtgttcaaaccgttctggtctaaactcctcagcgtcatcccagtactttgggtctctgccgatagcccacgcgttaacaaatacagtggtgccttttggaacatcataccccatgactttacatgattcacgacactctcttgcgacaagcagtggtaccacagggtgaagccttagggtctccttaataatgagctttacatactttaagccagacaaatcatcctctgtcacagttggctttctcctaagtttgtcacgtagctcggcttgtgtcttttgcataaccattgggttctttattagctccgacatcgcccattgaagcgtagtcgccgatgtctcgctacctccactaaagagatcctataaaaagttaaaagatcgaatgaaaaatactacaaagatttgagagctgtaccatctaattgagcaaatataatccaccatgatagcacatactctctccgtcctaaaataaatcaatctcatacgagatatgatatattatagtacacttaatctgaacctgttactctgggatgaagagagtagatatattttactttgcttttaatacgacaggtgtcaattttacttacaaggataacagctttgatttgttccatggtgagaggcgtctcgagctccccttgtttctgtatgttcaggagcacgtctatgaggtcttggttcttgtcgtcctcgacgccggcgccgccgtctaccacggcggcctccgcccgctgctgctggtgctgccggatggcgcagtccatgagctcgtagagcttcctgctgttcgcctccgctcgccgcgccctgccgccgatggcgctcgccagccacgacgacgggaacaggtcgtcgaggctgaacccgccgaggagcttcatctgctcggtgagctcctgcaagaactcgtcgcgccgctcgaacctgt

SEQ ID NO: 53880 - DNA, 846 bp, Oryza sativa
gcttcccctcctcgtggttgcacggcctcatgccgctctccccactaagtactgtaattaattatcaccaccatcaaatcatcagaatctaaaccaaaatatcttaagagttaagatgaaagcaaaccttaaccaaaagattaatttatcatcatgcccatgaacattggcatcagtaactgtaagttgatgaatggttcatatttgatacatatttccttttgttgactacttggatgagattctgaatctttttgtagacattttttgctgttgaaataactacacttttgacttgttgttcatggatggcatcgatattttctatctgaagaagactaaacctgatgctttacagtaagctgcactggacggcgaatactaatcccttatctcaacaatggtagagcaggtacaatagcaggctataaaccagctataaacatattttaaaaagataaagaaaaatagagaaaagtagcgggctatagatctgtagccagctgcagcacggactccaagacgtaatgtgtgtatgacaggtaagattaggtattaatagtatagtaaacaattgtatgaattggttattacattagctataaatgatttggagttagtattgggctatattattaaacttgctcttaatagcttatctactgcttgaccatggagtacgtcacagttgctgtcacatgaatacttttaacttttcttgcttgaaatttccaagctgaaagaaactcttacaaatagaaaccctagtgttttttttttaaaaaaacagattgctcaagtgagttcttacatttttttatttaaaaaaattcacttataaataga

SEQ ID NO: 53881 - DNA, 1054 bp, Oryza sativa
  unsure (1)..(1054): unsure at all n locations
nnnnnnnnnnnnnnnnnnnnnnnnnnnnnnnnnnnnnnnnnnnnnnnnnnnnnnnnnnnnnnnnnnnccctatggataatgataatagtattatctcccttaattttgataggacttattttattcaattttaacatcttcgacaccaaagctttaactttaattggttgcaaaatagtacaaccttaataactactccatctgttcacaaatacagataattttaagcccttttgacttgtccaaaaatattaatgagtttaaagtactttttgtcttatcaatcatttatttttcaatcgtatcaccaatcactttctggatctataatccctatattcgtgaacggatggaatataagacatattttaccaaaccccttttacctgagtgcacttaaaattttactactgttaatgtaaaaatctataaagttttacctttaataataaaattaaataaccttaactgatgaatgggggagcatatgaaaataaaaaaaaaggtatgcacactgaacaaagaaagtaattgataagatattgttttttacgtatatgggaaatcatgttttttccatgcatataggaactttttggtgctgggagcgagacatcagcaagtacacttcattgggcgatgactgagctcataatgaatccaaaagtgatgctgaaggcacaagatgagttaagtaacgtcatcaaaggaaagcaaacaatatctgaagatgacttagttgaactgaggtacttaaaacttgttatcaaagagaccttaaggttacatcctgtggtgccactacttctccctagggaatgtcgggagacatgtgaggtcatggggtacgatatccccataggtactactatgcttgttaacgtgtgggcaatcggtagagaccctaagtattgggaggacgctgagacatttagacccgagcgatttgaggatggacatatagactgtcaaggaacagattttgaattatacctgctggagctggccgaatgatgtgccctggcatgcattcgcagatgcaatcatggagctc

SEQ ID NO: 53882 - DNA, 963 bp, Oryza sativa
  unsure (1)..(963): unsure at all n locations
nnnnnnnnnnnnnnnnnnnnnnnnnnnnnnnnnnnnnnnttcgggtgggatgccacggacgttaagagtgttgcaatggctctttcgacttagagcgtcggcgaccacgttggccttaccaggatgatagtgaattcccacatcatgatccttgatgagttctaaccatctcctttgccgaaggttcagatccgactgggtgaagatgtatttcaaactcttatgatcagtatatatttcacagcgattcccaatgagatagtgccgccagatttttagagcatgaaccaccgcagctaactccaaatcatgggtagggtagttgccttcatgaggccgtagctggcgtgaggcataggccaccacatgaccatcctgcatgagcacgcaccccaatccttggcgcgaagcgtcacaatacaccatgaaatccttgcgagtatccggcaagattaacactggcgaggcaaccagcttttctttgagagttttgaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaataccagacggagatggtgctgatggtcttcctcggattgtgagtatatcagaatgtcatcaatgaaaaccacaacaaacttatccaagtattccatgaacactttgttcattaagttcatgaaaaaggcaggtgcattggttaaaccgaatgacatcaccgtgaattc

SEQ ID NO: 53883 - DNA, 4882 bp, Oryza sativa
  unsure (1)..(4882): unsure at all n locations
caatgcctgcgggcttatgatgtaataattagcactagactcttgtgtatgtgcttttggtatttcagctatgaactcgtgtgtagcagaccacttgatccagggaaatggtactgtttacacgaatgattcatgttataaaaacgggggtccacagagctggtatcagagccatacgactgtaggaaaagaccaaaaggcgccccaccccttttctaagttggccaagggaaaaattcccatttagtaatactttcgaaaataaaaacgctatgtttacaaaactcggtatgattttcatcttactcttaactattttctttacaaaataggttttactctcaactgactttgggtttttcttaaaattagatggcagatccggattcacccgctacctgggagttgagcttacctcaataagaggggtatgtcattgagctgcatcggatgttgaggcgtctgcgatactctaggttcccgttatactgagtgagacagtgtggctcagtttgggaggctcgggtcgaggttcacccccgagtcccttccgagttggactacagctttcagacacgtcaccaccgagacctgctgtcacgcccggaatttctatccaaaattctaaacgcttacatgtgtgtgaaccctcatccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacgactccactccacaggcagcttgaccagggctacacctaatcctcctcaccaacagcatcactgtagaactcttcctctgatgaatgattgcaaggtgagtatatgacatactcagcaagccacgcagcaaatatgcaagtgcacaggataaacaaagaatggcatagtagggtttcatttgcataaatagcatttaataaacatttcagaatttaataaaacagttaagtaataattaaaccatattaaaccaacactatacaacataccctgttgcataggcccaaccattctgaacaaccatcccggctgcacagttctatctccaaaccaagaatataccattccaaaccaggagctaaacaaattattaccagttatagcatcttttattatgatgaggagtgtgagactaatcacgaaagacattgttagacccgcccataaccgcgggaacggctattcgaatagttttactctggccagaggtgtaccactgtacccacaagacacagccccacaacatgtcaccatgtgcctcaataccaccacggtacctcggaaaggagctgtgacagtacccctcgcacaacacaatcgaccacagcgcaccattcctggatcataatcacccccttataaacaaggcattgactccccagcgacccccgtgggcttatctccgctacttctcagtctggtgctccgcaatgaaccatgctgtacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaaattttagttggcaaataattaattaaccaatcacgattgaccatcgtgaactatcattaaaccatcattaaataatagtgagtcataagttatcccaataatgtgctaatgtttctaagcatggctaagcagtcatatctaatatctagctgaaccaatatatataaagctcaactagtcaagttataataacccaagatatcaaggaataaagtaatcaagaacaaaagggctataacaaataataggttaattccacccaatgacattcgaaaataaatgcaatagttgaatagaaacaatagctttaaacgggatcaacatgctcaaagggttgtttgggatctgtgtgacttgccttgctggccttggaactcttcaaattcttcccctgcaaaaacggactctccggaaacgtcggaatctaaacagaaaagagcaaaatcaccaaaacagcacataaacaagcatgaacagtacatgtggatatttttaacatgtagatctcaattttagaaaaaaattagagacttgaaccaactaaatccgagctaaggtgaattagttatgaatttttaaagattaaatcggattaaaacacttatattgattttaattgaattatgacgcaataatgaattatttttgaaaaggaaaaaggaaattattgcgttagcggctagggtttgcggtggaccgggcgcacggcggcggttcacgagatctaacggtcgagatcgatccatccaaaacggacggccgagatcgatcgggtctacggcggctcacggcagacggaccctgatgacatcagcggtgacgtcatctccggcgacggctcggcggctcgggcgcgcaagctcgccggcgaacgacggcgcttcggcacgaacggagggcaccaggacgatagagagcgacgcggcgaactcaccggtgaccaaagaagcggcggaggagcagcggacggcgacggcgtcgagaaaaaggcggcggcactcttcggcttgacgacggcgacggtgctccgacggttgacagcgaatgcgaaggggcggacgaggatggcgacgcgacggcgaccacgatggcgagctccccgagcgacggcgatgactggagcgacggcggcgcgcggctggagcgacggcggcgctaggctgcacgtggctagggcgctacagacgtcggcgagcgaaggcgagggtggcggcgggtagaggagacaccggggtccttttctaggggctagggcgcggcggcaaaggcccacggcggccggcgacggaaaggaaagattggggaaaaacgaatccgaatcaaactcgaatccgcctatttccaaaggaaattagacaaagtttctatagaggaaaagatagagtagatcaaggggattctttcccctctaccaatttcaccggaaacggaaaggatcggccgaattggaaagcggcggcggcggcacagcactagggtttcggccggcggcggctggaggttgacgacgaccccgacaggtgggccccacctgtcagcgaggggaacgcgcgtgcgggcgctcggcttgggccgacctgggccgagagagagaaggttttgggccgactttcggcccaaagccaaaagagacttttaaaaacctttttcaatttaaattattcatgaaatgcaattccatttattaaaattacttccttagctcaaataaatcccagaaaaaatctaggaattatagaattaagcaaagtatttaatgaaattttatctggccccattttatattggaatttattaattaaaattaaatcttctcttctaagcttttaaaataaattctaaaaattccaattaaacaacaatttatatatttggaatttttagggtgtgacacctgccagagaccgcgatgcaggatgcagcccaggaggccttcctccgactcagctctatccaccgagctgagttagcgagtaccgagtttgctcatcacccgttccgggaggagagcaactcagtttgcacagttcaggacacgccctgctgctacaacccgatggtgactcggttgtcacgatgggctgaggcagtagatgactactacgaggaggctctgttggagattgacgatcaccagagacgtgtgggagagctggagactgagttgactgacctctcagtgcagcagcttcagttggaggaggagcactaggcttggggcagtgagatagactcactgaaggcacagctccaggttcacggcgaccagttccagcagttatctgactagtacaacgatcgccgcgggatgatggatactcttgaggaccagctgagagagagtcaggagcacgtcagccagctggaggagcagcttcgagcagccacgatcagcaccacaggggcttctacttccatagcagtaggccgtgaccgctacttcttcctcaccccgccgtacccaccagcgttccacgctcttctgggagaggctagtatgctagctaccgagtcagcaccttacctactggacccgacagcgacacaaccacctgtcccggagatggtgcgcactccactgatccctacaccttctccgcagctaggttccagtttggagactccgatccaggtcgactccgagacagaggggaccgacaccgagccagagatcgagccagacatcactgatccttcagaggatgagacccctgttccccgcatcaccttccttggaggtcctcgcaccctcagcactgctcgcaagagcacacgacctccgggcaagaggcccaagccagatccagaggccactacttctgagccgtggggactcaggtttgcgtgtgccaacgaccaccctctacctgccccaggatcctgcggatggctggaggactagactgacagactccttgcagcttcgatctcgtatcagatggtttttggatagcatgcgagacacaccccccctcttacctagattgacgagtagattgatgattagtttgatgtatcttttggatgaaccttattcgactgcgtatgtacgcagtcgattgcatcatgatttatgtaccatttgtgaaactctgtgatgttatttatgatatctattgttgttgtgttataaatgagtttattccaccatgcttnnnnnnnnnnnnnnnnnnnnnnnnnnnnnnnnnnnnnnnnnnnnnnnnnnnnnnnnnnn

SEQ ID NO: 53884 - DNA, 5515 bp, Oryza sativa
  unsure (1)..(5515): unsure at all n locations
cnnnnnnnnnnnnnnnnnnnnnnnnnnnnnnnnnnnnnnnnnnnnnnntttatgatatctattgttgttgtgttataaatgagtttattccaccatgcttgcaaaacaaaggtcacatcaaaacaatctcccctaatgggataaagccgtaaaagatagccagagaattaggatacttactcaatcaatcaacctgcacagatggcaagccgacgtcgggcaacaaccagcaatgacgaaactcagacacccgacttaaccactctggccagagttatggccacccaaactcaacttctgcaagccatcgcaaacaaccaaggcaaccgcggcggatcgagctttggagaatttatgaggaccaagccacccacattcgccacagcggaagaacctatggatgctgaagattggttaagggtcattgagaagaagctaactcttgttcgagtacgggaggctgataaagtgatctttgcggcaaaccaattgggaggaccagccggagactggtgggacacataaaaagaagctcgagaagaagatgctggagaaccaaactgggaagaatttaccacagccttccgtgacaactttgtgcctgccgcagtgatgcggatgaagaagaatgagttcaggagactacggcaagggaataccacagtacaagagtacctgaaaccgttcactcagctggcacgctacgcgactggagatcttgccgacgaagaggaaaagatcgacaaattcattgaaggcttgaatgacgagttgcgtgggcccatgattagacaagaccccgatagtttccagagtttaatcaataaggtcgttaggctggaaaacgaccggaaggtcgtggagcacaatcgtaaaaggaggcttgccatgaaccgcccgcctcagaccgcaccccagcgtcctaaagggacaacctcctcggcatggagaccaacagtggtgacaacgcctccagcaatttccacaggccggttaccattcagaaccgagctcctgcaccaaatcaggccgccactggaccagtaaggccaggaagctgtttcaactgtggggagtatgggcatttcgccaacaaatgcccccatccaaacaagacacctattcgcaccggagctaatgcaacgactattcacggaactgctacccctgctgctggacgaggtctatttaggactccacagactaacaggaccgctaccggatttggacgcggacaagtgaaccacgttcgagctaaagaggcctaggaggaccaaggcgtactgatgggtatgttttcactcaacttcactccagttaaagttctcttcgattcaggagcatcgcattcatttatatctctgaaagcaagtcaacaacacaaattaaccagagttaaactaaggcaaccaatgttagtacattcacctgggggtgaaatagccgtggacacagcttgcattgatgtacctattcgccttagggatgtggtgtttccctccaaccttatggttttgataccacagacccttgatgtcatattgggtatggattggttagcaaagcatagaggagtaattgactgtagacgtagagaagttaccctgaccacaccctggggatcggatatgagagcaaccatggatcaagatcctaggctaaccgaacgtgccggaggtatatttaccatgctacccctaaagggaatgcccgtagtgcagctatttcctgatgtgttcccagaagatttacctggaatgccaccagatcgtgacatagagttcattattgacctgatacccggaactgcccctatatccaagagaccatatcggatgctggtcaatgagttagaagaacataaaaagcaaattagggagttgcaagaaaagggatttgtacgccccagttcgtcaccttggggagccccagtgctattcgtcaagaagaaggatggtagcatgagaatgtgtgtggactaccgctcactgaacgaagtaactatcaaaaacaagtatccactaccacggattgatgatctttttgatcaactcaaaggagctaaggtgttctctaagattgaccttcgattaggataccaccaattgaaaattaggaccggggatatacccaaaaccgcgttctcaacacgctatggattatatgagttcaccgtaatgtcgtttggtttaaccaacgccccggcatactttatgaatcttatgaacaaagtgttcatggactacttggaaaaatttgtggtggtattcatcgatgatattctaatctactccaaagatgaggaagaacatgcggaacacttgcgattggtactcgagaaacttcggaagcataagttatatgcaaaattcagcaagtgtgagttctggttaaaagaagtcgcttttctgggtcacgtaatctcagccggtggagtagcagtggaccctacaaaagtggaggccgttacggaatggaaagcacccaagtcggtgaccgaaattcagagttttctaggcttggctggatactaccgaaggtttatcgaggggttctctaagatagcccgacccatgacacaactactcaagaaggaaaagaagtttgtgtggtcagaacagtgtcaggaaagctttgagcagctcaaagaaaagctgacctcggcgcctattttagttcttcccaacatcaggaaagactttgttatatattgtgatgcatcaaggcaaggactaggaggagtactgatgcaggacggaaaggttgtggcctatgcgtcacgacaattgcgacacatgaggaaaattaccctacctatgacctaaaactcgcagctgtggttcatgcgctaaagatttggaaacattatctgatcggaaaccattgcgatatctacactgaccacaagagtctgaagtatatcttcacccattcagatctcaacttgaggcaaaagcgatggttagaattaatcaaggactatgatctagaggtgcactatcacctaggcaaagcaaacattgtggcagatgctctgagtcgtaagagccattgcaatcatttgagaatggaagggatggtcccttagcttagggaggaaatggcccaactaaacctatatatagtatctcgtggacaggtaaacaccctggacattcaacctcttttgagaacccagatagaggaagcccagaaggacaacggagagatccaggaggtgaaggaacgcatggccactggtcatgtgaaagaattctcaatggatgagaagaaaacactgtggtataaaaagagaatctacgtacctgaacagggtggactgaggggattaattttaaaggaagctcatgaatcggcatattcattgcaccccggaagtacgaagatgtaccaagatctgaaagaaggatactggtggcccaacatgaagagagatgtgaaggaatacgtagcactctgtgacgtgtgccaaaaggtaaaggctgagcatcagcgaccggcaggcttgctgcaaccccttaggattcccgagtggaaatggaatgagataggtatggattttattgttggattgcccaagaccgcaacaggatatgattccatttaggtgatcgtggatcgactcaccaagatggcgaggttcatccctgttaagacaaattacagcagtgccaagctagccgagttatacatgaccaggatagtatgtcttcatggtgtacctaagaggattatatctgatcgaggcacatagtttacctcgcatttctgggagaaagtccatgaagccctaggaagttaccttgcgtttagcacagcttatcatccacagacagatggccagacggagagaaccaaccaggtcctggaggacatgctgagagcttgtgcgttggactttagcaaagacggggagagatgtttgccctacgccgaattctcctacaacaacagctttcaagcaagcctaaagatgtcacccaatgaggcattgtttggtcgacgatgtcgtaccccgctaatgtggtccgagactggagaacgggcggtatttggagctgacattattcaagaagccgaacaaaaggtttgcttgatccgtgaccgtttaaaagtagcacaatcacgacaaaagagttacaccgacacccgacgaagaaacctggaatttaaggaaggagattacgtttatctaaaggtttctccgataaggggaataaaaaggtttaaggtcaaaggaaaactggcaccaagatatgtgggaccattccagatcatcgccagacaaggagaagttgcataccagttacagctaccagaaaatatcgccgatgtgcacccagtctttcatgtgtctcagttaaagaagtgcttgcgagtgccggaagaacaagctacgttggaagaaattcatattagcaatgatctcacgtatccagaacacccagtccggatattggatgaagctgaaaagaggactagaaccaaagtgtggcatatgtacaaggtacaatggagtaatcacactgaggatgaagccacttgggaaagcgaagaatttttgaggacggaatacccgcatctgttcgagaactggtaagaaatctcgggacgagatttatctaagggaggtaggtttgtaacaccctgaaaattcgaccgacaaaaatcaaaactctaaaaatgcggattttcaaaaactttttaaataaattgcatcatgccgattttattcgattattttattggagtttgggttcggagtttataaatcgcgaataatggataattggttaggaataaaccctaaaaagtaaatggacaaactaaataattaaagtgcaatttaaaataagatttggtgaggatagaaatgagtaaaatattattacgaccatatttatatccatcaaatttaaaagcaatggaatgagaattaactctaattaagttcaagtaaattacaataataatatataaaacatggaataaattaatctagaataaatccatggattggaatgccacaaatattgagtatacttcatttatgcaaaatttgggaattaaagaatcaaatttaaataataaatgggccaaaatcgggttaattagaaaacggcactgttcattgcacctaaagtgttcgacgaggttccctagccctagcccctcctttgccgcgttgccctcgcgccccgcgcgccgcgcgccgctccgcctcccctctgacgacgctgtcgccatcaccgcgcctggccgcccctaaccccacgccgccgtcgccgtcgtttccgtcgcgtcaccgcaccgccgttccatcgccttgcgccgcgcaccgccgctaccgccgtgccgtcacgcgtcgctcgccgccatcccgtcgcgccgtcccatcgcgccgcgcgccgtcccgtcgccactgccgagccgtcgccgtcgtcgcctcgcgccccgtgccgcgccgctcccccgagccccgtgccgccgctgctaccgcgccgcgccgcccgtt

SEQ ID NO: 53885 - DNA, 1591 bp, Oryza sativa
  unsure (1)..(1591): unsure at all n locations
aaaccgggagggagagggagaaggaaaaagaaaagaaaagggagagagagaaggaaaaagaaaagaaaagagagagagaaagaaaaaaaaagaaaaagaaaggaaggaaaaagaaaaagaagggaagaaaaagaaaagggaaatagataggaaattagagggagattagggaagtttagaaaatttaaaataattagcatttagttatagactagttatagacgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacggtagaaattcggatttaatcactaggaattttagacgtatattatatttagtcgtttagtactagactaaaattaaatcgtataatattataagataattttaggattccgtccgatatttagcttgcgatagaaatttccaacctattatatggatataatgctcgggtagattaaattaaaaacttatgataacaaaatatctatacccacaaaatagtttagaatataaaaatcgaaattgggtttgccctagttcgcgaatagtaaagttaatataaaagaatcgacttacgcgttcgacttctatttggatttatttggatttttatttgaattctaaccgaattcaaatcaattttcgaacgtaactataaagcccgagggagttgcggatccaagtgagggccaagacccgcaagactttgagcaaggcaagtcatcactattcttgaacatattgatcccaattgcgaaattgttttgtttacaaataaaattgcatgcaatgatgaacatcctacttgcgattatgccatgccttgattattgtataccccttattccttcgtaaccatgtctacgtatgagtccctagtcaactatgacaaatgcttagaaatgctattctagaatcatgcatactcatatttgtcaaatgctatattcttgggtaattacctttgggaaggtaattgagatgcgacatgtggagacatgagcgccacattgccatgatattgaggacatgatttgtgaaaggagaaataaactaaataactgttttcgactagggcggacggaggatttgggtggtatctggaaaaggctagtaccttccccggtcaattaaggaccgagccatgaagttaagcatgaaacgaccctcgtacaaccgcacttctcgtatgggtatagacctagtggagtagatagccgagcagaggcagtatccctgcatagatggttcacccctgagtgaggcaggtgtgctacggtaggacagccgttgaggtagggccgagaggcgtgccctacatcggtgtcgccattggtaggactgccatgagtgtgtgagagagagaacttaacttgaaccataatttaatttaatatgtgtgtgagacttctctttcccgggagcgccagaactcctctcactgnnnnnnnnnnnnnnnnnnnnnnnnnnnnnnnnnnnnnnn

SEQ ID NO: 53886 - DNA, 10453 bp, Oryza sativa
  unsure (1)..(10453): unsure at all n locations
nnnnnnnnnnnnnnnnnnnnnnnnnnnnnnnnnnnnnttccttcgtaaccatgtttacgtatgagtccctaatctactatgacaaatgcttagaaatgctattctagaatcatgcatactcatatttgtcaaatgctatatgctttggcaattacctttgggaaggtaattgagatgcggcatgtggagacatgagcgccacattgccatgatattgagaacatgatttgtgaaaggagaaataaactaaataactgttttcgactgggacggacggaggatttgggtggtatctggaaaaggctagtaccgtccctggtcaattaaggaccgagccatgaagttaagcatgaaacgaccctcgtacaaccgcacttctcgtatgggtatagacctagcggagtagatagccgagtggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagaacttaacttgaaccataatttaatttaatatgtgtgtgagacttctctttcccgggagcgccagaactcctctcactgctagaaacatggacgcctagagtgcatgaggatttaagttcatggagcgggtactgccaatgcgaggttatcgaaaggctttgccgtgacgcgtctcatgtgttgggacgaggctcatgtgttgggcagttacggagtgcgggtaaagtgtacatccactgcagtgtgagtaaacccaatctattcgaatagccgtgctcgcggttattgagcaccgggacatgtattacacttggctagtctctaaattcttaacttgtgtgtgatgggttgttgcatgacgaatttttatgctgttggagccacttcctgagaagggggaaggtgggcgtcctcagaaaaccataacgattcaatggcgggaagctatccttgggatcacaatggatggtggacagaaccgtcgttgtttaaatacaaacactggtactaaaatttgatcagtcaatgctaggtcttaggtttgtgaaaagaattacaaaactggcttagcgcaaaagagccatagccatcctttgaaatgcccctttcatatgcattgttgctgtggtgacttgctgagtacggttggtactcacccttgcaaatataaaattaatcagaagcgggagatgaagcttcggaggatccctatgcctactactaggagggagatgaagatgatggcgctcagtaggtcttagtacggttgttgcctgtggcaatggcatgccgctgcctgaattccgctgccttatctattactacttttggatgtattccggaccgctcggtccgatgatttaagacaatgcctgcgggcttatgatgtaataattagcactagactcttgtgtatgtgcttttggtatttcagctatgaactcgtgtgtagcagactacttgatccagggaaatagtactgtttacacgaatgattcatgttataaaaacggtggtccacaagctggatggagctctctcacaaaattaactagagttgtggagctgggttaggcagctgcacaactacactgtagagccaactcctgtagttaaatttaggagttggagctgcaccaaacgggccctcagtatgtctgaattgctttctctaccccaattcattgttgcaacctagtagaaaatatctcagtgcttttgaagatctaaattcaattgaaaaattggactggagtaatcttgtatttgaatgattgatgaagcatatagaaaaacttgacaagtcgaaaagttttggtggctgtctaccaataggtatgtttttcaatttttttctttgtactctcatttaaactcttataacaaactgaagaaatcttctaacttgacattttataatcttgacattttgatttttagaagaccaataggtatcttctaccatgattttataagctttaaatttttaatttcatttacatgtttttagtacttaaattatagtttttttcaatgtaattcttatacaaatttactgtaatttgatttatattatttatttcaaatcttaattttttgatattaggattttacctaaacagaatatatttgatgtcacataaattccttacttttataacttttcagttcaaccaatattaaattttctgacttaaaactatgtacaaaatgggaacattctaaattcataacttattcataacagtagacagtttgtaatgttttcttgtttctttataattttcaaattatttttttgtagaattgattgtggaatctttactctaaagtttatggagacttggtgtccgagagttctacttccaaatcttttttcccaaagagatattcctcgtatcagaattcaacttttgaacaaaatgttgttccgcccaaataactcaaaccttagctcagaactttatcaactcctgaatgatcatttttgaaggtcattttttaaaagctatttatatcatttttgtactttcatgctatgttttgaaaatttttctttatttttctatagattttggatttatatcttgaagaaatggttcaagtggagattacagattcatattctctagaaggacaattgactatactagtcttactacttacatacatattactttgtaattacaaacttttgctacttgtgtaactacaattttgtgtaatctcagtttgacttgtttcatcacaaacaattgttgataaagtataattattgaacttgaaatatgatactgcagtaatagaacttattattacaactatgaatgtccatttttgtctctgaaatatacttaagtatgaattctaattcagatgatcatatgaaatttgatatgaatacaaaacatatttgattacagatctaaataccgaaattcttcagttctttttcatcttcttgcttgaattttgtacttcatcattgcagcttttgcctcccattgtcttgtccttctgagattttcttttacttggagcaacatttttcttttgttcttgtccatcctgcaattgttttgaaaatattatatttttattttgattcaatttttttaaaaaatatatattaatctaccctataattcaccaactaactcttacatccttcatacttcattcatcaaatctaacggatgaaaataatcgaatccaaccgctcctgtaaccccacgtctcccctgcctccccttctcacacggtcgcaccccctcgtctcccccgcctccccttctcacacggtcgcaccccctcgctccgagatttttgacaataagccactaaatacgcgcgcctttgcaaacttaccacccaatccgcatgccttctctaatacaccactaggaatgaaaatttcttaatttcataccactttctctccttcccgtcactttttctttttctttttcgttttctatttttctcttcttttctgggacagttttaccctggtcccacctgtcaggtaaaagagataggggaatcgagagaaggggatcgggaacggggaggcagagcgcttgcgctcctgtcctgtcgcgcgccggctgccgtgagtctgtatgctgctgccttgctgttcctcctctgctgctgtaagcaaaattttgtcgccggagagaacaaaatggcatcctgctgccctgctgttcctcttctctgagcaggatagtggcatataactgttgcatttattgctgcatgtattgtatatatgtgtatacataaactgttgctccggatgccaaaattttgacagcttgtaagcaaaattttgacagcatgtaccctaaattttggcaacattatgtaccttgcaatttgtacagcatttgacaagtcaagaaagtacccataatttggtcacagataaaaaaatggcagcatgtacccataatgcatatataaccatttgagaacaaacaagttcaataacaaacttaagaacatcatccagattacataaccatttgacaagttcagagaacaaaatgaaaccaaccagttgtgtcccatgtttcacattacaaaagcatccacaacactaaatattatatttagaaaagcattcattttttccctttctttggagtgatcttccttgcagctctagtaggcctcggaggggttgccatttgactcgatccttctccaacaacattagtcaatgccaattggcttcaatgaactgagtgttagtaaaattttaagaatcaatcataccattgaactaaagaaaaatcataccttctagtgacaggcccaggactcgcattgctggaatcattgattgcaactttttgtcttttaggtgtgctagaacccgctgcatcactagttgaacctagtggtcttccttgtttagcacgacttttcctaaaaaaatgtaaaacaagttaaatgattcataaagattaatgtacaatatgctagaagaagtaaatgtatgtggctaccttttttttcttggtaccatttaatggacattttgaggatgtttgtctatggcccatgttaagacacttcttacattgaacctgccactttcctttggtcctaggcttgcttcctttctcaaggcacccaactatcctattctttctttgcctccctacatccctcttagtgagaggcaacaacttgaaaccaatattgacttttggccattgggacttatctggaagtggatgaataacacctgcatatgccagcttatacttttccactgaatagcaaggatccaggtaatcagccattcttgggtttctagctgatattatgagagctaatgcatgtgggcatggtttgccagaaacttgccactctctacaagtgcatgtatgttctgtaagattgacagcatgcctactaatatcatgttcaggagtaatctcagtcacttctgctaggtccttattaccttgcactaccttcaagtgacccaaatctctagtcattgcattcagttgacgaactacaatagggagcataacaccatctagtttctcacctatcttcctccgtctcgcaaatagatccattgtctttgctctgatgccatctgcgagatctgcaataggatgatccttcatatccttgatctatttgttccatgactctgctagattgttggtgatgaagtcacattttatcttttctaagaacttactcctcatccaaagtaggccgtgataagtttctagatatggcttcacatctgattttgcctcatgaattttattcatgtaatactcatatctatctgtcatgtaagacctagctgcagggtacatgttcccaaacactgaaccatgaaatttcttgatgaaattctgcatcaagtgccaaaagcattctctatgctctgctgtactaaatacacttttcacaacattctccagtcccttacaagcatccgagctgattgctaagtgtggctgttttccaatggccttatgaagttgttgcataaaccaagtccaattgccagtggtctcactttgaaaaaaaccaaatgcaaccggaaacatccagttgtgtccatctatggatgtagcagaacctagctgaccattccaactcccattaagggctgtggagtctatactcaagtatggccggcaactcatacaaaacaaaaagggaataaccatgagacaactcatacagacaaaccaatatttgaaatatgacacattgtttagttagttgttaggaccctcacggatttttcattatgcatcagcctggccacgatagcccatgggcattcatcagctgtgcaaaagcccctaaacctttctttatcagacttctctgtcccaacctgaaattgtccctttatagcgtgttgcctcacagctgacctaaattcattcatgcttacatatgagcttccaacttccatcggaggatcatctctgtcatagaaaatttcagattcaccaggtattacatcattaacagcatattacaatctctgcctcgttaaggttcaaatccccttcagtatgagctgaacctggtgtaggcactgaattcctttgcctcttagcctcaagtctagcttgctcggctctcccatcctcagctctaagtccaacaaatgtatgcatttcatcttcctccatcgaaggcatagaagaaccaagttgatgttgtggaattggttctatctccaatgcatcccaatcaatagcaagttgaggaacttggttatgtggaattggagctatctctagactatcccaatcaatacaactgctgcattcttgaacatcaccttgcctgtctgtcacaacttcacccattgctacctcattgacctctgaaactaccgagttagtcatcaactgaataggcttgccttcacatcaacaaacaaaatcaactttctatcactcttcctaacaaacaatgcatgggctacatccatattatccttaaacggtgttttctcaccagtgcccatgtcgtagccacttatcacagcatgttggttgctgccccattttacccttactgcaagatccttttccaaactctccaatgtgcactgatgatagtccacaacccattcaagccatttacgcgccacttcaacacaagtaccatcatcaagtttagctgtaaaatgaccgaactaaacgcacacgctaaactccgcatcacatacgaacaagaaaaacgagagtaaaaaaaaattagttcgcccgctaaccaaatccgtcctaattttgttcttcagcccgttaatgcaaataatggagatgtggagagttatagcattacctagaagggagctcagatggaatcgaggagcttgccgcttgcgccatgatctcttgaaccgtgaccccctgtcccatctctatcttcaaaaccctaggtccccgagggaccggaggccggccggcggcggggcaaggaggcctgccgacggcgagccaagtaggctggccggcggcggtgggtggctgggcgatctggaggctggtggcggcgcccggtgaggaggcggcgcggcgacgggacgggagcgcacgcgctctgcctccccgttcccgatccccttctctcgatctccctatctcttttacctgacagatgggaccagtggtaaaactgtcccagaaaagaagagaaaaacagaaaacgaaaaagaaaaagaaaaagtgatgggaaggagagaaagtggtatgaaataagaaatgtgcactcctagtgatgtattagagaaggcatgcgaattgggtggtaagtttgcaaaggcgcgcgtatttagtggcttattatcaaaaatctccctcgctcccgaaatcacgccgcatcctctcttcagccaacgtcgcccacccgctcgtcaccgattccccatccacgatttctctcctctcccgcgccgcccctccgtcgtcgtcgcgtgaagtcctggccgatcccctccgtcgtcgtcgcgtgaagtcctggccgatcccctccgtcgtcgtcgcgtgaactcctcgccgatccccttcctccgtcgcgccgtcacgccgccgattcccccctcctcgtcgggcgcgccgcggggttcagtcggcgccgatccccatcccccaggtcgccgtcgccgatcctgcatctcctctgtcccgtcctcgccgatcccccgcctccctcgcgccgtcacgccgccgattctcgcctctccaagaccggtattcttgcctttttgtacaatgcaactgtgtatagacatatcctagcagggatagaagtttcagtttttttaattaatgtgtcttgtgtgagaccagtgcaaggggatccacattgttcttgattttgttttggtttcaagtttgctggtgcatgtgcatgtatatgataactattgctcctcgatgactgggtcgctgttgaaggctcagttttggcaagttttgaattcgagctcgatggccgggtccctgttgaaggctttcagttttggcaagttctgaattcgagcgaggttagtgtaattttaattattttaggtcatttcagtggtgcaagtaattcatatgtcatgggtgcaattgatttacttaatcattttagaattctgtctgcagccatagcggcctgtacttaaagaaacttgagcatgtgtaaaaaaggttaaagaggcagatgcagtgtactccttcagtgaaatagcagagtacattagagaagtgtaattttacttgatttagtgcctcgcacttaggaagtgatcaatatttcagtgctgggcatatggcacttgcttgtccttaccaccttgaccaaatctgcaaaatagagtaggaaacaaaacatacaacaaagatataaaaaaaatgcagctaagatattttacttcgtttagctgaatcaaatcaaacaaaccactcatctaatttcttctttttatctttgtttaatgcaaatactatggtaggaacccaattgtttgtttgacataagaaatcagtcatctaatttcttctttttatcttttttatgcaaatatggtatttagtaagaaatgctagagtactaatagtccctctgctcaaattgatcaaatagaactgtcaaataaattcaatatgttgttttggcgtcgttaaatggcatggttgttttataacacacagtaaatacaatgttagacacagtaaatacaatgtgtagaaattaattcgagaagctcaccatcaatgttagatacacctctgaaattagagcaataatggcagatattagatcaatgcacactataggggtcttggggtcttggggagatcgacggccccggtgtcttggggtcttgggtttggttcctaactgaatattgttgtttcaacagctttcatttttgcatcttccccagatcactgctggtcaacaggtcaacaaaaggtaacgccagttgtaaatcctgccatgactctgaatctaggactctaaaagctcccaagctttaagatttgagaaccccgtgcagaggcagtggagactgaggaggtcgccatccacaaccgacaacgacaacgcgacgccgctgccgcctcaagagccaccgctgcctatccatactcacgccaccgttcctcctgcgccgaaaggtacaggacacccttcgccacccctaccccatccctaatatgtctcctctctcccgataagtatccctgatgttgatcttatgtaaaagcatgatttatgctcaatatatatcatatgtaatttgtgctggaaattgggaatcatggatgacattttctgtatatctacatccaaagccaactgtgaacagttgtattttcctctgataagcactttcaaattcatgaatatgtaccatactgctgatttcagtatggtggggaattgatgtggctggaataagaaaaaacattctcacaccctgtgtttcttccaaaaggactatatgttcactattctaagggtgatttgtctacatgtgtatcggacgatcgctgattagtccctgccatatctaactatgtatattcataaattagtactatgtattgctatatttaagtatatatgcctatgcttctatgatcacataggactgtgtgcaatataattgctctatagtgaaattgaagggaaaggcctttatatttctgtgctgaactggaaatagataaatggcacatttgtttttaataaccattgggttgtctgaaatttagagcactgaaatgcacattgtttattgtcccttgaaagtgtaaatatatttggatcactcatgcatttatgtattcgggaccaatatatattcttaagatcattggtttagactgtatatacatgggaaatggtagcgactattgaataaaaatgtgttttggttccagtaactggatgggatagatttgttgtctacgtttggacgatatcttactgatttccagtaagatctaagcgtcggtcattttttcatttcattcctgcctctgacaataggtactgtgccgttaaagatacatgtttctattcaagttaaatcacacttatgcaattattcatggttacttacattgtctgctctgttaatctatacaacttgattgccaatggcattctctgtagtctcaagggtacatgattatgcttttcaggtcttggctaaatgcatatgaaaaaacatattgattgaactttactaaaaatattgctcgtccgggatttagtaagaatgtccctctgctcttattgatcaaatagaactgtccatatatgccttttctgatcacatnnnnnnnnnnnnnnnnnnnnnnnnnnnnnnnnnnnnnnnnnnnnnnn

SEQ ID NO: 53887 - DNA, 1177 bp, Oryza sativa
  unsure (1)..(1177): unsure at all n locations
nnnnnnnnnnnnnnnnnnnnnnnnnnnnnnnnnnnnnnnnnnnnnnnnnnnnnnnnnnnnnnnnntttctattcaagttaaatcacacttatgcaattattcatggttacttacattgtctgctctgttaatctatacaacttgattgccaatggcattctctgtagtctcaagggtacatgattatgcttttcaggtcttggctaaatgcatatgaaaaaacatattgattgaactttactaaaaatattgctcgtccgggatttagtaagaatgtccctctgctcttattgatcaaatagaactgtccatatatgcctactctcttttctgatcacatagtactgtgtcaaataaattcaatatgttgctttggtgtccttaaatggcatggttgtttttataagacagtaaatacaatgtgctaaatccagaatatatcaataagtctacccttaatgatgaaatttaacttgtgcttgctgcatatttctgttcttttaaccctgatgtgtattgtagaaagtataatccaattccacgcagctattttctcctccgctttctctgccaccgctgcctggtatctaaatgtttgcacatgtgctattttcaactcaggtactttcagcgaacaagaatcttactccattataaggaatcaaaccaatcgtgaaggtagctggtactttgagaactgtcagatatgcaaatctggctaaatagtcatccatgtgaaatgccttaatgaactctgtatttatatagatgagatagctcatttagagagtacatacatgatgtgggttcttcgatccaataaactctgtagtgttgatccatttatatataattctccctgttgtgctgatccatttatatatatttctcccttgcatatgcacttttcatttactcccatccatgtaacattgtcagcactgcagcgggtactggtgtgtatacatttcgtgtgcatggtgcgttgtaccatcgcctgggtaatttggttccaggttctcaagggccactccatatgcaactttacttttatgatacagaagacgctgaagcactggcccatagggttcagaggtctcctgaccttgatatcaaccttgttcgggtcattctacgtattttggcacaaacccttacgtacagaccttcaatagag

SEQ ID NO: 53888 - DNA, 757 bp, Oryza sativa
  unsure (1)..(757): unsure at all n locations
nnnnnnnnnnnnnnnnnnnnnnnnnnnnnnnnnnnnnnnnnnnnnnnnnnnnncgctgttcaatgctgcctgaagcccctccgtgaaattcggctgcacccttggaggtatttcaaaattgatcaaggggttttttatccttatctgctcttttcatttttctaagaatcggagcaaacccacatcgtattatgctcggaattaaaatctatcctaaacaagtaaaccctaaagtttagcccgtttcgcttgaaaaaaatcacatagaatgcgatgacaacaacaaacgaaaattatccccaatgccttatgtattttttaattagatacatagatatctaattaattaagtattcttacgaaaattatcactggtcactggaggcgagcgcttacccggacaagcagccatcaacaaagcatcaagctttaggacctttgtattgttattagcttaggatttacgagtgcgtggcaaaagcgattgttggtcagttggtggcttggagcgaatgatcggtagcagccggacgatgttaattttgacgtgcgacgcagcaccagccgtctcgctggcgtcgccgccggccgtcggcgattttccccgtgagccgcgtaattcccacgcgcccgagcagccggccgaaggccgaccaactgctcgtgtgtacgtcctatcctacgcgcgtgtgtgcatgcgtgtcgttggcgtaagttaattaattagccaccgcttgttgagagccaagctaacaga

SEQ ID NO: 53889 - DNA, 786 bp, Oryza sativa
  unsure (1)..(786): unsure at all n locations
tggatggcgaggtggttctatcacaccatccccttcgaaccgggctctgactcggcgaaagctcttcggtgccggcgcagggttatcgtgccgaatcggaaacgcaggatcgccgtggacggcgctatggaggcacggttcgccttgctgtgaaaagtttgttctcgccttagctgccgcgacctggtggaggaattctgcatgcttcgcgtctttcccctctcccaatcatggcaggttacagttgatccgagcgaagaggttgatggcttgcctaagctggtcctccttgagggaatgaacagtaagactgctcttttcgctatacactcccgtgtttttactattttgcctcgtttgactttcaacatgactccccctccttgcctttacagtgctaaccctcgaccaagctgaggccgaagcccgcaagatgatcggcgatgtgtcggtcgtcgagtacagccagttgctgacacggcaggcagttggtcgagcgaactaggtttacaatggcgagttgcctcctcgggcgaatccccacaagaccaatgacgaagcaggaccttcgcggaagcacacgcgcggtcaggtaaagcttgcccctaggaagcatagggctcctgcttcgtcggactctgatgctgatgacgaggaggatgctgaaggacgtgacggcgaagaggaagggggggaagaagaggaggtggagaccgtggttgaaaaggccannnnnnnnnnnnnnnnnnnnnnnnnnnnnnnnnnnnnnnnnnnnnnnnnnnnnnn

SEQ ID NO: 53890 - DNA, 1167 bp, Oryza sativa
gtgtatgtgctcatgtggtggatttcatctggatttaggtatctgtgccctgaaccttacatggagacgaatgccgagttcttgaaggcggaggggatccgcctcttccaatttgggattgaggggaacaaggtgatcacgctgttcctttatttattttcttcctaattcatgtttgtgtgatatatgtggcaatttgggattcaggggaacaaggtgatcatgctgttcctttatttattttcttcctaattcatgtttgtgtgatatttgtggcaatttgggattgaggggaacaaggtgatcacgctgttcctttatttattttcttcctaattcatgtttgtgtgtgatatttgtgggaattttctctttaggtttgttaacttctatgtttaatagatgcatgttgtttaggtgcgattgtgctctgatgggtgtggaatcctgatgcaatatgctgagaagggcgtgtttttgttctttaaatatacaacaacattccccaatcagagttggaacacatcgaatattgattttaaacctcacaacctaatgcatgattaagtaattatgtgtcataaaatctgtacactaagtacttattccagagagtgtggggtcctaagctttccttgtcaaatcgtagggatcatagaatttacaggcatttctggaaattggtgctaatttgatgattgaaggttgccttgataaatgataactatagaacaattaaatgtttagtgtcaagtgatgtttgtagtaacaatccacaaacttcaaaaggaagttgatttagaatttctctgttgcaatttatactggttgatgcttaattaggagatgccttttcagttattgaattgaagttgatcagtgtcattttcaccattgtaactgctaatattaggcagtttcataatgcatccggaatgtttcttgtaaggaaatttcttcagtcatacatggtctgtagaatgaatttttaacataactttctatactcagcaaggacagatagttggacatccgttattttttgacatcgcagcctttttcatggtccttcatttgtattcatttttccttcaattatgcccctgcaaaacatgcattattaaattttcaatatgcctttttttatatttaaacatgaattgaata

SEQ ID NO: 53891 - DNA, 782 bp, Oryza sativa
  unsure (1)..(782): unsure at all n locations
ctagcagcagcagcagcagcaaatttttcttcagatttagcagagaagccattgctggatataatatataacctggtctctgaaggggaaggccttcttcttcccgaaatcgaagtccttggggttgtagtggacgatctccggctcggggaatcctccagcctgcatgatcaaatttcaaacacaccaagattcatggcaatcctgccggaaagtcccatgtcatttcttggccgctacagcttcgttgatgccacgtaccttggcgcacgcccgtgctagaccgtcgaaggtgacgtacttggcgccggagatgttgaacacctgcttgctcgccttcgggttgccgagcgccagcacgaacgccgtcgccaagtcctgcaaaaaccaccacaaagattcagagtttcaggtcgacacccaaatacacactctgaattctctgaataatgatcactgatcgaattgaccttgacatggccgagctgggtgatttggttgccggcaccggggacagggatggggcggccagccttgagccggtggaagaaccactcctccacggggttgtagttgagcgggccgtagatgtacaccggcctgatcgacgtccagttcacgtcccgggtctccagcaggctctccgtctccagcttccccttgtgccggctcttcgggtcgacggcgtcggtctgccagacacacaaaagctcggcatgatcaatggnnnnnnnnnnnnnnnnnnnnnnnnnnnnnnnnnnnnnnnnnnnnnnnnnnnnnnn

SEQ ID NO: 53892 - DNA, 1235 bp, Oryza sativa
  unsure (1)..(1235): unsure at all n locations
tcgctccgggggtttggcggagaggcagttcaagttcttggccaagcacttttgctgatagctttcggctcgggagaaaacagacgcgaagagcaagtactgttcgatgtcgtcgacatcccgtacaactacaatgccatcctcggccgtgcgaccctgaaccagttcgaagccatttcccaccacaactatctcaagctcaagatacccggcccagcgggagtgatagtggtcaaggggcttcagccttcggccacgtcaaaaggcgatctggccataatcaacagggctgtgcacaatgtcgaagccgaattgcacagccggccgaaacacgcgccaaaacccacccctcacagcaagatagtaaaagtgcagattgacgatgccgaccccgcaaagctcatatcgctgggggacggcatgggcgaacaagaagctgagggcatcctagcggtgctcaagaagaacattgatatcttcgcctggagccccgacgaagtgggggttgtttcaacagacctcatcatgcatcaactggcaatcaagccggatgccaagccaagaaagcagaagttgtgtaagatgtccgccgatcgtcaagaggcggcgaaagccgaagtccaaaaactactcagggctggggtcattcaagagattgaccacccagagtggctggcgaatccagtactggtgcggaagtcaaacggcaaatggcgcatgtgtgtagatttcacggacctgaacaaagcatgtccgaaagacgatttccctttgccgcggattgatcagctcgtggattcaacagctggctacgaactcatgagtttcctggacgcatattccagctatcaccagatccatatgaacccgcccgacatcccgaaaacagcattcatcaccctgttgggcattttctgtcacctcaggatgcctttcggcctgaggaacgccggagcaaccttcgccagactagtgtacaaggtcctttacaaccagttcgggcgaaatgtggaagcttacattgacgacattgttgtaaaaagccgtaaggctttcgatcatgcgtccgacctgtagagaccttcgacaacttgcgcgcagcgggcataaaactgaatcctgagaagtgtgtcttcggcattcgcgcgggcaagattgctggagattcctggtttccgaaagaggcatcgaagcgaannnnnnnnnnnnnnnnnnnnnnnnnnnnnnnnnnnnnn

SEQ ID NO: 53893 - DNA, 4153 bp, Oryza sativa
  unsure (1)..(4153): unsure at all n locations
tgaggtgtgctgtgcttggttagagggggttatgtgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatccttagaatctggatagtataggtggatggttgggcctgtcgcaacgtggtatagcgttggacagtggatgattaatattaattaattattacaactgtttaaatctttcaacttctgtttataaatgctcgctttatgcaaatgaaccactccagctctcctttggtaattccctgcatcatacccctattccggtatgacttgctgagtacagtgggtagtactcagtcttgctctatttttcccaaccccagagtacgagtatgtggcagatggaggtttctctgaggagtaggcttcgtccgtgccgtcgaggatgcctgtggagtggtgttcccactgcagttctagtcaagacttagctcctgttgtctttcgttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacaagttggtatcagagccgaccttgaccataggacaagccaaatggaaaaacctaagagccctctgaatccttttcattgcatatgttctttgcaattggatttgttccgggaaaattgggatctgttcttgtggttcaaggggaaaaatcttggtcgctcgtttaagtgagatttgtcaaaacaagtcagtctagggttttagtaaaactattgagatttattcgtcagtcagttgggatttgatgggtgaaatgcattaggtcctagctcaggaacatgggttgcaaggtatttatgctcttactgttactattagtatgtatctaatttccccaatattttaccgttatgtaagtctgtcttatttattcgctctcatgcaaaatgatctatgcataaaatttcgctcttattcgattctcttatttgagtcctttattgctttatttaaatttggatttgagcatgcattgattctactcctttgtcttctctagatggccggccacccacccaaccaccgcggagaaggcatgattgactttgtggcagagttggcacgtatgacgctggtggtgggctaccccaacgcgccagagcacacgactgttccaccgctcagtggcgagcttcctcaccgtgttcgcctggaggtccacggctacgtgggtacctgcctagctaatatggtggttgaggcatccggaggcacagcagatcacgcctgtcaggaggcagcatacctgatgatggccagactacgggagcgccacaactacatcttccacgacacggcgtaccgatttcaccctcgtcgagctagcagtgatgatgtcagtactttccgtccgacagccagcgagaacgacactacctttggtcacatgtgtgctgtgatgaggggattggataggatgcactcggacttgcacaaggcgtccaaggccttgaatgatgggaagctcatgaggatcgtcgctctgaaggacgagatagcgcgcctgaagagggagaaggctcagttaaagggtcttcccgcgccagaaggagtccggatccgcactacgccccacaagacgacgactgcacccgtgcgcatccagcttgcgcccaggaacccacctccatcagcaactcccgcagcacctccagttctgcccgcagctccggtagttcctgcagctccagtaccagctccagctcccgttcacgtgtcagctcccgcgtccgctctctccttcgctccagcatcagccgccaggggtccagccagtggcaacggaggttggttgcctgctactcccagtggcagccacgatctcagcagcagtagctccagtggctcagagccgggcagcggcgagacttatctgccaggctccaggagtcgctcagagggacctggtgacgagcaggaggacgccctcgactccaccgaccgcaggagccattccgagcattaggctcgttttccattagtttatcgactgtctagcatttgtttgttagtttgtgtgtttaggttgcttgcttgtgggtcagtcgacggtcgatatcatgtgcctatgatatggctgtcttaataaggatttttgcttgctttttaagtgttttaattcagatcagaacaattgcagtttaaattcctatataataaagcttagttcttgagcctcttttttttttcttcttttccccgtctgcttttcctccagatggtctacaccaggaatggtagccgcgcaacaggcgagggcagcaacggcgaagagcgcactgagggtgtgcatcccaacagcaattccgacaatggtccgccaccacttcccgagaatccgacgctagcccaagtgatggcacatcagactcaaatgatggcagccatgatgcagcagatgcagcagcagcaccagcagatgcaccagcggatgctgcagcatgcggaacagcagcatcagcagtttggtccccctccccctcagtccaaattgccagagtttctacgtgtcaggccacctactttctccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccgccaggcactgaagtcacttgggcagagttctgtcatagcttcaggaaggcgcaggtgccagatggggtcgtggcacaaaagaagagagaattccgagcactgcaccaaggcaacaggacggtgacggagtatctccatgagttcaatcacctcgcgcgatatgcaccggaggatgtccgtactgacgccgagaagcaggaaaaattcctagcaggtctggatgatgagctaaccaaccagttgatatctggagattacgccgatttcgaaaggctggtagacaagacaatccgtcaggaggatcaacgcaacaagatggacaggaagaggaaggccgctcagttcagggcacctcagggaagtcaccagaggccgcgcttcgctcccgagcagcagggtggacctaccaccatgatcgtccgccagtaccgcccgttcaaccctagcaactttccccagggcgcaagtggcagtcagaaccaccatggaggtcagcccaaccgcggtgcagctccgctcccaccaatggcaccggcacagtcaggcccgtccgcgcaagccaaggaggagactggagcaaaaccagggtcctgcttcaactgtggcgagcttggccacttcgctgacaaatgcccgaagcctaggcgtgccgggccaaggtttatccaggctcgtgtcaaccacgcatctgcgaaggaggcacaagcagcaccagaggttgtactgggtacgtttcctgttaactcaatccctgcaacagtactttttgattctggtgcaacgcattcgttcatttcaaagaagtttgtcgggatgcatgggttaataagagaggaacttagcacaccaatgcgggttcataccccagggaatagctccacttcggttcaattcagcccttctataacaatagaaattcaaagatcaccatttctagccaacctcattcttctcgaatccaaagacctagatgtcattcttgggatggattggctgaccaagtttaagggagtcatcgattgttcgaatcgcacagtcaccttgaccaacgagaagggagaaacagtagtgtacaaatcaccagactcaccaaagcaagggatctctttgaatcagattgaggcggaaatcccagtggacaccgtggagaagaatttgaggaaattggaagatnnnnnnnnnnnnnnnnnnnnnnnnnnnnnnnnnnnnnnn

SEQ ID NO: 53894 - DNA, 3616 bp, Oryza sativa
gcgggttcataccccagggaatagctccacttcggttcaattcagcccttctataacaatagaaattcaaagatcaccatttctagccaacctcattcttctcgaatccaaagacctagatgtcattcttgggatggattggctgaccaagtttaagggagtcatcgattgttcgaatcgcacagtcaccttgaccaacgagaagggagaaacagtagtgtacaaatcaccagactcaccaaagcaagggatctctttgaatcagattgaggcggaaatcccagtggacaccgtggagaagaatttgaggaaattggaagatatacccatagtctgcgagtatccagaaatgttccccgaagaccttactaccatgccacccaagagagagattgaattccggattgacttggcaccgggaatcgctccaatttacaagagaccgtacagaatggcggccaacgaactagcagaggtcaagaagcaggttgatgagcagctgcagaaaggttacattcgaccaagtacttcaccttggggtgctccggtcatttttgtggagaaaaaggataagacgaaggggatgtgcgttgattaccgcgcactaaacgaggtcacaatcaagaacaaatatcctttgccgtgaatcgatgatttgtttgatcaactgaaaggagctaaagtgttttctaagatagatctgcgatcaggctaccaccagttgagaattcgggaagaggatattccaaagacggccttcaccactcggtacgggctatatgagtgcacggttatgtctttcggacttaccaatgcacccgcattcttcatgaatctgatgaacaaagtgttcatggaatttctggacaagtttgttgtggtattcatcgacgacatacttatctattcaaagtccgaagaagaacatgagcaacatctccgtctggtactcgagaagttgaaggagcaccagctatacgccaagttcacttctggttaacagaggtcaaatttctgggccatgtcattacagctcagggtgtggcagttgatccatcgaacgtagagtcagttaccaaatggaccccaccgaagaccgtgtcgcagatttgaagttttcttggacttgcaggttattaccgccgattcatcgaaaacttctccaggatcgcccgacccatgactcagctgcttaagaaagatgagaagtttaaatggacagctgagtgcgataagagttttgaggagctcaagaagaaattagtatccgcactagttttgattctgcccgaccaaatgaaacacttccaagtctattgcgatgcatgtcgtcacggacttggatgtgtcctaatgcaagaaggcagagtggttgcgtatgtctcgcggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatcagcattcactaccacccgggtaaagccaatgtggtggcagacgcattaagcaggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagtcagagcagctcaagtaaatgattctgaaatagcagagctgaaaaagaacatgagagtcggaaaagcccgggatttccacgaagatgaacacggcataatctggttgggagaaagattgtgtgtacctgacgacaaggaactgaaggatctgatactcaccgaggctcatcagacccagtactccattcatccaggcagcaccaaaatgtatcaagacctcaaagaaaagttttggtgggtcagcatgacgagagaaatagctgaattcgtcgcactctgcgatgtttgccaacgagtgaaggcagagcaccaaagaccagcaggtttgctccaacctcttcaaatcccggaatggaaataggaggagattggaatggactttataacaggactgctccggacatcatcgggtcaggattcaatctgggtagtcgtggatcgactcactaaggttgctcacttcataccagtacataccacgtatacgggcaaaaggttggcggagctctacctctcgagaatcatgtgtctacatggagtacccaaaaagattgtatctgatcgagggagtcagttcacctcaaaattctggcagaagctgcaggaagaattggggacccgtttaaatttcagcacggcctatcacccgcaaactgatggtcagaccgagcgagtcaatcaaatctgggaagatatgttgagagcttgcgctcttgattttggtggagcttgggacaaaaacttgccatatgcggaattctcgtacaacaacaactaccaggccagtctacagatggcaccgtttgaagctttatacggccggaagtgccacacacctctcttctgggatcagacaggcgagcgtcaactattcgggacagaggtattagcggaagcagaagagaaagtcagaatcatcagggaaaggttgaggattgcccagtctcgacagaagagctacgcggataacccccgaagggagctcacttttgaggcaggagattacgtgtatcttcatgtcactccactcgagtttcgtcgccggaattcgcatcccctcgcgctccggtgagttcaacccctaccgccaccttcggctatgaatgccggtcgccgtggttcatctccctctctctaatctctctctcttccttccttagggcaccccgaaacccgtccgccggttcccgtcgtcctcccgtggctagccgtcgccattcgccgtcgtcttcctccgcgccggccaccctcggtgaggtttcctctcccatccattcccctccctctccttcctagccgccgcttagtgccgccgccttcgcgtcgcctttgcgccgtcgcctccgccgccagatgccgtcgccggcaacgcgtttgcgcgcgcgcgccgtcatcatcgccgcggccggtaggccggccttgagccaagccgagccgggtcgccgccgcccatccgatcgaccccgagggcgatctgggccgtcggtccggtggaccggcggtggaccacccgcgtggtcccggtccgcggtgaaccgccctcccccttgagtcgctgaccggtgggccccgcatgtcggcgccgcgcctcctcccccgtgctgacgtcagccctgggatttattgcgcaatgaatgatttaaggtttttcttttatagtaataaaacacagtgaatcttctaaaattcataactaattcatccgagctccgtttaagcccattcaagtctcagtaaatcaagaaaaatgtgtagaatccattaaaaatggttttgttccctgttgcagtagtcttatagcctttttgcaatgtttgccttgtatgtcg

SEQ ID NO: 53895 - DNA, 2065 bp, Oryza sativa
caaggcaagtcatgcttgtcacttgaacatgttgatcctatattgcaaatgctctattgttttctttcaaatactgcattgttttataatgtttctatggggtgtttacctattgtcatagccatgctagtgttgtaccatgtctctttgtcagcttggggttataacatgactagagattggactagggattgcttagccatgcttagttcaactagtgcacaatggggaaaatcttattaatgtttagactgttggtcctaatggcattgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtaacgtagctttcctctagccgacgcatccaggcaagggtgggcgtgatggagtttggatgggccctgcgacggcttctgcggcttccggattcacctaggcacgagaggggactgcccgctgccttgcgaggagtaggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgattagagtaaaactattcgaatagccgtgcccgcggttatgggcggtcaaccagattcactgtgattagtcccatcttaataaatcaacccaatacactgtagtataggtgggttggttgggcctgttcaacgtggtgtagcgttgatcagtggagatctaatttcccttaattattcaacagttttactgttttgctcaacaaattgttttacaaccgcctttatgcaaatagccacaagtcattcttgagtccccttgcacgtctgcatcgttggtgtggcctgctgagtacggtggtggtactcagccttgctattattcccccttttcagaagtgtagtgcttctgagctgaagatgatgttggaagaccaaggctcagaccccagttgagttttgcctatggagtggagctgaagccccgctaggatcgccagatgtctcgagcacgcagctcaacaagatactagaatgtctaatactgcaattatcccatcgactgagctagtggtaattaagcatggctaagcatatagttctagctaggtcacataagtaacatacgctaggtgatttattacccatggttgacaaagaacagatatcaagtaaacatgacacaagcgagcaaataggtaatacccggatcccatgtaattagcaaaacatgcatatttatttgcaaacagtaaaacatttgtaaattgggatcaacatgctcaaggggaatgtgtgacttgccttgcttcttcaaacaatcttccgaactcttatccttgcgaccgcgatcttccgaaacgacgggaactacacgctggcacgcaaaacgaggaaaaactctaataaaaaccaaggaaacagtacataaaaactaaacaaacatgtagactcaattttagatgaattttgcaatttgaatggcccaattcggagttcgaatgaattagatatgaattttagaagttttgagccatttatatgaatttctagaattaaatacgatttatgacgcgattaataattattcttccaaaggaaaaggggatgctgacgtcatcatgggggagaggcggcgccggcaagcgggccccaccggtcagcgacacaagggcgccggtccaccgtggaccgggaccaccgaggcggtccaccaccggtccacgggaaccgacggcccggatcggcgcggctggggcacggcacggctcaggccgccccagccgagcgatggcgcgtggcagcgcggccatcggcgacgacggccggcgacggcacggggaggagaggagggatgctcaccaagggcggtgacggcgagactacaacggggaagcc

SEQ ID NO: 53896 - DNA, 5851 bp, Oryza sativa
  unsure (1)..(5851): unsure at all n locations
gccggcgtggtcgccttcgggcgcgccccgcgtttgccatgtggggccgggccgtcagccgccagcgccctcgggtgcggctaacgcgtggaacccacggcgccggccggtgtaagcccgggtgcgcccggtccaccgtggaccgtggggctgccgcgtgggccccactcccatggacccggtccgcgcgcccctcccctcggctgacgcaataaatccatttttaaattaaaatttaaatgaagaaattcgcaaatattcatttaaagagcatataaacttcaaatggccataacttggccatttgaattcggaattggaccgttcaagtctctaatttttccttaagaagtcaagaacccatttttatgctttgtttcagcttgttatatggagtttattagagtaaaagccttttcttttccgttgttcgtgtagacgctgcagcttcggaagatccgcttttcgtggaagttgaagccgacgtttgggaaagcgagcaaggcaagtcacatcatccttgaacatattgaatcccagtttatgaaattattttaatttaagattattgcattaccgctttatttaaattcccacgttatcattgttttatttagccatgcctatttacctttgttatgaccttattattattgttattgttattaataccttgttcaccctagatcgaaacaaaaccccaactagtggatactctactcatggtatcactagtatgattttaggtagatgctacgctgtttaattaggtaacattaggtggttttacaactttagactttgggatattctcatcacctggacacactagaattgttgaattattgtggaattggattcacacattcccctctattcaaaatcctgaaaatggttttaggctgggctcggggtgcatggttttgatagtagcacctcggccatataaggaccggtcttcgggcctctgttgcaaagcactaccgtacttccacatgtctagtgggtaaggtttagtttgtggctcagtctggttataaacaaaagtacacggatggagatggatgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttcattcttaaaacctgcttaacaactaaaaggaggaatggttggcctgggttggcttgggacgagctgggacccagggtcgggttgccaggtcggtctaaatcatcgtaggccttgggttaaggcaggttcgtgtgggttcacggccttgattaataatattgtatagttctagaatcgtgtttacaaaatagatttgagcaactaagtgtcttataatgctgtttactgcaaaccctaaccctttatattgtaactcccttgtactcccttgcatttattctgcacttgtgggtgtgtcttgttgagtacggtggttgtactcagtcttgctcaatttttcccaaacccagaagaggggcctcaggaagatgaaggctttggtgtctagctcgtgcctgccgtcaagcgcctgtggtcgtcgccctagtcttccgttgtttctcgtttgtctttgtgtgtgctgggccttcgctgcccatgtaataaattaactatttacgcttccgcttgttgaactctgaactgtatcaacttttggtgtaccttgcctcctgggacaaggaataatgcacgcacgtatggaacgcccgttgggttaattccggtcgtgacaagttggtatcagagcccccttgaccgtaggacgagccttagatcccaagccttagcaatattttcaaaaataaaaatcctgtcttaattgtgaaaatcctctagtctctctctgtcctgctgcttcatttatcgccaaaatctgacctttaaaatgttgcttttcttcttgtttttgtttgtagatggccggcagcatcaaccgtcgtggtctggacctgactggtttcgttttggagctgcggggcatgtgcgttgtcttggggtatccgcatggagtggactactagggcaggcagctcccggagcaggagggtgacgatgcagagccccacgctgcttgggaggttactgcggtgatcctcacgggctcacccgagaggacttcgttggcagtcaccgcgggtggagattctttctccgccgcttgccagaacgccgctctcctcgccatcggcactcttcaccagcgctacccgtacgagttgcagcactcaccctaccgctaccaccctcgctgcggaggagcccgcgactacgccaccttccgggatgctagctcggaggatgacgctaccatcatgcatctggcgcgcatggtggaggcgtacgacgcggctcgtatcgacttccatcagatggtgcgccgtgggatggtcgagaatagcatgaagatcctggagctgcgtcaggagaatctgcagctgaagaaggacctagacgcagtggaggcgcagctgcatcagctcaagatcgcccatggagaggtctgtcgccccaagcgccgccgcgtctgccgcagccagaagatcaccgcccgcaagagcacctccaggcctgagcttgttcgtcagtccctggcgtggacttgcttcgttgagacccctcgtgccgagcccgcgcccgtggttcctcaggagggggaagcctccggcgttggtagcacggaggatgcactgttgctcaccttctgtcctggcccgtcgcagcggtagacgagcagttagtaggcttgcgcgtgtgttctttctcgtttgtcttcttgttggagtcgtgtggggcatggttatgccggtgtgtggtataactgtgtcggagcctgtctttattttatttgctgaagcaacttgaactttaatgaaccaatttaatagcagtaataaattcaagaattatggtagtcgtgggtggttagctttaattgtcagctctctctgtttgctggttctgtgtggggttttcagatggtgacgaccaggagaagtgctaacaccggtgatggcaaccaacccgaaggcagcaaccacaacaaccatggcagcccacctccacctcctcctccgcctccaccaccaccaccagacaccaacgccattctcacccaaatcctcgcccagcaggccaacatgatgactgctttcctccaccacctccaaaatccgccacaacagaatgctccaccaccacccccacaacactctaaactcgccgagttcctccgcatccgtccacctaccttctctagctccaacaaccccgtggatgtgttggattggttgcatgccgtggggaaaaagctagacaccgtgcagtgcagcgatgaggagaaagtcatcttcgccgcccaccaactgcaggggcccgcatctctatggtgggaccatttccaggctacgcagccagagggacagcctattacttgggcccgcttcaccgccgccttccggagaacccatgtgcccgccggagtcatggcccttaagaaaagggaattccgggagttgaagcaaggcaaccgctccgtgatggagtatttgcatgagttcaacaacctggcccggtacgccccggaggatgtacgggaagatgaggaaaggcagaagaagttcttggcaggaatggaccctgagctgtccgtgcgtctagtctccggtgactatccggatttccaacgtctggtggacaagagcatccgcttggaagccaagcacaaggaactggagtcgcacaagcgccgcttggcgaatttccgcaatcaacagggagctaaccaaaggatccgctacaccaatccctatccagggggatcgtcctcgcagcagcagcagcaaccacgctccgcgccccgacctcaattcgtggtgcgcgtcccacagccgcagcaacagcagagccagcaagggacctgtgcgccccgtcctcctacgccagccgcgcagtctggtcaaggccgcagggacgttcaaggtccgcagcgtctgtgcttcaactgcttcgagcctgggcactttgcggataaatgcccaaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaacttgaatgtgatccttgggatgaattggttggctcaattccaaggagtagtggattgcgcgagacgcactgtcactctgtaccgagggccggaacaaccggttgttttctttgcacccccaacctctgtcagtagttcagaactccatcagataggactgtcagaaatccccatcgtcagagagttcggagacgtgtttccggaagaactacccggtatgccgcccaagcgagagattgagttccggatagatcttgctccaggaaccactcctcggtacaagcgaccctaccgtatggcagcaaatgaactggccgaagtcaagaaacagttggaagagttgaaagaaaaggggtacatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccacggtattctccaagattgatcttcattccggatatcaccagttgcgcatccgtgaagaagatattccgaagaccgcattcaccacgcgatacggactgtatgaattcacggtgatgtcattcggtttaaccaatgctcctgccttcttcatgaacttaatgaacaaagtgttcatggaatacttggataagtttgttgtggttttcattgatgacattctggtatactcacaatcagaggaagactatcagcaccatctccgtctggtgttgggaaagctcacgaaagtccttattccatccaccctagcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggactcccaaaaacccaaggtggatatgattctatatagagtaaatgtggaccgattaaccaaggtagctcggtttattnnnnnnnnnnnnnnnnnnnnnnnnnnnnnnnnnnnnn

SEQ ID NO: 53897 - DNA, 2304 bp, Oryza sativa
  unsure (1)..(2304): unsure at all n locations
nnnnnnnnnnnnnnnnnnnnnnnnnnnnnnnnnnnnnnnnnnccgcctcatgaaggcaactaccctacccatgatttttttttatctgcggcggttcatgctctagggatctggcggcactatctcattgggaatcgctgtgaaatatatactgatcataagatttgaaatacatcttcacccagtctgatctgaaccttcggcaaaggagatggtcagaactcatcaaggatcatgatgtgggaattcactatcatcctggtaaggccaacgaggacaccgacgctctaagtcgaaagagccattgcaacactcttaacgtccgtggcatcccacccgaacttagtcaacagatggcagccctgaacctaagcatagttagtcgtggattcttggctgcgttggaagccaagcctaccttgctcgatcaaatccgcgaggctcagaagaatgatccggacatgcatggactcctcaagaatatgaaacagggtaaagccgctggtttcacagaggatgaacacggaaccctatggaacggaaatcgagtatgcgtcccagataacagagaacttaaacagctgatacttcaggaagcccacgaaagtccttattccatccaccctggcagtacgaagatgtacttagacttgaaggagaaatactggtgggttagtatgaagcgggaaattgcagagttcgtggcactttgtgatgtgtgccagcgtgtcaaggcagagcaccaacgaccggccggactcctccaacctctccaagtacctgaatggaaatgggatgaaattgggatggatttcatcaccggacttccaaagacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcatatcacccgcagacagatgggcagaccgagcgtctaaatcagatcctagaagatatgcttcgcgcatgtgtcctagatatcgggaagacctgggataagagtctcccctatgccgagttctcctacaataacagctaccaagccagtatacaaatggcaccttatgaagcgttgtatgggtgcaaatgccggacaccgctcttgtgggaccaagttggggaaagccaagtgttcgggactgatatactgagagaagctgaagcgaaggtcagaaccattcgggataatctaaaggtggcacagtcccggcagaaaagttatgcaaataaccgtcgccgtaacctggaattcgcagtggatgattttgtgtaccttcgggtcacgccattgcgaggtgtacacaggtttcagacgaaagggaagctcgcacctcggtatgtgagtcctttccgtatcgttgcccgacgcggagaagtcgcttaccaattggagctgcccgcctccttgggcaacgtgcatgatgtgttccatgtgtcgcaactcaagaaatgccttcgagtgccatccgagcaggccgactcaaagcaaattgaagttcgcgaagacttgacctacgtggagaggccagtgaaaatcctggacaccatggagcgcaggaccaggaaccgggtaatccgtttttgcaaggtccagtggagcaaccacgccgaagaggaagctacctgggagcgtgaagacgagctgaaggcagcccatcctgatctcttcgccagttcttccgaatctcggggtcgagattccgtttaaggggggtaggtttgtcgcgtcccaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtttcttttccctccccctctccctcttgggccggctcggcccacctccctccctctctctcctctcccccgcggaccaatcggccccctccccgcgcgcgcgtgccactgatgggcgggcccgcccgccaccctctctgacgggtggagcccacccatcat

SEQ ID NO: 53898 - DNA, 3252 bp, Oryza sativa
  unsure (1)..(3252): unsure at all n locations
gtttcagacaaaagggaagctcgcacctcggtatgtgggtcctttccgtatcattgctcgacgcggagaagtcgcttaccagttggagctgcccgcctccttgggcaacatgcatgatgtgttccatgtgtcgcaactcaagaaatgtcttcgagtgccatcccgagcaggccgacttagagcaaattgaagttcgcgaagacttgacctacgtggagaggccagtgaaaatcctggacaccatggagcgcaggaccaggaaccgggtaatccgtttttgcaaggtccaatggagcatccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgaccctaaaatatatcctttaaattatgcctagaataattaaaatccgtgtgaaagcctccaacaattaaaatgtgcaaagttaaaagtcaaataaggcttggaggatttttgtatatttcctaaaagcctaaaatgcgtaaataaatttcagtggaattttcagagcacaaataataattattaagaagtaaacaaagttaaaatggttttataaaaagaaaagctctaaaaagtccttttttccccctccccctcttgggccggctcggcccatctctcttcccctctctcctctccccccccgcggcccattcggcctcctccccgcacgcgtgccgctgacgggcgggcccgcctgccaccctcgctgacgggtggggcccacccgtcatccccttcctcccgccgctcccgccggcttgcccgcgccctagcgccgtcggcgacgcgaataccgccggccccgtcctccccacgtgcaatcaataggggggaaattttccctgggaaccccctcccctttccccccatttttccctctctctctccctcggattcgtttggaaactcctcccctaacctctccggcgccattaatggcggccgagtctcccgcgcccgtttccccctcctccggccggcccctctcacccccaaccctatataaaccctccccgtgcctccctccaccgttgccgccactcaccggcctctctccccgccggaatcgagctcgcgccgtcgctctctctctccgccgtcgtcgtcgagctccggtccgccgccgtcgtagccccggaccacctcccacctcggcgccgcctacttcggctttgccgcatcctcgccgacctcgtccacctcttcgtttcggtcgccgaccgccggagcaccgtcgaccccatccacccgagccgcgccgccgtcttcctacgctccggtcgccgtttccgtcgtcgccgtcgacccggggtgagccgtggaccgccgtttcgtttccccccttccctcccctctctcggccgccgctccaccgtgcctatggccgccgccggcgaccataggggcgcgggcgcaccgcctcctgccgctgcgccggcgtggtcgccttcgggcgcaccgagcggctgccgcgtggggcccggctgtcaccgcccgcgcccttaggtgcggctgacgcgtgggacccacggcgccggccggtgtgagcccgggtgcgcccggtccaccatggaccgtggggctgccgcgtgggccccactcctgtggacccggtccgcgcgcccctcccctcggctgacgcaataaatccatttttaaattaaaatttaaatgaagaaattcgcaaatattcatttaaagagcatataaacttcaaatggccataacttggccatttgaattcggaattggaccgttcaagtctctaatttttccttaagaagtcaagaacccatttttatgctttgtttcatcttgttatatggagtttattagagtaaaagccttttcttttccgttggtcgtgtagacgctgcagcttcgaaagatccgcttttcgtggaagttgaagccgacgtttgggaaagcgagcaaggcaagtaacatcattcttgaacatattgaatcccagtttatgaaattattttaatttaagattattgcattaccgctttatttaaattcccacgttatcactgttttatttagccatgcctatttacctttgtgatgaccttattattattgttattgttattaataccttgttcaccctagatcgaaacaaaaccccaactagtggatactctactcatagtatcactagtatgattttaggtagatgctacgttgtttaattaggtaacattaggtggttttacaactttagatcattgatgcaatgatctttgtgctattaaaactatttctcgagctccgaaaattcacggaaaattccggagagtgcattagggcacagaatattacaaaatattcttggccaatgatttttaaaggaaatttttaattccctcaataattcacttgatcatggcaggaccatgatcatcaccagttcagaatttactcctgaagacgcagcaaggatacccaagcgtcagagaggaagaaataccttccgtggagcacgccagctaacccgacatctcataaagtacggtccgcccagacccgaagatgatgaatcaggagaacggttttctactgatgacgatgatgatacgacccttaacagtttcaaggaaagagagttgaagttcaaagcatgtgctagatgtgggatagtcggacacactgctagtttatgcctccccacatgccgctgtggtgaatatacccattactcagatgcatgccctttaaggaaggtcacatgtttcttgtgtgaaggaatagatcatgtgcctaaggagtgaggacaaagtgtgtagaaaggatgcctgtggagtggtgttcccgctgcagttctagtcaaggcttagctcctgttgtctttctttctttccgctgcatttatgtaagacttttgtgatgtttgtaagacatggatctgaatgtcgatattgtcgtttgtgtaccccggccggttctggacggggattttaatgcacattctgcttggaattctattcgggaatttctgggcgtgacagttgcccacccaagctcttacaccagcaccagcgtcgctccgggggtttggcggagaggcagttcaagttcttggccaagnnnnnnnnnnnnnnnnnnnnnnnnnnnnnnnnnnnnnnnnnnnnnnnnnnnnnnnnnnnnnnnn

SEQ ID NO: 53899 - DNA, 1967 bp, Oryza sativa
aagcactgcaaggggcgaaggcaagatacatcgaaatggaaaagctcgcttacgccctggtgaaggcttcgggcaagctcaagcactacttccaggcccacaaagtaatagtgccttcacagtaccccttgggcgaaatactccgaggcaaggaaatctcaggcaggcttagcaaatgggcggcagagctatccccgttcgacttgcattttgttgcacgcactgctgttaagtctcaagtgctaactgacttcgtagccgaatggacaccagtattcgcctctgaacccgagcccgtcgaacaaccctgggtaatgtgctccgacggttcgtggtcgcacaagggggcaggcattgcggcaatactcatttcgccgaatcgcatcccagtttggtacgccgcaaggctgcagtttaacacaaccaacaacgcagcagaatacgaagccattcttctaggcctaagaaaggcgaaagcactgggagttcagcgcttgctaatccgaaccgattctaagttggtggcaggccatgttgatagatcctttgaggcaaaagaagaaggaatgaaaaaaatatttagaggctgtccgaaccatggaaaagtacttcaccggcataactgttgaacacttgcctaggggccagaacgaggaagcaaacgccttggcgaaatctgctgcttgtggcggaccgcatttgcctggcatatttttcgaagtactgcacacaccaagtgtgcctgtggacagtttgacggtcttggcaatcgaccaagtgaagttgggagaagacccaaatgactcgcgaaccccgtttgttaaatatcttgaaactggttggcttccggacgacgaagcagaagcaaagcgcttgcaaatcagagccacgaggtataagttggggggaagacgtacccgaaccgccaggctttttatagcagagcacccctcatcgaactcattcagttcggtgaacaagcttagggcactggcaggcaatacaagattgcttaccccctccacaaaaggaaggaggtccgcctgtgtctcgaagtcgccaggggcgaagcggggtaccgcgagcgagtattccgaagcagatgtctcgacgaccgctctctttcccttcgcctcaatcagcggcgacgcaaccagctgacatagaggactgccgaatacttttgctgcggctgtcatgattctttccgcagaggccgaagccccagcggcagtactaccgcctgctccagcggcgccgagtggaggaacgggggcagccgaaagatccaagctgcggccagcgggcgaagtcggagtcccgtcagaggactcatcgccgctaaaaacacgagcgacatcaacgagtccttttttcttagccaccttcttgacaagacctcccttcgccgctttgcccgaagaaaacgcaaccagggccttcgccccgtctaagtatttttggcgaaggggggagctattcgactccaccccggtctcgttatggccaggactcggagtgggggtatagccgggagtcacagcgcggccctcaaccgcctcgcccttggccttttcaaccacggtctccacctcctcttcttcccccccttcctcttcgccgtcacgtccttcagcatcctcctcgtcatcagcatcagagtccgacgaagcaggagccctatgcttcctaggggcaagctttacctgaccgcgcgtgtgcttccgcgaaggtcctgcttcgtcattggtcttgtggggattcgcccgaggaggcaactcgccattgtaaacctagttcgctcgaccaactgcctgccgtgtcagcaactggctgtactcgacgaccgacacatcgccgatcatcttgcgggcttcggcctcagcttggtcgagggttagcactgtaaaggcaaggagggggagtcatgttgaaagtcaaacgaggcaaaatagtaaaaacacggg

SEQ ID NO: 53900 - DNA, 2066 bp, Oryza sativa
  unsure (1)..(2066): unsure at all n locations
nnnnnnnnnnnnnnnnnnnnnnnnnnnnnnnnnnnnnnnnnnnnnnnnnnnnnnncatgttgaaagtcaaacgaggcaaaatagtaataacacgggagtgtatagcgaaaagagcagtcttactgttcattccctcaaggaggaccagcttaggcaagccatcaacctcttcgctcggatcaactgtaacctgccatgattgggagaggggaaagacgcgaagcatgcagaattcctccaccaggtcgcggcagctaaggcgagaacaaacttttcacagcaaggcgaaccgtgcctccatagcgccgtccacggcgatcctgcgtttccgattcggcacgataaccctgcgccggcaccgaagagctttcgccgagtcagagccggcttcgaaggggatggtgtgatagaaccacctcgccatccaatggcggtcccacttcgacatggcagcgttcaccggccagaggtcggaccgttcggggcgaatgttaaagttcacactcccgaacaccgtcttctttgttccagccggagtaaccaccgtcttcgagttcacggtggcaaagaatatggcgccgaagagggcagcgttgggttcgaacccggaagtccggcgtgcccagtcgaagatcgagatccgaaccagcgctgacgggctcaactgagggagttccacctggaagaggcgaaggatctccggcaacaacacattgcatggaaaccgtagcccagcctcgaaaaagacggtgaaaaccaccgtccggttgtctacaggcttcggcaccacgctttccctggggcgaaagcctgcccctcaaccaacgccccagagctgaccaacttcgccagctcgtcgtcgtccataagagagacccccaaaaaggaggtgttatcgtcgtcgacccgactagggtccggtccgaccgcctgaacagggtttggtttgcgaggggccgtggcgaaaggtgtgtgggaagtggcgaaacaagagggtaggcgaagcgccaatgagttcaagagacgctgtgaaaggaaacaacggaagaggagagcgcacgcagtaaaagtggcaagtgtggcagtgaaaaagaaaggggtgggaatatatagcccaccaggccgacgtttcgcctacccaccaatcataaggtgccacatggcgcaagggtaggcgtaacggtaaaatcccatcatccgaacagcacagtaaaaaacccataaagcgccacatggcgcaggggtaggcgaaacggtaaattcgcatcatccaagcagcacagtaaaaggcccgtcaaaggaaagcccaatactgttcccttccggcccggtaaaaataagaatattttatttgcaggagcagtgtaggtttcggtaggagcatcggtcgaaagggggcaccacataccataccacatggtttgcacggtctcggccgaagctccactctcacccttgcccgtgaggggctcgttggcggatggcatgaggccattcgaccaaatctgccgaaacccgtggcgcaggctatgaaccaaggatgatgcaaggcgaagggtcgcgtgagtacctgccgaagaaggacgacttcgccatggccagttcgccctggcatccagctcgaagaaagacggcttcgccatgtccagttcgcccctgcaagggccaaagaagcctttccggcccatcaagcttaggggctatagggccggcgatcgcccgacggcccatcaagggtccataagcccccttgacattatgtaaccctgtaaatgtccctttcataagggcaaccatataaatttctcagtgtaacctaaaccctagtagtaagaatctgtaatggggctataaatagccccctagggccatgtaataaggggaccggaaggagagaaattccaaaaaaaaactaatacacttcgtttctttccaaccactattaagtaaccacgtctttcgacgtatgtagttgtcgtttcgacaacagattgaaaactttaaattagttttaaaaactttctacttaagatttaaactttgaagtcaaattttgaaaactttca

SEQ ID NO: 53901 - DNA, 1622 bp, Oryza sativa
gggatttgaaaactgtcaacttagatttgaaaactttggactagagtttgaaaagtcaagatttgaaaattttcaacatgatatttgaaaaactttccactcgagagtcgagatttggaacttccttcaaattgaaaaactttcaagttaagatttgaaaactttttcgagtaaactatttttaaaacatgtgtgctatcgattaaaaaaatcggaaaaaaaagaaataaagaaaaaacacgcgatgggaggggaagcgaataaaacgaaaaaaaacgaaaaagatggaaaaaatagcgataaaaaaaaagaaaacgtgggaagagatagcgccagttccataacccaactttccctttccccttcagccgtaaaagactgttcatcagcttctcggcccacagtccataacggcccgcccacgcccacgctgacgccgtctctcccacactccccacctccgtggctccgttcctcggtctcgctaccagccgcggccgccatacgcgcgccccacccaccaaagcgccacggccccggagcaacgagcaggatcagaacgccgagttcaatagctccgctgccgacgagccaccggagacgccctccatgcaccttgccgcctcgacctgctggttgccgcggcgctgcctgcgatctctgcccgaggctgggatggtaaagagatgagggatctagtggggaggaatagagtggaaggggctcatcatgcaccggaagatccttcgcggtaacaacccaatctctttccccgtcccggcattcgtcttcgccctctccttgtgcgcgcaaaatctccatttctctcactctctgtgtttccaggtgattcattatgagaggaattgacaagcgttagagccgcactcaccttcagtttttttattttgaagacggaaatatagtttcggcatcttcaccaaataaggtttgatggtctagtgtatcaattttagtgccttggaaattttctgcttttttggattaaaagcatactgatcgcgaacattgctgtactgattgggaactgtactcatcatgaacattgttatctatttaagtggcttagaaacactgcttgatgattgtgaaatgtgaattcttcctttttttggattaaaagcctaagctcaactattcaaaatttagaacaaagtgtgaaaggtttatattggggttatgaggcatgctaaaagagcagcagaaccaactaccatcacattactaaatctgtcagcagtagaacaggcacacactaccctgaacagagtcctggaaatagctagcacagaagattagactatcaaaccccagattaaagtgcccccatcaaacctttagctcatgtcttcatcacctccaccactatatccagctttacttgctccttcccgttcagtgcttgcggacattgctgtagaataaatgacagtttacatagagcgaccaccaagtgtccaagtgtgaaatttagactctaatctttcatagaatccttgtctttgagatagatgctatttgttctagagttcagattagtgttaaagaggagcgtaggtttatgactactgaaacagatgctatttccacattaaatcttg

SEQ ID NO: 53902 - DNA, 6052 bp, Oryza sativa
  unsure (1)..(6052): unsure at all n locations
nnnnnnnnnnnnnnnnnnnnnnnnnnnnnnnnnnnnnnnnnnctttagctcatgtcttcatcacctccaccactattttcagctttacttgctccttcccgttcagtgcttgcggacattgctgtagaataaatgacagtttacatagagcgaccaccaagtgtccaagtgtgaaatttagactctaatctttcatagaatccttgtctttgagatagatgctatttgttctagagttcagattagtgttaaagaggagcgtaggtttatgactactgaaacagatgctatttccacattaaatcttgttagtgatgtcttgatgtacgaccagttattcccattatagtgctttcatactgttcaaactattttaacccctgtaaatactcattaacaaaatattattcctctgactaaaatatgcatcaaggaacaagtatagtataaataggaagagagtaccctagaaagaatatatataaaaaggaagagagtgcatatcagaagggaccatatacttgtgtgcatacatcatatctgtgagtggtgcgtagatatactcaagaatttgccaacttagctatgactgatacaaacaaaagcagagttacaaaagggggacagcccactgagatcaattgttgatttttgtagcagatccatgatttatgattttcttccaggctagataaacagagaagttctttgcattttatgcaaagatattccagccatcgattttatcagatggaatgagcagaactgtgaggacccaaatcagagcactccaggctcgagctgatgtatcatggcctgtactgggactcatgagtgccattatattccactgcaattccaggtatgtactgtgttgtactgtagtgctactcaaatttgcatcctgctcaagctgattaaactttgtaccagtcaatcaatcgttccactccactctagcactgttgccatgcccttatttggaaagtgatagccatttatgatatgaaattctgagaatgttatctccctcctatagcaatttttcatgtagttgtatttgtgaaaaaaattcagaagcacacttcagcgtgagttacctcaatatattgctgtactttcaattggaagattttattcattaagcagcatagacagctctctcagctaaagttcagtatatctcctgaatttaaaacatcaattctgcatgacttctataacgtatttatgttcttcttggtttcttcaattgaatcagcgtgtccatcttgattccgttacagtgatagtaaaagcaaactcactgctgtcacttaaaactctgtttgaatgtattctcatgtccaggtattgctaaatgaggaaatcagtgccaagatgaatctaatccatttattatgatgagcaaattgaatctttgtcccaacctttcctctgagtgctggattgaactccatccacagcctgtcacaggaaaagtcagaatgaattcaatacctgctattagaagacgaggacatgccctccttggcctggtcattgttctttagtgagaattatgacaagttcaatcacattgaagaagtagatgtttatagctggtgcttatattctttatcgtatctttattcagccatggtttatgtttatagttgttgattacttgcaggatatgagccaattgttggtcttgagttctgcaatccactcttcgtctcacaatgtaagtgttacaggtcaagaaatgtgtcatgtgctgtgcattatataagttttgtaaaagatatgaccaataggtcaaactttcatgacaaaacgtatccatacagtcctcaaccattattataattcaattgctttgcaatcatatgtagtttaacaatggcagacgatctgcataattcaagagaaaacctttgctagaggacattttttgagcaaatgcatatattcaagcaaactacaataaaaaccatgtttcttttcaaagtgcttaaggttatcataacctacaggaggaatcttgacttgaggagtacaaaaagttccacctctccaaattgctgtctcaaagcctcaaatttggctcaaagatgctaatgttaatttggatctgtagctgtggatcaactcatgttacacagcattcaaacagtagtaatgctttagtctaaaacttgcatcaactattagtctaaaggtctactagttgagtaaaaggctactcttgacatcctgtctgtaaatcctacagatagcacatgagcttttgaccaatgctaaacatgatatggtggtgttttcttcctaaatgcatcaggtgagtaccaataaacagaagtagaagctgaaatagtggttggtaataactgtagtgtgataatttcttaggattctaggttgcttcgtgctccttggagatagatgttaatgaggtatgaggagcgcctaaggcctaagcttaatacatacttaccaaatgcattttttcaatgtaaaaaatatgcttgcgttattatttgagcttttgaacaccaaattgttgaaaattagtacattactgaatgaaaagatatatagcgttaacgggtggtgatttaaatactttgataacggcgtagatagaaaacttgatccacccggtgaagaaccaagaaacaagtactcctgttctttaactttttcgctacatgtttataactatgctaatatgcataacttgctatggtgttcttagtttagtcagttaaattgttcatatctcaaaccccatgatttcttatgtacttattggtatgacagggtttaattcggctatgacatttgttactggggagcatggatgatatggtgagtagaagctattttgggccccaacctttttacattttcatttcgtaaagtgtcactaagatttatgttatgatttgactccatacggtgaactatatgcaactttgtactgtactatgaaatcagcaagaagaaatagatagtaatcacctcctcaactgtcaaagagaagaaatcagacggtgatgcttccattttgaagacaaggctcaccaattatttgacaatcttacatgcgctgcaagagcggggtgcacttctagttctaggcaggcaactggcagaaagggccatcagggtacaaacagtttgatcagatgggcatggatctcttactcaactctaaaatagggaactttacattgctaccagaaaaaaatttacaaaataaaaatgaggagtttactgccagtcatgcaatgggtgttattctatatgttctacgatacttaattcttttggaggaatagaagcttttaactggtgcttatggattagggtcaacttaaaaaattattgtgtatcgtatttcaccttatttgtttttataagcaagttactcactttgggtagtaagaagtgattaattgaggtaatgttgtgcacaggcagtcaggcatgacaatagtagttccttttttttaaagagaggatgataatagtagtacattaatagtataaactgaaaacatcgattgactgttctgtccatgacactgtttcaacttggaggtacgaattatgatcaaactccattgatgataatcatatgaccaaagcaaataacaaatttctgttatttacctttgtgtttctagtatctagttatctactatgacattgatatctgagcaaatatgatcaatatcctactcataatttgagcattttgttttgcagctgggccgaagatgcaccggttcagcttgtactggagaacctgttgtgccaaggtttgaactgggatgtctggctggctgggttgctacggaaagagagttctgtgtatctatctgactacacgctagttgaggttgcaggaaatccgtctccaacgttgcaactacatgctgctctcaaataaccaagattgaaagagcatcacatggcatgttttttaggctgctttagctagattgtttagtgtactggaaatgcatttggaaatgtctgggaaagattgaaatcatatttatcagagactctacatattccgaaaccaactactgtgactgttgccgtttgatgtgttttgtgttgtacgtgtatcttctaatccagtgcatgcttagtccttccaatcttcatctgatccgcaacttttgcacaataacttacgaaatgcaagagaagtgcataactttgatcctgacaacaaatttgtctgcagttcaaactctgcgcatgcaattgttgcagaacataattcttagaacacaacaggaacaattcaattacaaagcaagctgaacactatatgttcacacgaactcataattactcttgacgtgacgaatttggtcacataaagaatttcgtgttctcttgtacaatgtaaagaatttcacaactaatcttcactacaatttacagctcttcatcagatggtggtagtctttcagagacaccttcagccactgttggtcaatttgatcgtcgcccatgtccttcagaagcacacggtagcccccctgcgactgcttgtcacatccacctcttccgcgacgactgaaggagcgaacacatggcctcttagcatgctcgcaaaatcgtcctcgccctcgtcttcttcgttggtctcgaacggatccttgggaaaggtcaagatgggtggatgaggcggcggcggtggcgccatggcgggccaagatgccggtcgcggaggaggaggagtcgcacaccgcggtggattgtcattgccgtcctcttctcctcctccttgtagcgcgtcctccagttctttggcgagctcgtcgtattcatatagctgggaagggaggatgccgtcgactggtatactgtccaggaagctcataagctcgtccatttccatgccgatgtcagccggatcgggtacataagcagggccttgctctggcgtcgcagggacagacggctgagtcaccgaggcagctggcgccggtggctcgaacgggtccgtcgggtaggtctggaatggtggatgatgctgcgatggcgccacggcacaccggggtggcgccgcggacgccgtcacgctgctctgcggcgccattggttttgccgagacagcgcctttcatcttcttggtggcgcacggcggctcggcgaccggcgcggcgggcctcttctggggcggcgcctgctgctgcgtgatcacgggcacttgtcgtggcggcgcaggagcttgcggcgccgcctgtgctgcaggatacggcggcggcgcgagttcttggggcggcggcacgagttcttgaggcggcggcagggcggctgattcttggtgcgccaccgaatcaggagccgccctcggggagacgtaaatccggcagacgacgggctcgacgacaccaccggcttctttcccgcagaggtgatactcctccatcaaccaatccgtgttgttgccacctttcttgaagcggaagttcttgacctcgccgatcttgatgccctccctgttcttgagatccttgctggactgcgagacccaggtgccacccccggcggagcgggagaacttccctttgacccgcttgcaaccggtgaagaagaaccggtcgccattggggctcctcgccacgggcgcgtacttgccggcgaggtccctgggctcgtcggcgccgtagacgtcagcgcggtggatgtacccctcggtgtccttgggcgggtggccggcgatgagccgtggcaggtagtaggtgatgacctcctcctgagacgggttgaagcgaaaccctagcttgaggagaagatcgaggctggccatgtcgatgggagaaggcgatggatggagcgcgcgggaggaagaagcgagggaaggaagggggtgctctgcttttaaaggcagcggcgggacgggagctagggtgggtgcggatccgattcggactccgaatccaatcgggtcgacgctaattgtttggttttttttttttggatttnnnnnnnnnnnnnnnnnnnnnnnnnnnnnnnnnnnnnnnnnnnnnnnnnnnnn

SEQ ID NO: 53903 - DNA, 2111 bp, Oryza sativa
  unsure (1)..(2111): unsure at all n locations
tacnnnnnnnnnnnnnnnnnnnnnnnnnnnnnnnnnnnnnnnnnnnnnnnnatatgggctatgatattgatttatatgggctttgcatcttctttttgggctgggtttatatgggcccatttttgttgttctgtgggtcccactttcactgttcaccactttgaaatcaacgcctacttcatccgttgtatgggtcccaccttgaccatttactcccttcatcccataatataaggcatggtaaaagttgcacggtcttcaaaactaatttttaacttataatttctcatatgctataaggtttgtagcaataaaattataatcatatgaaagtaaatttaaatgtcaatctaatgatataatttttaacaaataaaattcatttcatattacattaaacgttggtcaaatattttaaaggttaaatcttgaaagcgggcacatttgaaatgcagcagtagtgagctcctatagaaaatccaaaattcaataaaaggtcataatggtcggaagctgttcactacttcagaaccatccagaaggcaagagaaaaaagcaccccattataacgacacgagaacgcagtcaggcgtggggtgcgagttagatacatacctggatctacttatttccagaaaaagaagaaagtgatcttgagctggggagaaggttttcggggtgaaagagtaagagatcaatctcctattatgtcatgaccgagggtgggtatctcagtcgcatatctagagcccagcatctctcctgaacgacaccttctacagactctactggtggtattccccgaggcgagggtaaatatgtgcattcatatcggttaggaaacgacaatgactcttcttctttccgggaagctatgggcacctcacaattcttagacgacattagtggaagcgaacattcgtagcattcattgtcaccgatcattgacaaaagaagaaaaagaagccgtacgacaacttaaggaatctttacatttggcggctatagactcaaagggcacagacaggctgctggtactgtttttttagctaactaaagtctaacttcctttgccgaaagaggatgaaacggaccacccgataccaatgaactcaccaaaagttcactgatcagatcaaccactgatcgctgagaattccaaccctttctatcccagcttctacttcacacagttgttctcgacttctactctcgatacttatcgtagtttatttttctacggttccttcaggctagggttagtgtcatttccactacttttgggagtgttatgatcagccaagctcgacaattctctcaatagtacctcgttttcatctaaaacactgcttaaagctcgatgggccgtatggccaaagtttttgaactcatctcccccaatatgatggggtttagtaccaactaagcggccatcgctgtcatgaattgatattcgctttttactagtaagtcccatggtgatatgaaatttcttatattgaactaatagttctgcccaattcctgtggaattgtttctcataggtgtgtgtgcctatcgcctgccttgttgtttttcctgttcaaccaccccaacttgtgacgtataacgatgcaggtatctggccagcattgaccgttcgagttgatgagcggaacccagacccatatgccaactggacacccgcaacgtatgtcagaaaaataccacgtttgcattgaaggaatgtcgcaggaagctgtcgatccgcgatttcaagtagttcgtgcttcggcggcaggggagggtcggagtcccaagcaaagaaggattcgaaatatgacgtcgaagtgatcatagtagaatggacgcggtgaagatgcagcaactagcacaagtgcctccaattgcacatcaggagaagatgtcactacagatcctgcggtcttctccttcctagcttttagatagccctgattctttcttggattttaatacacttagccgtgtacgtatcttggctaaactcgaacctatagttctattccacttcccgggtgtatggaaaaatctttaaaagaaataaatcatgcggtacttcttgttttaatcactcttcctttcctcttccg

SEQ ID NO: 53904 - DNA, 3582 bp, Oryza sativa
cctttacgagatagggccgttcacatgaaagataagaaaaaatccattcttcatggtcgggcgcatttctccaaatcctccaggatcacaagtggaacgctaagcaagggtggggaggctgcgagctccgcgttgaacagaaagaagcaagcagggggtgttgccgtagcgcgccggggagcaaagactccttttgtactgagaacacaattcaccttctcacaagaaggcaaaccttgtacgttgatcgaatcttctttcgcatccagaaataagtgcacgccttatattatgggatggagggagtatctcgtttattcctacagaatccaagggagagagagaagcagctgagagagagagccaagaccagcgatttcaccgagatgaggagcaggcgagctcactgcaccgtcgagctagagatttcgtcgcggcgtcggcggcattggagctactggttcgtgattcatcatcgttgctgttggtggttagtacttgctcccttgcttttgtttttctttcccatcgttttctgcagcagtagccatcaccaccgccattttttggctgcattttttgcttgtgttgtttgactagttgatcgatttttggtgccaccttcgattttgttggtggagttatgattcgttgaagagtttttgtgttgttctcaaggtgatttgttgtgaatcattttgttgtttagcagcgattagatctgacttctagaacgatgaaaacacacacccttgagtagagcacatacatgttttatgtttgtttaaacttcattgatgcttgcatgatttattctaactctaatttgttttgcaggttttttgcttgtattttggctctgttttggtgtttcaatcacaaatctatcattttcatctaaggtgagttagtttttttttgtttattttcaacttgaatgtgtgtggttctggaattttttgtgggttttccttttaaacaatgagctagtggcttttgagcaatttaatggttgatgtgaaatactgcttgtggatgtatttttattgtgtatgtgaaaatgtaattctgcatgtgcatgtgcatgtttgtattgatttttttccacaaatgtgttctatgaggtctccatgaatcattatttttattttttgttcattatattattttgctattcctactgcttgtatgtctgttgaaaagtgtttgtttaactttgtgtttggtatattagatattgagtttactgtgtttgagatgtatattaactgatagtaagaaaagctttatcttaaattataaataaatattgtaacttgcttgtatgagtatatgtctagttgcatgtctgagtgtctttcctttgtgaatgtttagtgatttagtcggctgttttagttcagttttatgaagttagtggacgaactgcttctggattttgtgttggttttagttgattcattcggctcagtttcatgaagttagtggacgactctgtgtatgtttgtggctgggagcattatattgttttatggtctttctggttaatcaaagcaaaaccgtatttgttcagttcatcagcacacatgcacagcggcgagctcatgtgtagtgaattagcgcaacagtgagttctaactgacaaatacattgtacatagttgggcattaattaggtgatgagggcaaatgatttttgcttagtgcttatttgcctatgattttctgccagcctcccttttgggagcaagtattcagttatcattaaattgaatggttaacatttgaatttgcctaaaagtggatgccgatggcaaatatggggttaggtcggaaccatctacaagccacacccagctgggaaccgatcctgaaagatgaagcagacatgcactgctccacgaattgtttctaaaatgaaaattcatttctttagcctttctttgttctagtagtattattgtctaggctgcagatttttgactttggttttgatcgactaggtgccacttcagatcttaattgtactatgccatcatcaaacatatataaaaattttgtgaaacacaataaaaacatatggtgaaacatatttctatcacgtatgaaacattaagtttttatggtttgaaacatatgtttttctttcatcagaatataatcatgtgatatcttattgtaaagatttaattataacgaattcaacggtatgatcgaatcgctcatcagttaagtagtttggaagaaaaagatttttaaaatcattaaatagttgcatcttgcatgcatgcatggtgtggagagaaagtcaataaaatgtatgagagaaagagagtgaggcatatacttctcatactttttcagtgtgaagcattatatgtggtgagacaaaaaaatcagttactgaacatttaacttttctatgaaacataatgaaagcttacaatgaaacatattgctaccgcgtctgaaacattaaacttaacagattgaaacatacgtttttcttttatcggaatgtaatgatgtgatatcttgttataaagatttaattatagcaaatacaatggtgtgatcatatcacagacttgataagtagatcagaaggaaaattattttgaagatcattataacatgtatggatgtgtggagtggattggaaagcagtagtttgcctgtctgatttttgtttgctgcgtcagacgtctaataggaagcatttccggaatgttagtcctacatattgctctgttaaacagcatgatggcacaagaatattttaagctattatatatgataaaacattgttattgttgtttttaactatttatatggtgattagtttttttaacttttgttttatttttccaatagatggttaatcaaaaagcaattgatgatatttttagtgatgagatgtcatcagattctgaaagttctccaaatgatgaagaattttgtaaggatagatctgacagtgaggtatttttgttttaataataaccaaaagttcatttttttgtcattttgcttaatcttacaatttattatactattttttaaaatttgtgtagtgatgtaaaataagctgtggtgaattatcaaaatatgagctattacgatcattaaaagcaaaattgaataaaggaaaattttcatttgatggcaacttgaaggtatccaatctactcatttgtttttaactttttattagaaaaaattggagtggagctgtgtaacgccctgaaaattcgaccgacaaaaatcaaaactctaaaaatgcggattttcaaaaactttttaaataaattgcatcatgccgattttattcgattattttattggagtttgggttcggagtttataaatcgcgaataatggataaatggttaggaataaaccctaaaaagtaaatggacaaactaaataattaaagtgcaatttaaaataagatttggtgaggatagaaatgagtaaaatattattacgaccatatttatatccatcaaatttaaaagcaatggaatgagaattaactcaataagttcaagtaaattacaataataatatataaaacatggaa

SEQ ID NO: 53905 - DNA, 1387 bp, Oryza sativa
cccgttccattgctgcgcgccgtcgccgttcggcctttgcgtcgccgctgccgcgccatcgccatcgcgcgtcgcatcacctgccgcgccgcgcccccgggccccgagtcgccgctgctaccgcgccggtgccgctcctcgcgccccgcgccctgctgcgacgcgtcgtcatcccatcgccgcgtcgagccccgcgccacgccaccccgccgacgccatgaggccgccgcccctctcccctcttccccattatctctctccccccttcccttatataagcccccctactcccactcttccccttcatcctcacctcctctcctctacccacgccaccacgccgccgcctccacgccgctgcgccgccgcctccacgccgccgcgctgtcgcatagagccgccgcgccgccgccacgaagctgccgcgccgcgccgcaccttgcgccgacgtcgccaccgtcgccgtcgctgccgtcgccgcgaccgccgtcggtaagccgccgcctcctccacttgctcggccaccgtcgccgccctgggtagcagagagccgagaaagagagagagagagggagaaaccaagggagagaaagaagaaggaaggaggagagaaaccgggagggagagggagaaggaaaaagaaaagaaaagggagagagagaaggaaaaagaaaagaaaagagagagagaaagaaaaaaaagaaaaagaaaggaaggaaaaagaaaaagaagggaagaaaaagaaaagggaaatagataggaaattagagggagattagggaagtttagaaaatttaaaataattagcatttagttatagactagttattgacgtagaattgcgaaatttaatataaattatggattattcttggtaatttctacaagaaatcaattcgcggtagtagtttaaatgtaattaagaactaaacgattagatgaatttttatagactattatagattattttgggtaatctctataagtaattgattcacggtagaaattcggatttaatcactaggaattttagacgtatattatatttagtcgtttagtcctagactaaaattaaatcgtataatattataagataattttaggattccgtccgatatttagcttgcgatagaaatttccaacctattatatggatataatgctcgggtagattaaattaaaaacttatgataacaaaatatctatacccacaaaatagtttagaatataaaaatcgaaattgggtttgccctaggtcgcgaatagtaaagttaatataaaagaatcgacttacgcgttcgacttctatttggatttatttggatttttatttgattctaaccgaattcaaatcaattttcgaacgtaactataaagcccgagggag

SEQ ID NO: 53906 - DNA, 773 bp, Oryza sativa
  unsure (1)..(773): unsure at all n locations
ggtgctactttaaaaaccatgcaccgtgtgcccagcctaaaaccatttttggggattatgaataaaacgagcggtgtgaaagcgattccacaatatccaaaccattccatagtgtccaggcgatatgaatattaccaaagtctagaggtggaaaaccgactaatgttccctaattaaaagcgaagcatgtacctaaaatcatactagtgattgcatgagtagagtgtccactagttggggttttgtttattttagggtgaccagggaaataataccaataccaataataataaggtcataccaaaggtaaataggcatggctaaataaaacagtgataacgcgggaatttaaataaagcgataatgcaataagttaaatcaacataattttacaaactgggattcaatatgttcaaagatgatgtgacttgccttgctcgctttcccaaacgtaggcttcaacttccacgaagagcggatcttctgaagctgcagcgtgtacacgaccaacgtaaaagaaatggcttttactctactaaactccatataccaagcagaaacaaagcccaaaaatgggttcttgacttcttaaggagaaattagagacttgaacggtccaattccgagttcgaatggccaagttatggccatttgaagtttatatgctctttaaatggatattggaaaatttcttcatttaaattttaatttaaaatcggannnnnnnnnnnnnnnnnnnnnnnnnnnnnnnnnnnnnnnnnnnnnnnnnnnnn

SEQ ID NO: 53907 - DNA, 1208 bp, Oryza sativa
  unsure (1)..(1208): unsure at all n locations
atggattgtgcaacgggactagactaatggttagagcttttcaagataatgcaattgatgctgaaattgttggtggacaacatgccaacaaaagggtgttcatcccacggatccctttgcctccctccgacgatatatcactacctttcaaattcaagaggaagcaattcccaatatgtctcagtttcgcaatgaccattaacaaatcacaagggcaaaccatcccaaatgttgggatctatcttccagagcccgtgttttcacatggtcagctatatgtcgcattgtcaaggagtgtgtcaaggctaacaacaaggattttggcaaagccaaagaaagaagttgattcaacagggaagagcactaaaaatatcgtgtataaagacgttcttgactggtgagcaaaggtaggttcgcatgatctaaattaattcaaaaaaatattgaatatagtaaattgctcatcgaatgttactcaccattgtcctctttttttgtacagcacgccatcaccttttatatggaatgccgtatgatatcttctacatactttctcacactagatgcgtcagttttcaccaggctgtcatttgagattgtaattggtctgtattatattaatggatacatatgcttacaaaagtgttctggattatttttttctatatggttcatccatacaatttaaatggataatgcaccgcagacaacccacaccaccgccatggtcatcgccatcgccatccaccgcatacagcccgcaccactgccatcaccatcacgatcaccgccgcctccgctttcctctgctattttttggggaaaagacagagagggagaatagggctgacaagtgggccctacgctttttagtttttctcctatcacttacatgtgggcctcatcttgtaaagttttattgtgcccacgcaatatcatagtattgcactttacatgaaatatattttatgtacgatataaattgaattaaagttcaaatgcatagatcatataaatttttttttgctaacatgaaattttaaaaattattaaagacagatagaattgcaccgtagcgtttagcacgggcatattactagtaatattagttacttacataaaaagtattattttgaacttttctcttcttcttnnnnnnnnnnnnnnnnnnnnnnnnnnnnnnnnnnnnnnnnnnnnnnnnnnnnnnn

SEQ ID NO: 53908 - DNA, 870 bp, Oryza sativa
  unsure (1)..(870): unsure at all n locations
nnnnnnnnnnnnnnnnnnnnnnnnnnnnnnnnnnnnnnnnnnnnnnnnnnnnnnnctcggagtatttcgcccaaggggtactgtgaaggcactattactttgtgggcctggaagtagtgcttgagcttgcgcgaagccatcaccagggcgtaagcgagcttttccatttcgatgtatcttgccttcgccccttgcagtgcttcggagacaaaataaaccggtttctggccgaactctgtttcttggacgagggcagcactgactgccactggtgaagctgctaagtatagcagcagttcgcttcctagtgttgggcttatgagggctggtgggctttgcaagtattgctttagctcgtcgaatgctgcttggcattctggtgtccaactgaactttcccatgccccggagggtcttgaagaatggcagacctctttcggccacctttgggaggaaccggctaagtgccgtaattcggcctgcaagcttttgtacctcatgtacacttgacgggggcttcatttgctgaatggcgtcgattttctcggggttcgcttcgatgcctctttcggaaaccaggaaacccagcaacttgcccgcgcgaatgccgaagacacacttctcaggattcagttttatgcccgctgcgcgcaagttgtcgaaggtctcctacaggtcggacgcatgatcgaaagccttacggctttttacaacaatgtcgtcaatgtaagcttccacatttcgcccgaactggttgtaaagaccttgtacactagtctggcgaaggttgctccggcgttcctcaggccgaaaggcatcctgaggtgacagaaaatgcccaacagggtgatgaatgctgttttcgggatgt

SEQ ID NO: 53909 - DNA, 1190 bp, Oryza sativa
gaacgttgcaacgacgtaatgacagagattatagaggaacttaacgtgccagtggactttgaccatttagacatatacacatcccttaatgatgagcagcgtgcaggatttgatgaaatcattgatcatgtaactaataagaagagctaggtattttttatcgacggcccaggtggcactggcaaaacatttatgtacaaggcgcttcttgctagagtgcggtccgagggattaatagccattgcaactgcgacgtctggtatagcagcgtcgattttgcccggaggacgtaccacgtactcgagattcaaaatccctattaagattgctcacaacagcatgtgcaacttcatgaagcaaagtgtcaccgcggaattgcttcgcatggcgtccttagttatttgggatgaagctgcaatgacgaagcgtcaagccgtagagacacttgataggtctcttcaagacattatgtgttgttcattgccatttggaggaaaggttattgtttttggcggtgatttcagacaggtacttcccgtggttacacgtgggacaagggcccagataactgatgcacattgcagagatcgtatttatgggaaaatattaggaagatcagattgtcgcgaaacatgagggctcaatctgatccatggttttcggaatatctccttagaattggaaatggcactgaaaacactatcagagatgattatgttcgcttgcctgatgaaattgtgattgcttatggggatagcgaggattcagtacacgaattgattaatcatatgtttccctcgcttgatgatgaaaagaatgcaagctctgcatcttatatgagcacacgtgccattctatccactaaaaatgattatgtggacaagctgaatgcgaatatgattgacagatttctagggcaggccaaggtttatcacagctttgactctgttgatgatgaccttcacaacagttatcctctggactaccttaactctatcactccaaatggtctctcaccacacgagctaatagtaaaaatcaattgtcccgtgaatcttcttcgcaaccttgatccaaataatggattgtgcaacgggactagactaatggttagagcttttcaagataatgcaattgatgctgaaattgttggtggacaacatgccaacaaaagggtgttcatcccacgg

SEQ ID NO: 53910 - DNA, 2046 bp, Oryza sativa
  unsure (1)..(2046): unsure at all n locations
attcgagctcgttaccctatcatagtattgcactttacatgaaatatattttatgtacgatataaattgaattaaagttcatttttatagatcatataaatttttttttgctaacatgaaattttaaaaattattaaagacagatagaattgcaccgtagcgtttagcacgggcatattactagtaatattagttacttacctctttagtattattttgaacttttctcttcttcttccttggcaaatcaaattccatgtgtttaaatggacatgtgggaaatgtgtggtctgttctaccacaatgactacaatgatttgtctctttttcttcaatttgctcattaatagtcttgtttctttgtcttggccttccttttgaattttctatatcaggatcttccaaatattttcgtcattcattgtttgttcctccacatcaatattctcggaattttcattgacttctgcttttccattttgcaagatgttatcctcaacattgatattttgatgttcacactcttgaatcgttgaaatcattgatttcaatgtgctactaattttgtctgattcttccaacaagtattgatatgtttcaactgatttggaacctcttgatatattaatgttacattttttaatatattaatgttacattttttaaatactaaaattacatttttttctatgtaattcttatacaaattgactgtaaattgtatcgaaattattaaacatttcaaattgatgtttgtctttagacaatagtgataattttgaaagatagtattattgattattagaagcaaacatcaattttcttaacaattgttctcaattatattttttaagttctaaaatgacagggtttttttaatgtaatgatatttcaaattcaatgcaattttaattgaattttataagacagatcaaaatttacctattcttgattcctgtgtgttcactccactcatgctttccttcttttttttccgtaacttcactcatatcatgtttctcttttgttgcaactgaaacaatcaaaggaaattgtttatggacaatacatttaacttgaaaaaagaaattaaagtagtagtaatcacataaattttcatttacatgtttttagtactaaatttacagttttttttctatgtaattcttatacaaattgattgtaaattgtattgaaattattaaacagatcaatttagtacttctaaattcatttttgaatcatttcaatactaaaacaataccagaaattgtatttaatatagatagtaatgataattacaagtgaacagaaatttttgatcatttgattccagttacatgtttcaagttctcaaattacagtgcagattctatgtaattcttacacaaattgactgtaatttgtaattttagtcagttcatgtttttttggttgaatctgaaaggactgaagcaaaatcttgtttgtattatgactgcatagcacaatattcagagtagtgcagtatagtgcaacattcagtgttttcagatctaacattttttctaatttcagatccaacattttttctaattgaaacattccaataattgaaaattgaaatttataagtctagtttcagtttttatgttttgatacagtgtttttcactgtaatttgaatttaattttgtaaaacagatcttgatttacctgttcttgattcccatgcattcactccactgatgccttccttcttttttccttctacaattcctctatgttcactcaaatcctgtttctttttggttgaaaccgaaacaatcaaaggaaattgtgtttttttcttttaaaccataatacaaacattcaaagtacattagaaatgaactacatagaaagtgcattgtaattttgaaactaacgaatcaaatttttgtttcttttccgtcttgagcattttgctttagcgagaaaaaaaatttattattgaattaatcttgttagtacttctnnnnnnnnnnnnnnnnnnnnnnnnnnnnnnnnnnnnnnnnnnnnnnnnnnn

SEQ ID NO: 53911 - DNA, 3177 bp, Oryza sativa
  unsure (1)..(3177): unsure at all n locations
nnnnnnnnnnnnnnnnnnnnnnnnnnnnnnnnnnnnnnnnnnnnnnnnnnnatgtaattcttacacaaattgactgtaattttttattttagtcagctcatgtttttttggttgaatctgaaaggactgaagcaaaatcttgtttgtattatgactgcatacacaatattcagagtagtgcagtatagtgcaacattcagtgttttcagatctaacattttttctaatttcagatccaacattttttctaattgaaacattccaataattgaaaattgaaatttataagtctagtttcagtttttatgttttgatacagtgtttttcactgtaatttgaatttaattttgtaaaacagatcttgatttacctgttcttgattcccatgcattcactccactgatgccttccttcttttttccttctacaattcctctatgttcactcaaatcctgtttctttttggttgaaaccgaaacaatcaaaggaaattgtgtttttttcttttaaaccataatacaaacattcaaagtacattagaaatgaactacatagaaagtgcattgtaattttgaaactaacgaatcaaatttttgtttcttttttgtcttgagcattttgctttagcgagttgtgttctttattattgaattaatcttgttagtacttctacattttagcatgtcagtttgtatttagttagagtaggttgataatgcctcggattttcacttagacttgtagctgttgagatactagtttatttcattaatctggttttctagaacctttcgatttatgcttgcttatgtttgtatcagtccaaacatgtgtcctatatatgatcacaatattgtctttctttgtccagcatattactagatcaaatgccactgctgttgttttaaacataatagaagtgtattagataggatgtccagagttagttgttgaacatgctttgcccataatttagctggagactagaaatcacttctatttcacatgttatcaaaagtagttattttcataaaaaatattcacatctacctgaggactaggtaaagatattctaggcctaggaatagaatttttcctagtgttgttaatctaagtgtttagtttgtcttttaggccaatagtcatcattttgtctttaggccaatacagtatcttaggtgttgtttttgtcatgttatagtacctgaattagaattgaactacactgtctttgtttttgttgtatattcagggttcctgtgtgcattgtacaagttttgaacttttgtcacatttgtctatgctttttggttgaaactgaaatagtaaaatgtaaatgttgtttgtacttttaatccatagtacttcatgatatccgtatattgctttttttctccattgtagtgccaaattcagagtttgcagatacaaattcagagtttgcagatacaaattcagagtttgcgttatgtcttcagaaccactgaacaagaaaataagatcaaagcaatagattatttactcagatcccaaaccacactgaaacaaaattcagatccagccaatttttttgatatataacatttcaaagaacaactttttgtggggatgtttatttttgctgcccaatacgtgtctacttattttctctctaaactctgttttgttctaatttaccagaggaagtattttgcaagatcaaaactcaaagaccaacatgaagtaaaggaagatttcaaaagaaaatctacatgtgtagttggttacttgaagaaattcagaagaatcacaggtaccttccgatttgcgcttttcttgaaatttgattcccaatctttctgcttttgaatcttgtccagaagaatcttgttcttttatttcatctccaattttgagttccttttccttcatctccatctttttccccagtttcttctcttcaatcgatctgtgtttatctctctgagtttttgcctgttttgttcactggttacgtgtgtttgtcaccgatctacttgcattgcaagttttgtatgtcacgtgtttgccccttctttttgggctttatttgggcttgactttttttgagctcataatctgttttatatctcttcatcttttttttctgggccttaatttgggctttttaagttgggccaagattcgtttgtcaatgtctatgtatttagttttttagttgtcaaaattccgggctgttagatcaaaatctagtggttcaaaaattcaacacatttgagcccctgttttctgtcgacagaacagtagacagtccctttttttaagataatggaatgaaacattccgacctttgctcaagagttacagccaattattacaaagtttacacaaaatcaaactcacacaatgtgtatgttgacaaagtaacaaaacaaaaagtaaaagcaaactaataaaaccaagcaaggtaaagagctgcatgatcgtggactcaagtttacgacacgcatcttttattagcttgatatgatcatcatgcctttgtagttgagctcattccctgagctaatatgttgccctggaaagaacctgcaaataagattttgaaggtgatctattaaaaaccatttcatttctactaagccagagagcccaacaaacagcggaagctccaacaagaataagatccttgatcttattattaacacccacaagccaattcccaaacatatgagatatactatgtggagggtgtcgaaacaagatttcggcaatactaaaagggggtggctatcaagttagaaaagtggatgggtttgaagacaagggattttatacaggttcaggccttcttagttaagaagtaataccctattcttgtccggggatgattccgccgagtgtattattgatcgtatgatctgggagaaaatcgtgtccccagagggacccggacccctccatatatagggggaaggagtccatattacaaaatacagtttatatccctaacggaatatgtgattacagataaaatacaatcataaccgactaggatcccaggtatttccttgacatacaagtttaaaaacttacccgagtcctcttaaagatattctatctatatttggtacccttgacctaaccagactatacatgccgtgtagatattgggtatcataatcttcacagtagccc

SEQ ID NO: 53912 - DNA, 3558 bp, Oryza sativa
acgagtctaataacctaggctatgacccttacccaatcaaaataagcatataacatgccaagagaatgactcttaataaactagtcatctcgaatcaacccaaacagcttttgcaacctaataaagcttacaaaaatagtataacaccttcctgtcgggcacatttttatttgcgtcgtagtaattccaaagaattatctaaccgcgttaaaaaggattttaacaacatcgggtcacatcattgtgtgcacaaattgccaaagcaaaaagcgcctaagtccctagggatcataacgggccacgctggtaataatattgggctgaagtactgtacaggcccaggcccattagcactcccgataccctaacaaaacaccgaagtccaaacgacgcttcgtcttcctcgccgagactctcgccatttccccattcctcgctacagtacaaaaccgcgccgacgaagctagggttcatcaatccactccaatccatcctcagaaactccacgaaatttcaccgcgcgtccaccgcaccgattccccatccctctccagccacatctcggaccaaattagaccattcagctcacattcatggcggaagagagagaaagcttcgagagtcagtgggcgccctccggtgtgacggaggagaatctgaaagaaatggtggcgcacggtgtttttccggcgaaggaaatcatcgggtggcgaccagcgttcggcgaagtgttcccaacccctaatacacacgaagtcgtggtattttctcacttcttttgtggcagattttctcttccaacctcaagattcttccagggaattttgaacttctatgggattagcctgcatcatttgaatccaaagtccatagttcacatcgccaatttcattcatgcctgcgaagcttttctgggcattaggcctcatttcgctttgctctgccgcatcttctttctcaagccccaaccgaacaagagcaaaccatgcgttgttggggccgctggtttccaactcagaggaacactgagccaaaagtatttctccgtgcccttcaaaacctcaaacaaaggctggcacgcaaactggttttatgtccaaaaccctgaacccacactccccgagtactcctgtctccctccagtctatcaggatacttggaactcgctacctatgggaaatgaagccgctcaggcagtggaactgatggaccgcatgataaagctgaaagaacaaggtcttcaaggagaatagatcactcggcatttcattaagagccggttagctccaattaaggagagatctcgcacggcttttgaatttgacggcaagcatgatccaaatcgtgaagatccagattcccttgattttaaggttatgaaagaaagaatgtacaagatcttctccaacgctatcgtggttagctattcacacttgctgccagtggtgccgtacaacgcattcaatcctcctccaccagtacgtattcaaacacttcaaccttcctcaaaatgtgatcttgtcttcttgttaaatcagttgacaatggaagatattatgctcagcagtttgctttgatgaagtcggatcccccaatcgctcagcgccgatcacctcgccatcaaactggtcaggggagcgggggaccaaagatccgatctaaagcccaaccgaacacctctaatctagccggccagccggattcccgcaagaggaagttagtgctgagtgacgacgaaggcgatgatgctagaaagcctggagataaagaaacaatcggaaaattgccgaagcaagccaatccaaagaagaaaacatccagtcgtcctatgccgaaaatcagaaagtcttccaggtacaaatcatatagcgatcttccttgtattgacgctcacttatcatgaaaacaatgctgataatataactcaaacttgtaggaaaccatctgatatagacccttctgggaaagactctgatccgactaacatggagacgagttcctccaaagaaaccgggccaactgcaaaggatcatccgagaggcaatcagccggcaaccgacaatgtagaatccagcaaccaacctccgactggaaaccagtcggccgaagctgaagtcggagttaaccaggagcccccgattggaaaccagtaggacacagggccaagccaagagattcctgaggttgaaactcaggcaaacagccctcgcggacaggatgccagcaatggcccaagatctggatctcctacaaaggcacaagagtccactcgtcctcgtccggaaatcatcataggtaaacacttcgtctgaaaccatgttgatccaactgactttatttgattgttcgacctttatccatggatatattaggaccaatgattggtgatgaagaggagattctccgaatacgagcagctgaagactcgcgccctcccattctggtcaagtggtgggatgacgacatgcaacctcaaggaatcgtaataaaccggaaaaaagaggatgaagaggtatgcctacagaaaaaggcacttagccaggcgactcgcatcgtaaacgtaagttccttgatgcctgacctcaaccatcttgttcgccatttagctcgagcactaataaaactgttttgcagaggattcaccttaggaatgaagcaaaaaccgcaaccttagagaaattagttcctcatctcggaacccttgaagctatcagagatcaactgcacgaggcaaaagaacttgccaagaaaaccgagcatgatctaagggatcggatcgctgagctccaggagtctaattttgaactgactggctcatcaaaaggtacacacaaactctgtccgactaacttgtgctgtcatctttgtaacttcaattaaccggagtcaatgtagtgcaagccgccaagatatctcaactggagaagcagattcagactctgggaaatgacaaggcagaactggcaagatagagggactcagctttgaaggatgttgaaggtaccatcaatcgatactccaaaagccattatcttctatatgctgactcattaatgtgaatctgttgatgcagaccgtaagatcaagtcgcaggctcaattcgacgtcctagtcggcaaaatcaagaggctcgaaggggccagggacgaagttgctaacgctgctaccccactcgtccaagcgatgttcttcaataacaacggtccgagtacattcgatgcttctgaaatcttcgacaagctgagagttgctccggatacatatttcaagaacatcaaagaggtcgggagtatgggagcgagcctagcgttggcaatgaccaagtccctttacccaaaaatcgacattgatgccgttgatggctttgcagacgggacgagcgaagaagctgctcttgaccttatcaatgatgcgcagaaagccgccgacaagacagtggttgatgtagtcgagaggttccaggacaccgatctttgaccgactggtcctgataactccgatgatgaaaaaactgatactgattgatgtaatgtgataacaatgattttgatgatgatg

SEQ ID NO: 53913 - DNA, 7619 bp, Oryza sativa
gtcgagaggttccaggacaccgatctttgaccgactggtcctgataactccgatgatgaaaaaactgatactgattgatgtaatgtgataacaatgattttgatgatgatgatggaggcacaatttgtacaatactgatgaatttatgctgtgctcggtgtttcaaacttagcttctgatttcttaaaagcttttgtcaaaccttattgagcctaaaacccgcaaaagttattaaaaagcttttagtcctcatggactaagccaaaaaatcaagcaaggcaatgataaatcaagtaagcaaattgaattgataaaaatcacactccattattattataatagtccccgactgataacttcaaggagacgcttgatgttgtcagtcaaaatagggaaatacagaagcaaaacttaagcataaaaacgacgaagatgttcgatattccaagagttgtcgataggtgtaccgtcttcacgcttgagtcgataggaacctagccgagtgacttatgagattataaatggcccttcccataaaggggataacttgtgccgatctcgtgtagtttgaacttttctcaaaaccaggtcgccgacttagaaggctcgtgatcggacgttacgattatgataacgacgcaacccttgcaggtatcgggccgtctgaattaaggctacttcgcgggcctcttccagtcgatgtagatcatccactcggtcttctccgtagcgctcctcgcgaaagttgcgaaaacgcaaagattcaaattctacctcactaggcaacattgcttctgctccataaactaggaagaatggtgactggctcgtagccgactgggggtggtgcgcaaggaccaaagtatggatggcagctgttccacccatttgccggcataaggattcagtcggtcaaaaactcgtgactttattccttggagtaccatgccgttggctcgttcaacttgcccattgctcataggatgcgctacggaagcataacaaattttgatgccgaagtcatcacaaaaatctttaaatactccaccagtgaattgagtgccattatcagtaatgatccgattaggtaccccaaaccgatacacaatgttgatgaaaaaatctctagctttatctgccgtgattgtgatgaccggtttagcttcaatccacttggagaatttgtcaatagccacaaagagatgtgtgtaaccgctgactgcctttttaaacgggccgaccatgtcaagcccccaaaccgcaaacggccaggacagcgggatggtttgcaactcttgggctggtagatgagtttgtctggcgaaaaattgacaaccttcacatgtccgcacaatcttgtcaacatcagacacagccgtaggccagaaaaaaccttgccggtaagccttgccgacaatggtgcgtgcagcagcgtgattgccacagataccagaatgtatatcctttagcaattgtctcccttcctctaaggacacacagcgttgcaggattcctgatggacttttcttgtacagctcggtctcatggataatataaagcctgctgcacctggaaatccgctcggcttcatctttatcttgagggagttcttggttggtcagaaatcgtataaggggctctctccagtcggcttcaaccatagctatgtcttgagtgtccgcggcctcaactgtttctctccttggtacggttggttcgtaaagatgttcgacgaacacgtcagaaggagccgcttcgcgtttggatccaaaatttgctagtctgtcggctgcttcgtcattgtgccgaagaacatgggtgagatcgattccatcgaacttatgctccaacttgcgtacctcttgtcgataagcgatcatattgtcgtcaaggcaggaccactctttcataacttggttaacaactaactgtgaatctccgcaaactatcaaacgccttgattcccaaagagattgtgatccgtagtccgtgaaggagcgcctcgtattctgccatgttgtgagttgcagagaaacgtatccataacacgtagctcagtctctctccagtcagggaaattaaaacaaccccggccctagtgcttgaaaatctctttgacccgttaaaatgcatagtccaatactccatcttctcctcgggcgtgtcctcttggcactcggtccactcggcgacgaagtcggctaaagcttgggacttgatcgaagttcgtggcttgaacgatatgtccaaggacatcagctctaaggcccattttgcgatccacccgtttgcttcacgattatggagtatattgccgagtggaaacgatgtaaccaccgtgaccgagtgaccttggaagtagtgagataatttcctgacggtaattagaacaccatataacagcttctgaacttggggatatctcatcttggagtcggccaaaacctcgctaatgaagtagattggtcgctggactttctgaacgtggccttcttcttcacgctcgacaaccaggaccgtgctcacaacctgagaagtcgccgatacgtacaataatagcggctcttgcgagtgtggtgaggccagaactggtggagtagtgaaaagtttcttgaagtcttcaaaggctttttgtgattcgagtccccactagaaattgtctgttttctttaaaagcttgaagaagggcatcccccactcgccgagtagcgaaacgaaccggctgagcgccgccatgcatccagtcagcttttgaacatctttctgggaactcggcggtttcatgttgaggatggcgttgactttctccgggttggcctgtatgcttctatgagacaccataaatccaagcagcttccctgacggtactccgaaggtgcatttttcagggtttagtttcatcctgaaagcgcggatgctcgcaaaggtttcttccaggtccgtgatcaaatcatccttttgcttggtcttgatgactacatcatccacataggcttcaacgttgcgaccgatttgagttgagaaacatctctgtatcatgcgttgataatttgctcccgcgtcctttaatccgaaaggcatggtgatgtagcagtaggccccaaagggcgtgatgaacaaagtcttcaagcagtcggattccttcaatcggatctgatatcccgagtagcaatccaaaaaactgagcagctcgcagcaggcggtcgagtcgactacctggtcaatgcgaggcaacccgaaaggatcattggggcaagacttgttgatgtcggtgtaatcgacacacatgcgccattgccggtcttcttccgaactaggactgggttagccagccagtcgggatgaaggacttctttgatgaagcccgtgtcgcgtcccaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaatttttagtggaattttcagagcacaaataataattaagaagaaataaacaaagttaaaaaggttttataaaaagaaaaaccctaaaaagtttcttttccctccccctctccctcttgggccggctcggcccacctccctccctctctctcctctcccccgtggcccaatcggccccctccccgcgcgcgcgtgccgctgacgggcaggcccgcccgccaccctcgctgacgggtggggcccacccgtcatcccctacctcccgccgctcccgccgcctcgcccgtgccctagcgccgccgccgccgcgaatcccgccgcctcccgccgtccccgcgcgcaataaagagggggaaattattccccgtgattccctccctctttccccccacttttccctctctctctccctcggattcgttcggaaagtttccccctaacttcgccggcgcatcaatggcggccggatcttccgcggccgattccccctcatccggccgctctctccccctcccaacactatataaacgctccccgtgcctcccttcaccgtttccgccactcgccgctctctctccctgtcggaatcgagctcgcgccgtcgttctctctctccgccgtcgccgccgagctccggtccgccgccgtcgtcgccccggaccctctcccgtttcggcgtcgccttcttcgggttcgccgcaacctcgccgacctcgtccacccctccgtttcgcccgccgaccgccggaacgccgccgtcctcgtcgacccgagccgcgccgccgccttcctccgctccggtcgccgttcccgtcgtcgccgtcgacccggggtgagccgtggaccgccgtttcacttcccccttccctcccctctctcgggcgccgctccgccgcgccggtggtcgccggcagcgaccatcggggcgcgggtgcgccgcctcccgtcggctgtgccggcgtggccgccttcgggcgcgccccgcggctgccatgtggggcccggccgtcagccgcccgcgccctcgggtgcggctgacacgtgggaaccacggcgccggccggcgtaagccgcgtgcacccggtccaccgtggaccgtgaggctgccgcgtgggccccactcccgtggaccctgtccgtgcgcccctcccctcggctgacgcaataaatccgattttaaattaaaatttaaatgaagaaattcgcaaatatccatttaaagagcatataaacttcaaatggccataacatggccattcgaactcggaattggaccgttcaagtctctaatttctccttaagaagtcaagaacccatttttgtgctttgtttctgcttgttatatggagtttagtagagtaaaagccgtttcttttccattggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattattattgttattgttattatttccttgttcaccctagaataaacaaaaccccaactagtggacactctactcatgctatcactagtatgattttaggtagatgcttcgcttttaattaggtaacattaggcggttttacaactctagactttgggaatattcatatcacctggacactatggaatggtttggttattgtggaattggcttcacaccgctccttctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttctggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgcatagtactagaatcgtgtttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgttgtttctcgtttgtctttgtgtgtgctgggccttcgcttcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatagagcccccttgaccctaggacgagccgtagatcccaagccttagcagtattttcgaaataaaaatcctctgttatttgtgaaaaccctttagtctttctctgtcttgctgcttcatttatcgccaaaatctgatttttttttaaatgttgcttttctttttgtttttgtttgtagatggccggcagcgtcacccgtcgtggtttggacatgactggtttcgtcttggagctgcggggcatgtgcgttgtcctggggtatccacatggagtggactaccagggcaggccgcttccggagcaggagggtgacgatgcagagccccacgctgcttgggaggtcactgcagtgatcctcgttggctctcccgagcggacttcgctggcagtcaccgcgggtggagattctttccccgccgcttgccagagcgccgctctcctcgccatcggcactcttcaccagcgctacccggacgagttgcagcactcgccctaccgctaccaccctcgccgcggtggagcccgcgactacgccaccttccgggatgctagctcggaggatgatgctaccatcgtgcacctggcgcgcatggtggaggcatacgacgcggctcgtatcgacttccatcagatggtgcgccgtgggatggtcgagaacaacatgaagatcctggagctgcgtcaagagaacctgcagctcaagaaggacctagacgcggtggaggcgcagctgcatcagctcaagatcgcccagggagaggtctgccgccccaagcgtcgccgcgtctgccgcagcccgaagatcaccgcccgcaagagcacctccaggccctagctcgttcgtcagtccctggcgtggacttgcttcgtcgagacccctcgtgccgagcccgcgcccgtggttccccaggagggggaagcctccagcgttggtagcacggaggatgcgctgttgctcaccttccgtcctggcccgtcgcagcggtagacgagcagttagtaggcttgcgcgtgtgttctttctcgtttgtcttcttgttggagttgtgtggggcatggttataccggtgtgtggcataactgtgtcggagc

SEQ ID NO: 53914 - DNA, 6252 bp, Oryza sativa
  unsure (1)..(6252): unsure at all n locations
nnnnnnnnnnnnnnnnnnnnnnnnnnnnnnnnnnnnnnnnnnnnnnnnnnnnnnnnnnnnnnnttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgttgtttctcgtttgtctttgtgtgtgctgggccttcgcttcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacagcccgctgctaacagcttggtcaattcctccttgatcgcgtccttcctgtcttgtgcaaagcggtggagtcgttgtttgatgggtttagcgtcttccttaacatgcaaagagtgctcaatcacctctctaggaataccaggcatatcggatggtttccacgcaaatatatctttattattttgaagaaaggcggtgagcgcgctttcctatttacaatctaacttggcgcctattacagcagttttagtaggatcagaaggatctaggggaattttcttggtcttggcttcactttctccactctttgagatcttggtcgtaggcacttctccttcgcttgccgtggttgcagccagtcggatgtcttctcgggcgatcgcgatctcgcgggtttaggccatctcgcagctttccttgtcgcatgtgacggcttgtttgatgtcgctccgcagggatatgactcctcgagggctaggcatcttcatcatcatgtaggtgtagtgtgggacggccataaacatgactaacgccgggcgtccgagtatggcgtgatacgctgtctcgaaatcagcaacttcgaagtagacgttctctgtgcggaagttctcccgagcaccaaaggtgatcggaagagtgatctggccgagtggtgttgcagatagccctgggatgactccatggaagggcgcattactcggcttcaactcggtgcgagggatctgcatgtcgtccagggtcttggcgaagaggatattgagtgcgctgccgccatcgatgagcgatctgcgaagcttgacgttgcgaaccactgggtctagtaccagggggtaccgccctgggtggaccactcggtctgggagatccgagcggtcaaacttgattgttgtctccgaccatcgaagatattagggcgtatcgggttgaacagcgttgatctcccgttcagtcagcttttgctttcttttagactcgtaagccagagggccaccaaagatgtggttgagttccttgcgatgatcttgaaaacctgtcggggcatcatcatcatcattcttctttttcgacgtgctttgttctccatcagacgtcttccgtgcattcttggcatattgctctgcaaactgcttgtagacgaagcaatctttggcggcatgattggagttgggatgatgcggacattgggaattcatgatcttgtcaaaagtgttgacgcgcgaacgttgtcgggaggagtgtgtggtagtcgcaacaagttcctcgggcttacgcttgtggtccttgtgattgttacttccaccccctcccgtagtcggcgcatctttctttggcttccaagtaggacccgactgcttggatgcgataatggcgtcttcggctttggcatacctgttggctttttcaaacatctgtttgactgtcttgggaggcttgcgcccgaacttgccgactagatcttcgtggcaaatccccttggtgaaagcggcgatgatgacgtcgtcggtaatgtcggagatcttattacgttgttcagagaagcgtcggatgtaatctcgaagggattctccagacttctgactgaggttgtagagatcaaactgtgtgccggggcgttcaaaggtgccctggaagttggcgataaagtggtcgcgaagttccgcccatgatccgatcgtgccacggggtaacccaggaagccaggaccgggcagaatccgctagggccacaggtaagtagtttgccatggccttactgtctcctcctgctgcgcgaattgcgagaccgtagacggtaagccaagactccggattagtggtgccatcatccttctcgattccagtcggcttgaagctggctggccaatccactcgacgcaggtcgttagtaaaggcagctattccatccacgtcgtcgtcgtagcgatctggtgaatggcggtgggcatggcctcgtgctgcacggcgctggttcatcgtatcgcgaagatcgatgggacgacgacgaggtggggagcgaggccattcaactcggcgctccctgtgtcgctcaggaggcgagtgaacagatcgctcgtcgtggcccctgctcctgtgattggatcctgcgccggcgatgctgagggttggctggtgataatcttgagatcggagatggggaacctggctgccagtcggcgtgcggacacttccggagttaaccgggactgaagcggcaatcatggtcttggtctggttcaagatgttgacgacgtgatcagcttgattgagtgcgtcttccttaaggagggtgtcgaggagggtgatcgccgcgacagcgttctgttgaggggtgcggaagaccgctgtcccctcaacgtcttgctgcccgatgagatctcgcgctcatcgccctgcgtccaaggctcgttgtcgtcggtcctcggcctccattgcagcccgttcgcgttcttgttgctcacgctgcagccgttcttgctcttgtgcttggcgctcctcttccagtcggcgttgctcggcctcctgctgtacgcgttgtgcttctgtttctcgggcttggtgttgttcttccgtctcgttgtcggccatgaagacaccgaagtagaaaggggtgtaattatcttcaaagctttcgtcgaagttgtcgaggtcgcgattgtcgtaggggtagccaaattcgtcgtactccacgacctctgttggtcgtgagtcgacgccaggagagctgaagtagccttccagttgatccgtcgaaaccgtgccgagtggctggagtatgacgtcgacttccctggagctaggcaggatcggtgttgaagctgaattctgcctagtccttcaggaaggagatgcccttgtagtgaggacggcagccaaattgtcggggagtttcatcaggattgacgggtaggccccatcatctcgatctggtggtgttggagtagatgggatctcgtccgagtggttggaagccgactcgatcttggccgagtttggaataccgaacggggctgagacctggtctctccctgactggtttaaatccaagtcaaggagagagatcttgccgaagtcgttggtgatgaagtcaaggctgccgaaccggaacgcctgcccaggagggaagacgaagtcgtcgatgccggagaccgaacccattgcactgattggcgaaaaacttgacgcaacccctacctggcgcgccaactgtcaaaacaagatttcggcaatactaaaagggggtggctattgtggggacaccatatttaggcttggtgccccgaaaatccactcgtgatcgtccaggatttcgatcacacacagattgatatactgaacaactttcgattgtttacacaaatttgtttatatagactaattatacaactgttaaagggtgaaaaaatacaaactaatacatccttatttgaaatacaagaaaattcaaagtgctaaactattaaactcctaaactcttcaactactaaaactacagctaataaagtccaaagaattcaaagaactccacaggcaaaagctcgagtgtagactagcctagacaaacttgtcgttgccgtagaatctcgcttccttctgatctccttgttagcacgtttccgctatatgtcaaattatgcaagggtgagtacttatgtactcggcaaaacatattataaataattaaaggtgaatagatatgaataaataaacaataataaagtaaaggagtaatgaaaaccataaatcatctttatcctcaacattttaattttaaaactacttatacttcaggaataggaatcaccctgatgacacaactccagaaccgagagtacggcacattcgaatgatttaattcacctctgctgagactgtccagttttacccacatgatgcccactgctagctgggctgagaacaatagagccgttcgaaggtcccacttactactagttactgcacgagtgggatattgatccgtcctagtagccgggcacttgttgggcctaagcaaggctacttggtcgctgctttcacgggttccaccgttatgaaccatgcccccaacctccttacgcatgcgttcaccccaatcctgctcctagtgagccaaccaacagtctttcatatagtgggacaatgtactaggctaagttcaattacttgatcgtgtggatggacgcaactatgtcatttccatggtataagggggtaattataatccggttaaaccacccaaaactttccaaactccccacaccatcttcataattcaacaacattcataaacacaatattcacaatctcaattcataaatacccattttaaccagattcctaagtttgtaaagaggtttgaataataaaccacataaaatgatctcgaatgtatctttcaataatatcatgcttaaaagcatttaacatctatccacgagatgttaaaagagcaaaaatcatgcatcaaatttaaatatgaagattatatcaaggtttctatatgatcaaaattttaattatgtcttaccttgcgcctcaagatttcccgtggcttcaacgtagccatctgggtccatgtcagttccttggattcgatagtcgaacttgctgtatggtctaacttacggatacgaaaagatagcaaataaagtctataagcaaattgctacaagaaacgataaagccaaggaataaataaaattggagcgaggcgagaggaaaaaggaatgggttcaaaataagttttaatttgaaaataaaagagaggtgatggtttctataggttggaaattgaataaaaacgaagaaaggataattttggataggtgggatttatttggtggatttggttttctagccggtgctagaatggagtagcacgacggttagatatttgaagtggttagccgatgctaaggttggtagcataacggctaaatatcggctcgtctaatcgatgctacaattaagcagcacagtgactagagagttgagaaaatttgtgcggagcggaacagtgttactctgcagccgtgagtgacgacagagcggctagggtcgcatatagctcaaggactagtgtgcggcgtgctgtggaggtcgagggagtagtgagcctacaacaactatacgtgttgaggcgtggggtgcgaggagcgacacttcgaccttaggattaggttatgccgggttttgcgaccaacgatttgacgacggggtttgagaccacacgaacgtctccatggaaggcgtaaagttccaacagcggttatttggtggctaagggatggttttaaaaataaaaagaattatcaagaaatttgaaataaataaataaataaataagtttaaaatagattaaagaaataaaatttaaaatggtattttaaaataaagaaaagggcatttaaagaaattaaaggataattaaattttaaaaaagtttttaaacgataaatttaaaattaaagggatataaagtaaatcaaataaatttaaaataatttttaaaggttaattaaaataatttaaaattagaaagtaaataaataaataaggaaaggttttttttaaataaagaattttaaataaaattttaaaaataagaaatttgatatcaaaacgaagagtttgaaattatatgaatttaggttaaagtcttactgggattggatttgtggttggaaagatatgggtgtctaaagattgaaattgaattaaaatcaaataaaagaaaaaggttactgtgcagggggcccacttg

SEQ ID NO: 53915 - DNA, 5592 bp, Oryza sativa
tattttaaaataaagaaaagggcatttaaagaaattaaaggataattaaattttaaaaaagtttttaaacgataaatttaaaattaaagggatataaagtaaatcaaataaatttaaaataatttttaaaggttaattaaaataatttaaaattagaaagtaaataaataaataaggaaaggttttttttaaataaagaattttaaataaaattttaaaaataagaaatttgatatcaaaacgaagagtttgaaattatatgaatttaggttaaagtcttactgggattggatttgtggttggaaagatatgggtgtctaaagattgaaattgaattaaaatcaaataaaagaaaaaggttactgtgcagggggcccacttgtcatatgtctcttcttcttcctcccgttcttcttcttctcttctccttccagccgggcacagaggagagggagggagtagggcgccggtgctccggtggttgaacggcctcgacggcggcgtctaagcgtgttccggagcatcacgcacccggggagggtggaggaaggcagagggagagaggaggatgaccggaacggcggcaacaagagcacagctccggcaacaaaagaaggtggctgtggtggttggtttcggatggggaaagagaggagaaactggaaaaatgagttcacctcggcgaggcaagcccgatggcgcaagggaattggaagagaggctacgggggaggagatcggccagtgggtagtggtggccggtcatgaggagagaaagggagaccaagctctaggagctcggtttatggggaggaatagggaacctcgttgtcctttttataggcagcgagaggcggtggagaacttcgcttgcaaaggcggtcggcgacttggccacaacgacggtggcgggcaggaggaagaaacgacgccggcctcgttcggtgattggctggccacgtcggtttgctttgcaggatgacgtcaacggcgtgaggtggcggcggcggattggctgggcaaggcggcggcggcggattggctgggcgacggcgtgttgggaatggcgaagcggcggcggcgccgtggtgttgcaagcgacggcggcggtggcgcccacagagagagagaaggaaaagtcggctcggctgtgggccggctcggctgggcttcggctcagttgggtcggcagcccaagaaggagggaggaaaagaaaaagggaatgggccaaaagaaagggaaattggcccaaaataaataggaagttttgataattttgtatagaggatttggaatggaatttaaaggagttgaaaacaaaaggatggatggatgtggactttttgaatcttggtcaaggaattgaatccaaggaattttgaatggagggttttaaataaattttaatggagataaaatttaaaagagaaacgctggagggtcttttgaactttataagaagaatataaagttttttaaagcaaaaaggagtttaaaatatttttataataaaatcaaatatatttattttgagatataaattttgaaaaggataaaaataaagatgctccaattttaaaagaattcaaataaggaccaaatgtaaaacttgtcacgaaagatttaaaaatcaaacgggaaaggtaataatttaacttctaactttggataaatttgggatggtggcaaaaatagatgaaggtaaataactaagattttagcctccaaaatatgtggtatggattctcggtgaattatttgtggctaaaagaagttaaattttgaatagaagggattggaaataagtttcttagcacaagagcaatcattccaatatttgtgataatattattcttgtgtcaagaatgtgatcaagtcataggaatcaaattggtggattgatcaaaataggaacttgaccacataatattttggatcgattaaaaggagacaaaggttttcacggataggtttagattggggttgatccaaaataaattccaacggaaagggagttatactggtttagccccaaagacaaaaatggttaatgggatataacagagagtcaggtcaatcggggatatattggcccaagctaaacaatagactttgaaatcttgagtggataatttggaggaacgggatttcaaaggggaaatattggtgggagtatagatatgggctcggaagtatatgtggatgggaatttctacaggaacagaattggtggtagattgataaactttaaattaaggatgggtacgttgactcaaagggggattgaaaaggatattttatggactcgggggatatttaggtggagatccaaacgaaaggtatcaacaattcatgtactctagagatatttgggaatggattcaaaggaaatataatttagagccaaagttaaagattaaagaaaataaataacaaagttttgtaaaatttaaaagaaagcgattaactttgcaaataaagttttaaatccaagttaaaagaaattaagagaaggcaagatcacttcaacagaagaatcgggaagagcatgacttaagacatttcgcaaaaaaaaaattccatgaaattttgagtctgttacagatccacccccttaaagagaatcccgtccccgagattccgctgaaaggagtttagttctgtaaacttgttgctacgactttgactgttttgtccatcatattccaaattttctttctcacattccattcaggcacttctttattctttctcacaatccgttcaggcacttcttaacatgtcaagtcatttccttagaattgcttgatccgctgactttttcttttacttttccctggaccttgatatattctttgaaaatgtcttccaaccataatctattattgtacatactcctctatggtagtctttttgcgaatattctctcaaatattactatcttcgtttatatgcacatcaaataatagggttcttgggatatcccatttgatagttatttcaacaatatcatgtaatgttgaaggctcaagacatgatagttgaaaaaatgagggatgcgtgttggcaaaacgagggttttttccaattttatttcatacatttctatggggcatcgatatttcagagattttggatcaaaatatttagaattaaacaaattttgaatgaatttgaataactttttatcaatataaacaaattaaaaaaaccagtaaatttcgagcgagataggtgcatgccaaggggtccgaaatttcaatccgtgagcaaaaccaaattattcggcaagtgggtagctaaaaatccaacaaatcatacccacgatttttgacattactataacatccctccctccaggaccgtgtagccagcccatccaacgggagggcctacttacacataccactccatctacacttctgttctcgcttcttgtaaaagggttaacctgggagtgcatggttggatggacaagtccctataatttggttccacccttactaaactagccaggtgaaactaaacatgcgcacacagctcatatgagccacacaggccaaatcctaattgggccaggatgtcacaattacgtccaatttcaaaaacttattttataaataaaaaactaattacataaatggacttttagctcatcgtcatgctcaatggctctaagccataatttcattggcgctgccttctcagattttgaggtgaccaattttaccatgtcatatgagatttagcacaaacatttgtgcatactctacttgatagcatggtgacgaggggattctactctcaccatgagtttctaggttcaaatcaacaatcttgcatacacttaacaattttgacttttcccatgtaaacatagaccattgcctagacgaacagcttattcgactagagataggtgatgggccggatccgtatattatgtaaaagattaggctttgcaagttgtgttgtcttgtactccaaggcatattccataagttttagtcatacacacttatctaaatgtataaggaatgtttacacccaaatttggcacctatggacgaaataggggaatattgccaaagtttggaaagtgacgggtttccttcacaagaccggtcagaccgcaggtatgtgggcggtctgaccgcggcctgaactccggtctgaccgcaggtatgtggctagtcagaccgtcagggtccgagcccgagtctgttttcgtcgggtcttgggtttccttatttgggaaggcatgtttcgggtttttctttagtttctatcccgagttggacatggaggagggcctgtagagggtaagaccaacccctattcaagggacaatgccggttcaattgtaacccccgaacacacaatctacttgtatcgtttttttcttttatctttacttttagccatgttttttactttaccctagttttagtccatctttgttgatttgcgcaatgaatcgtccgccgccgctgcgagagtgcaacacctctttgtaggtttgtcccgaaaaccttccatttgcccacgagacgggtcgttatcctcatatagatctaaatcggcctaaaggctgattttgatctctaaatcagctccgctagcctgtttagctttttttctacaaaaaaccatcttgacttggccttttggctaggtcgaggtggttggcgactccatatcaccgcaaggcgtttaggtgatgcgatcgtgtttgtcgacttgtcacaaaaagttgccagcaaggaaatttatactgtatttggttgggtttttctccttgtaacccgacctccgaacctatataaggagggcagggagcctctcaatggaataagcacaacttgattgtcaaatcaatacaacacccagtggatacaatccccaaaacagaagtagggtattacttctcattgaaaaggcctaaacatgtctatatcttgtccctttactcatccactttagatctcatgttctacccccttttctcattgtcgatttctagaatcaacggttggcgcgccagataggggttgcgttgagttttccactgacaagtgcaatgggatcaacttcaggagccgacgacttcgtattccccctaggacaagccaacaggttcggtgacctcgacttcatctccgactacttcagtaagatcgctctcctcgagtcagattcgaaccaattagggagaaactgcaccacttcagcaatatatcctcagatcaccatgctacttccgtcgcccctcgctgtgacgttcggatctagaccagtctccctccccctaggtcctgacctatgcacaatttcaacgagtccaagatcggatctcgggaggtgagcgttatgattcaacaattggatcctataggactacatagattatcaacagcgtcagcttctcggacggctatagcaacttcgacaccgaaagcatcaacaactccgagttcaccaacgactactctccactcttctttgaagttttcatggtcggggcccctgaagacgagcaggcccgtattgcgagggagcaggaggagcaacgtgcaaaagccgagaagaatg

SEQ ID NO: 53916 - DNA, 1968 bp, Oryza sativa
  unsure (1)..(1968): unsure at all n locations
nnnnnnnnnnnnnnnnnnnnnnnnnnnnnnnnnnnnnnnnnnnnnnnnnnnnnnttctgtgtggggttttcagatggtgacgaccaggagaagtgctaacaccggtgatggcaaccaacccgaaggcagcaaccacaacaaccatggcagcccacctccacctcctcctccgctccaccaccaccaccagacaccaacgccattctcacccaaatcctcgcccagcaggccaacatgatgactgctttcctccaccacctccaaaatccgccacaacagaatgctccaccaccacccccacaacactctaaactcgccgagttcctccgcatccgtccacctaccttctctagctccaacaaccccgtggatgtgttggattggttgcatgccgtggggaaaaagctagacaccgtgcagtgcagcgatgaggagaaagtcatcttcgccgcccaccaactgcaggggcccgcatttctatggtgggaccatttccaggctacgcagccagaggggcaacctattacttgggcccgtttcaccgccgctttccagagaacccatgtgcccgccggagtcgtggcccttaagaaaagagaattccgagagttgaagcaaggcaactgctccgtgatggagtatttgcatgagttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccagccgtgcagcctggtcaaggccgcagggacgctcaaggtcagcagcgtctgtgcttcaactgcttcgagcccgggcactttgcggataaatgcccaaagccgaggcgtcagcaaggccaagcgcctccccgctccaacaacggtgggaaggatgtcattcggggtcgtgtgaaccatgtgacggccgaggacgtgctgacaactccagacgtcatcgtcggtacgttcctcattcattccatccctgctaccattttgttcaactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgtgcaagacgcactgtcactctgtaccgagggccggaacaaccggttgttttctttgcacccccaacctctgtcagtagttcagaacttcatcagataggactgtcagaaatccccatcgtcagagagttcggagacgtgtttccggaagaactactcggtatgccgcccaagcgagagattgagttccggatagatcttgctccaggaaccactcctcggtacaagcgaccctaccgtatggcagcaaatgaactggctcaaaactgggattctacttgccactggctagctttgatcaggtcatcaaggtatatataagtcacacccagaaattctcgaaccagaatttnnnnnnnnnnnnnnnnnnnnnnnnnnnnnnnnnnnnnnnnnnnnnnnnnnnnnnnn

SEQ ID NO: 53917 - DNA, 1099 bp, Oryza sativa
aggggcttctactttccatagcagtagccagtgaccgctacttcttcctcaccccactgtacccacaagcgttccacgctcttctgggagaggctagtatgctagctaccgagtcagcaccttacctactgaacctgacagcgacccatccacctgtcccggagatggtgcgcactccactgatccctacaccttctccgcagataggttccagtttggagactccgatccaggtcgactccgagacagaggggaccgacaccgagccagagatcgagccagacatcactgatccttcagaggatgagacccctgttccccgcatcaccttccttggaggtcctcgcaccctcagcactgctcgcaagagcacacgacctccgggcaagaggcccaagccagatccagaggccactacttctgagccgtggggactcaggtttgcgtgtgccaacgaccaccctctacctgccccaggatcctgcggatggctggaggactagactgacagactccttgcagcttcgatctcgtatcagatggtttttggatagcatgcgagacacaccccccctcttacctagattgacgagtagattgatgattagtttgatgtatcttttggatgaaccttattcgactgcgtatgtacgcagtcgattgcatcatgatttatgtaccatttgtgaaactctgtgatgttatttatgatatctattgttgttgtgttataaatgagtttattccaccatgcttgcaaaacaaagttcacatcaaaacaatctcccctaatgggataaagccgtaaaagatagccagagaattaggatacttactcaatcaatcaacctgcacagatggcaagccgacgtcgggcaacaaccagcaatgacgaaactcagacacccgacttaaccactctggccagagttatggccacccaaactcaacttctgcaagccatcgcaaacaaccaaggcaaccgcggcggatcgagctttggagaatttatgaggaccaagccacccacattcgccacagcggaagaacctatggatgctgaagattggttaagggtcattgagaagaagctaactct

SEQ ID NO: 53918 - DNA, 1199 bp, Oryza sativa
tcgacatggccgatccattaaaaaaggcggcacgacgggacacccaactgtaaagcggccttggcacacaacgcaataaagtgaggccacacactcattaacaaccacaggctatacagtttatgacttctgcatgaacattgtgcagaaatgtgaacggcccacactgatacacacgaaacaggtatcacaattcactggcggagtttttaaagacttttgtgaggacttcggaattaagatttgctacgcctcagtggcacaccccatgagcaatggacaggtggagcgagctaatggcatgatacttcaagggattaaagcgcgtgtctttgaccggctaaaaccctatgccggcaaatgggtgcaacaactgccatcggtactttggtctttgcgaactacacccagtcgggccacaggccagtcaccttttttccttgtctatggggcagaagcaatgttgccgagtgaagtcgaatttgagtctttgcgctttcgtaattttcgtgaagaacgctacgaggaagaccgagtagatgacttgcaccaattggaagaagcccgcgaagcagctttgattcggtcggctcgatatttacaagggttgcggcgctatcataatcgcaatgttcggtctcgtgcctttttagtcggtgacctggttttgaggaaaattcaaactacacgagatcggcacaagttatctcctctatgggaagggacatttattatctttgaagtcacccggccaggttcttatcgactcaagcgcgaagacggtactcttgtcgacaactcttggaacattgaacatcttcgtcgtttctacgcttaagtttatcattgcacttccctatcttgactgtcaacatcaagttttcttcttgccgttgtcagtcgggggctatcatcataataatggagtgtgattttttatcaatttaatttgcttacttggtctatcattaccttgtttgattttttctacttagtctgcgaggactgaaagtttttaatagcttctttgggttttaggctcaacaaagcttgataaaagcttttaagaaatcaaagacttggttagaactatcaagcacagcataaatacaccagcattgtacaaattaagcctccatttgctacatttacactcagtcagaatcagtcttttcatcatcagagttattattgctcgg

SEQ ID NO: 53919 - DNA, 1702 bp, Oryza sativa
  unsure (1)..(1702): unsure at all n locations
cgtcaagtgcactcggaccactgtcattaaggaacatagcttggacaagtggtgtagcgacattggcgacttcgtctcttgctccttcaagcttcttgatcttaccaaccaggacatcaaactgagcttgagatttgattttacggtctacaaaacacatttataataagaatttgctgcattaaagagaggaaagttcaaattgtcagctggcagtaccttcaacctccttcaaggctgagtccctttgcacagctagttctactttgtctcttttcaaggcttcaatctgtttctccatttgtgccatcctggtagcttgtgctgtttgaaatccaaatatttgaggatacagttatgacagcataaatcaatggaatagatctggaaggttaccttttgatgaaccacttagctcgaagtttgaatcctggagctgggcaattcggtcccttaactccttctctgtctttttagcatactccttggcctcatgcagctggtccctaactgcttcaagagctcccaaatgaggaaccagcttttccaaagttgtagtcttggcctcattgcgaagatggattctctgcatgatggatcatgattcagttctgctaaaagagagaacaaagttattaaaggcagtcacccggaagatttacattcacaatgcgagtggcttctccaagtactttcttcagctggcatacttcctcattttctttttgacgatttataacgatgccggcaacttgcgagttctcgtcccaccatttgagcaagataggaggacgggagtcattagccgcctttatgcgaggaattgcttcttcgtcatcgcctagtgttcctgatgtatttccaagacattggacgagtaagctgaagttatttaaatcggcatcacttgagaagatgtgttacctgaggatgttcctggctgaacatgaggtggtccttgttctgtatttagagacccaatcattgagtctttaccagcctctggtccttgggaagttgtcgtttgcgcttcaacttcagggatttcttcatcgggacctacatccgactggtttccagtcgggggctcttgtgttgttgcagtttcagctgttcccgactggtctccagttggcggctggtcactcggatcggctctatcatccgaagcatgggcgccagtcggctggctttcggcagtcggccggctttcggcagtcggttggttttcggcagacggctcagcgtctttggataaatttggctctgtcacagccggatcaggatcttttccagttggatctatgtcggacggtttcctgcaaagtgtcctttcgatattcagtataatttctatgagagaagcatatcaaagggagacggtaccgagaagtttatacctggaagatgttctaatctttggcatttgacggccagccagttttttcctgggcatggtatgctttgggagtttgttgggcgtgcccttgtccccagatttgttgctgtcatcgccctcgtcgtcattaagcaccagctttctcttacgaggacctgtctgaccagctggtttggaggtttgaggttgtgggtctgacctgtttgtcggccctccgcttccctgaatggtgtgctggcgaggagatnnnnnnnnnnnnnnnnnnnnnnnnnnnnnnnnnnnnnnnnnnnnnnnnnnnnnnnn

SEQ ID NO: 53920 - DNA, 1806 bp, Oryza sativa
tgactgcaaaggtctcgggggctactggggagattatggatatcccatatctatacggcgatgatatttggattgaatataggataccgagtatagatagaatatcttatgtgtatcctgggtttgtttcctaacttgtatatcaaggaaacaccttgagacttagtcggtcacgactgtattcagttagggacatagattatcttttgtaatccggactccttcctatatataaggggggtccgggtgcctttaggggcagatgttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacaatactcatgtatggttatagtgtaggaaacggacaacagttaacaaaccaatcgtaattagattcatacatggaattagcatccatgttggtattagtttatacgcttctgaattatacacgattcatatagtaataaatagatcgatactcttagcaatgaaagcaaaacacaaagcacaaatatccagccatacatcttttagccacaatcagctttgccaccaaattagcaagacagaagttttgccgccagaatccacttcattaacaaattggcacccgagaatgtcggaatcttatagcaaaggatcgtctaacaaataaatttgtgtgtagcaaattaacatattagattggtaataaaaggaacctccatgttcgttcaaattatctaggaaaacaaacattaattaaaaaaaataaaagatagaaatatgtctattgatttattaaagtaataagaaaaaaaggctccacaatcactctcacgacctacaaattctcatattaatcaattcgaaattaaaaattaagacatattaaaagaaaagtctagagtctatattgaactaattaaaattccgaataaaaattaaaaataaggaatattggaagaagagtctagagtctatatatgaatttagagctaattgaaagacgaatttgaaaaataagaaaaattaaaagtaacgtttagagtccatataaaaatatatttagaaatagctgaaattcataaaaaaattaaaaaaagaagattgaaaaagagtctagggtccaaatagggatataatttagaaataactataatttgaaataaaaaaataaaatattggacgaagaatcttgagtccatataggaatacaatttataaataacataaactcataattaaaaataagaaatattggaagaacaatctattgttcatataggaatacaatttaaaaataacagaaatatgaaattaacaaataagaaatattaaaaaaggagtataaattatatataaatacaatttagaaataattaaaataaaaaataattactttcatgcacatgcattacagtatgaatattgcgtattggttagttttatcaagttagtacataatttaaaattatgtttttatttcaatctatttcaataataaaatgtaaaaatatatatgatattgtatgggaaaaaattataacgatgatagccgcacaatctgcgtgggccaccatgctagtttttataatacaaacatcatttcagcatttatttaaataaaaatcctcctttttatctagactatttttagttcattttcttctttcgctgttcaatgctgcctgaagcccctccgtgaa

SEQ ID NO: 53921 - DNA, 13922 bp, Oryza sativa
  unsure (1)..(13922): unsure at all n locations
nnnnnnnnnnnnnnnnnnnnnnnnnnnnnnnnnnnnnnnnnnnnncttttgcagcgatatatttgaaaagagaattaatgttcatctagtaacaatttataaattaatgtccatctagtaacaatagattaggttgagcgtttcctctgtttcaaaatataataagctattactgaattagatactagactggtacatttagaaggcataaagtgagaatttatatacaaaaatttgtgaacttctttttgttatgtctttcctttgctgttccgggttcaaggtagataggaaattaggtataggtgacagcagctagccgctggccaaaaccattaattcttgcctgccctagggtttagaaccaggacgtgctgggtccagggtttctcaaactgtcgggaccggggttaccgtgtccggcaataagtacggttaccgcgtagtaaccgtaagaaatcatacaaaatcatgtaaaacttatcaaaattttaaattatttttaaaatttatttgaatttaagaagattaccgtggttttcttttcaccgtacccccacggtaagcacggttacctgcggttttgtaaaccccgtgggcctagctatatgatctcccattctccccttttttttcaagtcgcaagcttgagcgacctgtccagccaatgtcaccgaagacaagacaagagcttgcagttgcgaattgtgaggcactaataggttcataagcaacgtccaatggaaaaacatgagaccattattgatgtgcgcctgcctttctccaagtgatcgatggatcaattggaaaggagaaggccgtttttgaccctaacccatatgagatccatggttcctgcaactctgcacgagattgttttcctgttccctacacatatgcatcgacactaactggctacagtttttctgatccatagccttttcttttcagactagcctatttaggagagttcgctataaacttaatctgaaaaaactaggtttttcaggtccatagtttattttattttggattatattgctatagataatcataatatggatgagaatatacattatctacgagagatggagattttgagagtagttacagctcctataagattctcaaacactggctaaaagaaattggggaggagaccagcactaatttttctgctacgtataagagtcaatccaatatatcttctttaagaatcatgttaatgggggagacaaatattgtagtttctgctatgcaaaaaagacaatatccaatatctttatttcagcgtcatgttcttagatttttttttgagatgcatgtttttttcttttaatatctctccatcccataatgccaaatatttttgttaattggcttaaaggtgtaactagtctataaaaaagattattctaattggagtgttttatgttagtcaatttgtgttgccttaatgataaagttcttttttatcttcatgtctttctgttagctttattttttatgtactatgctagtacaggggaacaagaaacactctgaaaataagtagtcaaaggtctcttatttcactgtaaatagcgtagttccattagaattactagctaaaaaaaatatatggtttagcactaccatgtactaataaaagagacttaaggatttgtcccatcaccgtatgtcttatttttctttttcttttattcttcttttaacaaacttgtggttgcgtgtcttataacagaaattgaagatgtaaactattttcattattaaaaaaaatatgttcacaaaaagggccttagccataaattgagctagcctacagtaaataaatcatattatctctattttataatatatgatgccattgatttttacatcaagtttgaccgttcgtcttattaaaaaatttaagtaaatatcttttattttgttgtggcttgatttatcactaaagaaacttttaagatttgcataaaatttttaaataaaatgaataataatgttgtaaaaaaataaaataacgtcatgtattaaaaatgaagggagtttatgttctcattcctcgtcagctccaatcaccaactttttttctctcttcctctcatcagctaatttatgtcactggtcactggagatgaccacaaagcaacacgctatacatctcgatcggtctgaaagagatgatgactgcaaaacctatccacgaaaccaattgcttgagagagacgacgacgtctctaactacagaatggtttttttagataatgaactccagaatggttaacgtacggattgaattgacgaataattcgtaataataatttgaggataaaaaataaattaactattctaaagttgaaaaatgggtttaaaacagtatgtatgatttacatacacaaatatatatatatataggtaaattatatagatatatatatagagagagagagaattattgtaaagaaaacttatttttaggagatcgagaaacgtgtgcattcatcaatgtattcatttgttaagcacgaaagaacaggagggaataatttggtgctacacgcatggacagggtgaccaggcggatttccaagacagatcgaaaaacctgacggagggaatggaaaaggagtggctggtctgattggagcattggagggatggggacgcctcggaaaaagggctacgctacattctcaacgaagtgttttcttttcctcagctgaaagagaaaacctttttttcacatcaggtccatacctatacaggtaggatgttaaggtccatgaacagtactagctacagtatagcgaggtagtacaaattgatggttagtttcggtttacctgtttgcaaattgcaatattgttaaagcgagaacggttattcgctcccgttaattccaaatctaaggccgctttcggaagtgagggttgggcctggcacgaaaaacaaagcagcgattagtgcatgattaattaagtatttgctaatttttaaaaaaaatggattaatatgattttttaagcaactttcgtatataaatttttttgcaaaaaacgcaacgttcagctatttgaaatgcgtgcgcgtggaaaacgagggaaggaagttgggaacctttgatatcgaaagcagcttaaggtggtgtttggattcagggatttaactttagtctttatatttagacactaatttagagtattaaatatagactacttacaaaactaattacataaatgaaagctaatatgcgagacaaattttttaagcctaattaatccataattagataatatttactgtagcatcacataggctaatcatagattaattaggctcaatagattcatctcgcgaatcagtccaagattatgcatgggttttattaatagtctacgtttaatatttataattagtgtccaaacatccgatgtaatagggacttaaaaatttttgtcccatctaaacagggtctaagagcaagtttaatagtatggcccgctactagcttcaattcatctatagctaatgtaatagttaattcatacaatagttgcttactatactattaatacctggtcacacatgtcatacacacattgcgtcttggagtccgtgctgcagctggctatatatttgtagcccgtagctcttctctctcatcttttatctcattaaaatatgtttatagctggctaatagtctgctattgtacatgctctaatagagagcacgaatgactttgttgtatggtttactgtcctagcgttaagaaaggtaaccacaaactgtgaaaacccgggtaaagtttataaaaattcagattaatttttattttttgaaaaaaaattgatggagttaagcaaagttaccattgctgtacctcgatggtaagcccaattaccatgtctatgaatggatgctggctatgtacgcatggttctacctacatcactactacatggtgccgtactaatttgggccggtagaaaggaaagatgatttgggcccgtaggaaagaaaagaaggaatgggctgaagagagcggggtatttggcccataatgaatagtggtgtttctcaataaaaataagttcactataggtccctcctgtgtcgctgagtctaaaattcatctctgaaccaaaataccacatatgacgtgtccttcaattcccaaaactagtgcaaataaggtctcaaggcagtttggatagcggtttcggcagatgtggcgcttaaagtcagaatgaaccgtgggacccacatgttaatgagtgtttggttaaaaataacaaaaatgcagtgggacccatgtcatcacctctctctctttttttttctcctctcccttcctcttttctctctttgtcggtgaggggcaggtaatgacgatgaccaggatctggtaggacgctgaggcggtcagcgacctagggtcctccagtgccaggaacgaccggaccggcgatggaaggcggtacctctggtggaggagtagcacagtgcatgacgaacgcgatgccccatccttcctatgaggagaccaagaaaggggacgaggtggaggactccgcgtcgcgcttggctggcgggctcgacacgcatgtcgccgccgttgccaccgccgcagtggcgtgctgcagcttcgccacgccgctgttggtttgacgcgagtttgttggattggctcggctacaactgcgagagaggtggcactggcaacgatgccgcctcgagcgcctcgcggtgggagaacaatggagaggtagaggttgagggagctgttgcgctcgaagacgaagaggatgaagtcggaggtaggaccgaagtttccgttgtagttgaggaagacaccattggtgaggcggagctcagaagcggggttatgagacggtgcgaggggagggagcagataaaggtctggtgcatggctggcgcacgacgcctcaccatcgcttccaggggatcctcactgccaccggctttaggacaaggtggcctccccggacccatccctagccatcgccgagctccgtcaggctatcgcgatgcttgcacacgcgagagagaagagagaaagagagaataaggaaaggagagaagagaggaaagagagaataatgaaactagagaagtggggagagagagttaggggtgccaaaggggcgaggcggggttagtttggacaacgggtgaaaaacctcacccgccctcacccccacaggggacccagcgggtgagcgggcccctgcaccacccggatggccaacaactgcgatgcacctattgtggctgctggaggtggcgtgccgcgacgaggtgacggttgaggacggtgacaaggtgtctacggctgaggacggtggccactaggcggcgccggcctggggcggcgtcagctaggagtagcacgctacaaggaggcgacgctggccgggggcagtggaccatgaggaggcggcggcagttggtggcagcatgctgtgacgaggcggcggcgaagaggcgatgccgtgtcggggcggtgacagctaggaatggcgtgcgaagaggcaggctggttgggacggcgcactaggagggagagacgtgagagtcagagaggagagagtggtggcttggtagggatttgggaaaaattagggttttgccgatatagtccttcacctaatgggtcgtttgggccttagaatgtactatcttttgatttgtaactcatatctttggagcgccgcgggtcaactcccatccccgcccccacccccgcatttttgtggggcctcagccccactcatcacccgtggtgagaatttcccctcacccccagccccatatggctggtccctgccggctccccggccccaacggggaaattgccacccctagatagagtgatgatgtgggttccattgtaatgcttttatttttttaccaaatactcactgacatgtgggtcccatgtttttttttttactctaagcgcgatgtaggcaccacatcagcgaaaaccgtcatctaaactgtgttgggaccttatttgcactagtttggagagttgagggacacgtcatatatggtattacgactcagtcaaactcgacaacagttgagcgacctaaagtgaacttattccttctagattttagatcctatagagcccatccaggatgtgaggcccacgtgtggccatctggccctagcaatataatgtgggctagaggatggaggtgcccaagggggcaagaagctgtgggcttgagccccgggccctatggcacatgatcaatttttggctcaatttacggtcgtctcaccgcaagagatcgctgtgctctttttttttcttttttttttttaaccatagattgctgtactcttttttactccctcccaccctagctggcttttctcatcagcctccattcttccatcggtggcatctcaactcctaaccgagctatatactactatacggcaagtcctaggtaaagtcccctttgaagcggagcagtggcccagctagtaacaaagagtggtgtcataggacaccaatgacatccatattaatctaggtatcctcctaattttccaatgaatggcactagtaaatcttgctttgttacaccagcgtgtgaataattttacactttcgttagacaagttagcttatgtggacatggataacttgacaacacagcaataaattaactactagcaaactataatttatagttatttgaccatgcacaacggctaattcaacgagactatgcataatggctaaataaagttcatgcattataagttttcttgagtgattaggtgaacatatgctgagcaaccactattgtgaggaattttttgtattttccatatgtattattgtttcatttaaaccgtggtcatcaattagagttgacgaatgataccaccgacctaaaatcctggctccgctcctgaagcggaggagttttataggattttctaattatttaaactaaattctgtggaaagcttataaaattcatgcacaagcagcccgaaccttgggtgcaagattactgtcggatcagatgatcagatggttcttgctaagttagtttctaccaatagcctgtatcgataagagaaatgacatcatatcatcttccgctgcattggtagaaaacttacactgaattctatcgacaaggatcaaactctctgagttttagcattttatcaatagtgtatcagtataatcattatgcagtcatataaacttgacacgtactggatactattcactaccaaatttaaccggccgcgcgcttggtctctttttctttggaaaaatattactaatatcttaaaaatattttattattaaagtgtctagcatgctacatataactatactacttgcattcaccaaaacatcgtctattaaaaaaattattagtctaaataaaattacactggtcagcactgaagtacgtgggggagtatatctttgtccttgggattcccctgcagaatgatgcttatatacgctctttaattctcaagatcacaatataaaatgtaatgtataaatttattactatcgtgcaatcaaccatttcttatataaatgggatgttttttttttctcatttttcctcatttttataggctactatggttgactgttttatgttggtgaggcttgtcatcacttgtgtgttttgaaacttcatctatcacatcctggcgcttttcctacaattagtactacaagccgaagactggaagactactgctatacatccgaccctgttgttcgacttctgtccgacgctgccgtatctgccaatcaatttactccaacgagccagcttctctccatgtgggtcagagcaaggagcaggtaagtactggtcagatgctaagtcgtacaccccagtcggatgtgtagcaatttccagactagaaatcttagttttggtaagaatggcagctgctgcatattactgttgaatatatagcatatactatattatttcaaggtcggagccaaggcccggccaccatgggcaagtgcctgggctccgcccgctgtgctagcacgtaccctgcttaattaacaatgcaattagcaaagtagttaaggctaatgcaaaagaatatactagtctctcatgctacattaatcgatataacctttcacgttgattttagtctactcaattacaaattaaattttatatatatatatatatatatatattgtatagattttatatgtatgcttatatcttattagatttgtctaggtaaaaaaaaatttctagatccgccactgtattatttaatattgagagtatgaacgatttagttgtgatacatgaatactctgtgtcattttgttctcgaagtactcctaccggtttagttttaaaaaaaactgttgttgattctcgcccttgcaaattaactaatataattacaacaaactgattaattatcattgttaaaactttttctttccattttaaattatctgcaaagtaagaaagtaacactcccaagttacaacagcacaccatccatatatccatgcaggcagcctgtttgtgcccttgtgcagatgcatttcatttatacaagtagaaggcactcaaatcagccaccacatgaacacacacatgttccatcatcgatcgatctacacatgcatcacccggtcatgcacttacaaacaaaagatctacttgaagaagtacgggaggtcgagcacgtagaggaggaagtaggcccagaggacgccggagatgccgccgaagaagaagccgccggtgaacttggcccagccgtcggcggtctgcagcttgtcggcctccttcttgcggccggtgagcgtcagcgtcggcgccgtggacggctcgccctcgccgaaggaggcgacgccgtacatggtgaggcagacgctgaggatggcgacgaggcctgcggcgccgagggcgccggcctggccgtgcaccggcgtgttgcggagcgggccggtgagcgcgaagggcccgacgaggaggtagccgtgggcgaggccgacctcgatgccgcggagcagcgggctgacggcggtgcggtacgccgggaggttggagaggtaccaggcgaccagcgggctggaggtcaccggcgtctccaggctgccgatgagggggtcgccattgatgggctgcaccacctggtacgttggctgtgtacaacgccacaagaatcacacatatcagatactccctctgtcccaatttattctttaggattcatactccctctgtctcaaaatggttatcataaagaattattacttgtcccatcaatcacttctaattcaaatttctatcttttctacccttaaccatcctcctacatccaactatacaatatttaattaggagtattatattttttttcctcaaaccttaatctatgctaaattatctaaaacgacaggtaatatgagacgaagagagtaaatgtttcatttatcgttccatagaagtagacacgtgtaaatacacaccaccatatatatttcttttagataatactatatttcaattcggcttctgcgtcaagatgtatccggcctacagacgccgatatagtcacgctcacacaaataaagctatttaattaagctctagaaaacgtatgctcttgtttcttgcatatattatggacttatggtttacacttatcatatagctagaacttatacaaagttaactataaattaatgcatccaattttggctaaatttgtgtaactatatcttctaaaatcgtcatgctaataatccaaccctctctcccaaaaaggggatttgtgatcgaaataacgatggcaaaaagtttaaggatgtactatgcaggcaaacttattactcccttcatctttgaaatttttcacatttcatagtactacgatgcgtctaatctacagagggattacaacaattcaatattatattgctaattgaggaaataaactagtgaacagagcaataaaaatacaacaaaatgaaaaacgattatgtctgaaatctaccatctgattttaattaacagagcttgttcttgagaaacatgcaagttttacactagctttgatgaagcgaaatgggaaatctctcaatgctctntagcagtctagctagctctactgaccttctcagactggatggccttgactgtgaagcggggcctccttgtcagcgaagcaccagacagccccctcggcttggagcacaccaagctgctcttcatcagctggctcgccatgggagcataagcagtggccatctctctcctctcgtctcttcctttctctccctagctagatgctctctctcccggccaaaaaaaatggatgtgaaacagctttcttggcaactgccctagaaattaaagtttgtgatctttacaagctgcaggagagaaaatctggagtatgtgtttgggtgggtccctgaagatgagatatggttgagagctgtgtggcgttcattggatggaggatgccagcaaccctatcccttatctgaattcctggagatccccctccttacgttggacgcctagctggcggtgccgcccgtcgcgccaagtggaaaacagaatctgcagcctgcagggcttgtggttggggcaaggttgctgaatcaatatatctggagatggcataacagaatggtcgcagactcggagtttggtcaaaaagattacttttggatatttttgaggaaatattttttcgaagtttggtcaaaaaggattacttttggatatttttgagaaaatgtttttcaaaaattagtaaatttcatgggcatgtgtttcaacggaatctcatcagtacaattaaacacatcttgcataagaaagagcagagcaaacgaactggcaatttataggttctcaacttctctagtgatccgcggggagactatcacaacatctaatgtgatccgcggggagagtatcacgagaaagtactccctccgtttcaaaatgtttgacaccgtcgactttttagtacgtgtttaaccatttgtcttatttaaaaaatttaagtaattatttattcttttcatatcatttgattcattgttaaatatactttcatgtacacatataattttacatattttataaatttttttaataagacaaacggtcacacatgtgctaaaaagttaacggtgtcaaatattttgaaacgggagtatatattaagaccgcgtgattaattaattgccagggatctacttctcgaagaatgtaaggactggcaaacaggtgtttggttgttatatgaggatgcgcactaccatagcaatacaccacacttaataatcataaacttgcttagacttatatttagggtggtgaaattaacgtcaaagaccatgctcaaagaatatatatatatattataaaaagaaccaaggcatgaagatataaaaaaagaatcaacagatgcccggtaactcgagtctttgtgttacaactccgaccaattcccctccaaaaaggaaaaatagtccgaccaattcttctccagggatatactcatgacacaggagatagtttccacagtagtttatctctcgctgtatgccaggcgcttgcttttctgaaggcaaccatggtagtggtagatgagcctgagcaggcaatccgtcatgcagttgacatcaaatgattcgataaacttcagatctgacaaccgtgactttccagcagcataccgatggtactcttcaaagactgatgagagacaccaattctgcagctttctgaagcagcccacaagacatccagtacggtgctgcggtcgaaacagataaaatatcaagaacatgtggtgtggacaaaaacaattatggattttgaacagatgagtgctttttggtacctttcctcttttgcaatggattagaactgggtgattccttacatctgaaaccaagaatcagtactagtaagtcaaaattattagcttgatggtcatcagagagttttagtatacagcaaagataaacaggacagaagaagcctaattcagtaccaagtatgaccctaagagcccccatgatggcatccacaggaatggacacgttagggtcctgcagatgcaaacatttaagagatactgaacttcttcatatatgtaatcaagaatgaagaaacaagcaaacatcaagggttattttatccaaaagcaatgatagaacagagtaacaagcacaagcacttggtgaatcacgacaatgtctattggagtgtctgacagaactaaaaaaaacttacttcttcacctgtagtaagacacaactaacaacagtggaaaggtataatgagcaaacatcaaagtgaagggagtgactactgatcgacaagaaaatgcaggtgctcttccaacattaggagtacctaactggatactaccacaaaaggaacagaggcggttctaatcattcattcagcacaaaaaatcggtagtttgtacttgcaaccgtaaaatcatgctaaagttgtaaacgttaattagacattgaacattggtcgccaaatttttatttcagagcaagtaaaaagactaggaaaatgagcctcaacttttgatttaaacttttttttcaaacaatttctagaccatgcctcacctatacttccaagaaagaaaatgtggaaaaatccattttagtcaagccttttaggccaaagtacaagaaagtatgtaacatgaggcttcttgtacatcagcaactaaactatcaaataactaaggaacaaaaaaaaactatcaaatggtcagcaaaaaacaaatacttctttttaaaatagcattgcatcctgaatagaagagggaaggaaaaaaaaatctaaatcacgtttactggcttaggctatttccatgagaaatggaaaaaaatagattgtactttcttctgacaaaaatgttggacacaactactccctctgtttcaaattatttgtcgttctaggtttgtcctaagtcaaacatgtctattttttaccattagtttttaaaaatccatgcagttcatcatgtgaattatttattatgaaagtatttctcatcgcaaatccaaaaatataaaccttatgatgttaaactatatgagtttatagaaattgatggtcaaattaaaatgcttgacttaagaaaaacatagaacgacaagtaatttgaaacaaagggagtattggacataaaatttcacataaccctatgtaataatggaagcaactttgtattcaattcatgtttaaatataaaaaaaggcatattgaaaatttaataatgcatgttttgcaggggcataattgaaggaaaaatgaatacaaatgaaggaccatgaaaaaggctgcgatgtcaaaaaataacggatgtccaactatctgtccttgctgagtatagaaagttatgttaaaaattcattctacagaccatgtatgactgaagaaatttccttacaagaaacattccggatgcattatgaaactgcctaatattagcagttacaatggtgaaaatgacactgatcaacttcaattcaataactgaaaaggcatctcctaattaagcatcaaccagtataaattgcaacagagaaattctaaatcaacttccttttgaagtttgtggattgttactacaaacatcacttgacactaaacatttaattgttctatagttatcatttatcaaggcaaccttcaatcatcaaattagcaccaatttccagaaatgcctgtaaattctatgatccctacgatttgacaaggaaagcttaggaccccacactctctggaataagtacttagtgtacagattttatgacacataaatacttaatc

SEQ ID NO: 53922 - DNA, 1878 bp, Oryza sativa
  unsure (1)..(1878): unsure at all n locations
cagggcacagatacctaaatccagatgaaatccaccacatgagcacatacaccgaaggaataataccaacagcaatccaatccaatctaaacgaacccaaccccccgagaaccgctcacacgacagatcggaggccgaggcccctgaggaaaccgaagctggcagggtccgggaaccccgaccggtacacccccgtgtccaccatcccgaagttggacggcggcgccaccaccatcgccgcatccgctttctccgccgccgactcgtcgaactgctccaagatcatggctgacccggcccggattccgcggatccgaggccggattcggcggcgatttgcccgcggggtggggggatcgagatcggtgggggtggcggcgagggcgcggcggcggcggcggcggaaactagggctcggcggagtcgcaacacgcggacgcaacggtcggctcgtcggcgaactccgtttcgtggaggcgggtggggcaacttgtactgggcgcgatcttaacgggctaacgggtgagcggtttcggttggtggatttggtggttggtctcgtagataggttggtcttcgggtttggtggtttaagtacggagggcatttcagtcacgtggagaaaaagaatatagattatgaatcagattaggcatgcaaagggataaagaaaaatcagttatactgctctcccaaactatttcgtcagaaaataccatagtgagattaagtcagtatttttctaaacaataatctgcagcattattagcacctgtaacgatactaaaataaaaacaaaatcagcaaagttgtgaatgggaaatgatcggtgacactaaggctcagttctattcttcaacttccttatttttcgttagcacgattttcaaacggttaaatagtgtattttttttcaaaaaaagtttatatatacaagttgttttaaaaaaagcaaataattcaattttcaaatttatgatcgttaatatttaattaatcatgtgctaatgaggtttctcattttgcgtgcaacaaaaatccaactcccaaaagagagatcaaacggggcctaagttaattaagtagtgtgaattggaaggtgattgagtgaagatcaagagagggtttccctcccgttataattaaggagataggtaggctgtcaaggcaatgagatagtaatggcaacgtccagctctgtaaataaaactaaggaagaaaagtgcgtggtaataaagaagtacagtgagaagaaggcaaagttttcttacgaagcaatgatatacctaaattatagtcgttgtagataaaacaggagtatgggctggcatcaaaattattgtgctgaacttgatagacttacatgaaggtttgtatctttccatcacgaaataggcagattctctttatatcgttatatgtaaaatttctttttaagtatggttctgctgttgatcatttatattggacaatataccatggagtatttatgttttaggtgaaaatttcttactgatttgtggttttgattttttaggaaaaaaacttttctatcataatgcaaaaaagttagggatgcaagtgggcagacttgtggcccactaagccggagtttgaaaatgggtttgcatgttgctaccgctcgtttaccatatgcatgtttcccaaactaataagcgttgccatttttttttcaaaaaaagaaaaataaacttttttttcaagtttggaataatcaatatccaattaatcatgtgcgagtgactcgtcttattttgtgtgccactaaaaatctaagccaaacatcactttcaaagttaattttagccatatttttannnnnnnnnnnnnnnnnnnnnnnnnnnnnnnnnnnnnnnn

SEQ ID NO: 53923 - DNA, 14077 bp, Oryza sativa
ttgtccatgtttgagcctagcttacgtagaaaagtgatcggttaaaagtctaaaactatcatgcttctttttttatataattgcggcacattattgattaaggagcatcagaacaacgtactttccagaacaagagttagactcgacatagcgagctattaagtatatatgtgccgcaacattagacaactgactaacatggataataaaggaacaaagtaggaactcagacgcgagcttctttatgtagcctatcacacaaacgatgttagatcgatctcggatcatcttttggacctactgtatgacagaaaggcagtctaatgccaaaatcagcttcaggaagcctttttcttttgcgcgttgcagggtgcactggatcgcgagggcttcagcaagctctgggttgacaatcatgggtatatgctcattgctggtaaaaatacaactgtcattatggtaacaaataattagacctgcactcatgcgacgagaaccatgaaaaattatagcatcaacattgaaaagaattgttcctgcagacggtggaatccatcattgaacaacataagagatacagcttggtgcattcataggtttaaagcagtgctgctggattatatcatgtaagtcgtgaatatcatagccacccaatgaggacgccataagtcattgttgttctttgcctcattccttgcttcccaaatgtgctagaaaattacaacaagagccatttttttgatgcgcaagcttttgttcatgaaatcaaatatccaatgcctcatatctataagatttcttttgcacatctcgaagccaaacttttgcttgagtactccccaaatttatttggcaaaggggcaggtcaaaaggacattttctatttgatcatcttggttgcaaaacacacaaccgttgattgcagggatgtgtggtgtcatcatagctggaagcccgtcagaaggcaatgatgtgccgccctccgaacatttattttcgtcttccctggcgtcgtagtcttccaaagatccttccagaccgcggtatcaacttcccatactaaagatagcccccttccatttgtgctttgagcaaataggaaccgctcaaatttcaccaagtcttaggctgaacgaacagtgtatgacccaaatttatcatggggccaagatgcatagtcatccaaaccttggtggctaattgaaacttgcaggatcgagtttgcaatctcttcctgcaagacctttcactaactctgtgccctacctactgccattcctcatctcggttggcatgccaagataggagtcttgaaggatctcattagagacttgtagacttgctttcactctctctttggtgtcagattggcaatgcttgccaaagaagatcgatgattattggagaatgaccttctattctgagtcatcacaataggtcttgatggaggacttgagtgtatggactctcctggcatcactcttggcaaataacatagcactttgtggaaatccccacaacaaaaacatgggccgatccattaacgatggagacggcgaacaaggttcaaaacacatgtctcaattcctgctttggttccctatagacaatggccccttccgttgaaactgatgatcaaaacaggacaagctccctggtgaggctattatattgcagctgaaggcaaaagagcttgagaatcctaaggaccacatcatgtttcttgctttgttatcgtcttagggtgtgtttgccattcctagttcccaaccggaacagtacgcacggaaaacagagcggtccattagcacgtgattaattaagtattagctatttttttttcaaaaatggattaaattgaattttttaagcaactttcgtatagaaacttttttgcaaaatacgcaccgtttaacagtttgaaaaacgtgcgtatggaaaacgaggagaggggttggaaaaaaggggtgccgaacatcggcttagagagaaagatgaggagggtgagtcttcaccagccagcgaagctcactcactatcacacctgaccccagcccacaacagttatagcacaagatactcattgagtctggcgagactactccacaaccaccgcttgatccgctgatcaaggttgaagcactctcgcttcttgttcgagtcgatttcacctgtatcctccgcccacagcttgagaggggaggtttgttgcccggtggtaccaaagccaagctgacaacttccaatgccccaacagcctaatcatccctcggcgagataactttactagatttcttgttctaacttgagaccaccagcaatgtcccttggtctgggaacagatctctcccttaagccattggcccgtcccctggccctgccccctggcagccctatcggtccccctgcttccgcccctcatcaatccctcgtggtttgaatcctacccctcggtttctcgaagcagccagtcggacaggtcctccggaggagccttgggaatcaaaaccggaggcattgacacctgacaaggaagacacattgtctgatttggcactacctgttttctgctctactcttgaggcacacgtggcctcttcgctgcatatggaaaatccccatcttcatctcgttccgccggggttgggcagaccaagaaggaactagtagctagatgaattactgtacatactatggtattatggagtcatataaaatctactacatatatacgagtctatcagtttgcaatactgctgtttatatcagccgtgaatatcattgggttttatgctcatgtttagttgtgccttttagcattcaacgttcttttcactcgtagtgaagcacacgcattttgctagttatatcatatatattagatgaagtttagtctcccttgtatcacatcttacagtttcccaatcccaatacattgcagcttacgcctgtacgcgtgtatccaactatccatattgtaccaaaccagcgttgataacaaaactgaaaccgtctccgcttgctcctgcccaccggccatggcggcccggccggtcagccgctcgcgtcgcgcagcaagcaatccgtccgctgtccggaaaggacggcggcgagctcagacgctgacgagcttcttgccgaggatcatgtcgtcggtggtgaagtcggccgccttcctgaacgtgccgcggccgaagtcgaggttgtacgagtcggtgaggccctccaccaggtcgtactccggcttccacccgagctccaaggtcgccttctcgattgacgcgaagaaatgctgcagttgttgcaatcacatcgaattcagaacactagcagcagcagcagcagcaaatttttcttcagatttagcagagaagccattgctggatataatatataacctggtctctgaaggggaaggccttcttcttcccgaaatcgaagtccttggggttgtagtggacgatctccggctcggggaatcctccagcctgcatgatcaaatttcaaacacaccaagattcatggcaatcctgccggaaagtcccatgtcatttcttggccgctacagcttcgttgatgccacgtaccttggcgcacgcccgtgctagaccgtcgaaggtgacgtacttggcgccggaatgttgaacacctgcttgctcgccttcgggttgccgagcgccagcacgaacgccgtcgccaagtcctgcaaaaaccaccacaaagattcagagtttcaggtcgacacccaaatacacactctgaattctctgaataatgatcactgatcgaattgaccttgacatggccgagctgggtgatttggttgccggcaccggggacagggatggggcggccagccttgagccggtggaagaaccactcctccacggggttgtagttgagcgggccgtagatgtacaccggcctgatcgacgtccagttcacgtcccgggtctccagcaggctctccgtctccagcttccccttgtgccggctcttcgggtcgacggcgtcggtctgccagacacacaaaagctcggcatgatcaatggcattccatcagtggtgatcattagttagcatgagtggaaaatgcggtggcgtacctcgaagtgcgggagcaggtctgatttcaggtacactcctgctgatgagcagtagatgtacctgaagatgacacatatgggaaaattcagacattggaaatttggtttgttcagaaatgctgtaatttgggctatggtcagatggtgtagttaggcttactgttcaaggttcggcaatgcgtctaggattggggctacctcaacagcttctctccctgtaaaaccatgagccgatatgcgtgaaaaatcgcgtgatagtactatatttgatggaagattgaaggtgatagtttcagttggtgggatggaagattgctgttttttgaagttgctaggctggtttacagtgaccattagcattgacatgttttatgatctatgcagggctactatggtggtttttttggctttgaagtgttaccgtttatgtcgtaaacaacatcgaagccctttgccgcaaggcttgtcttaacgaaatcaaagtcttgcctgtcacctttcaagtgcaacacctacagaaaaaaccatcccaaattaacgccatctcactgaacttaaatgataattgttgagaacaagatattcattcagttaggcctttatactgtcctaattcctaaataatcctacattagaaattttataataccttgtgtatacattagcatctctactgcagtattatttatcacactgcaaatggacaatcctcttttacatggtatacacaggaataagataggaggaaacagcacacctttgaagagaactctgcatactctgcatctgactctcctggcaactgctgggtaatgggggcctttcctctagtgaacaatgtgacctaacaaatacagtttttcaattaacttacttctccaaaacacagaaaatattgtacttacaggggaaaaaatatcacactacacaactgacatacctggtgcccctccttgacaaggagcctggacaagaagacaccaatgaacctggttccccccatcacaagaatgttcttggagtctgcagctgctgctacctgcatccttgccccccttggctgccatgacctcctcctagcctgtcgataaagaattcacaaccatctcttagcttttctgccatgcttgaacctcatggaactgaaagtttcatgtttttctgttcttcagattacctgggttgagatggagagtgctgcactactgaagtcagagataggagatggtagcaggaggctgctcttcagggaggctgttgctgccatctctctctcttttttttcttgtttactctcctcaaccctcctctccctgtgcttgagctgttataaaaaaaaacaaggtacaaacaagaggaggggctttgtttgttcaggatggtagtatatcccttgtctgaaacttgtggttcagtcttgtgtgctaatggaacaaagcaagagagaaaaaaaaaagaggtgctgggactgttttggcttgtgtggatggggcagccagccctatcctgtgatggatcctctcctctcattctttcttctgtccacttggcagcattctgatcaaatgatggggacatctaactcttttttttattgcttttgtacataaaccctgtaaatattatatttattaatataatacagtagtagcctctcctattgtttcccgtaaaaaaaaagtacacaaagtgaggctatggtgtccacaggcattttcatcaatatatacttttttttaattggtaaaatagataaagaactagaagtttgttatacttaagaatgtaatcttattgcaatgggtataaaagttatctaatcatcttgtaactgatactctagtatcaacctgtattgtagttctttttcacctaagagatcgatgggtttccgtatggcatcaaattcattctgaacatttaaaaaggttgcaacttggttttcctcatcactgtacactccatttggttaaaaaaaaatcctagaatctttaatagttcttttaagaacatatctatgttggtggatgatatcaaagaccgcatgtactcaatcgaggctgggtggagcaaagtgcattggctagatctttagatagcctcccaggatgttgttttctttaaccattattagatcattttaatgtttgtaaaagcttgaccagttaaggggcaatggattttttttcttctattcaagtgggacacagagctcctgtgtgttaaaaaaaactgtagttctttccaaagtttaaaatttgaagttaaaaaacattggaaaacacaaatatgggcaattcaagccaaaaattgaaatctgcctctcttatcaccagtatatatagatgtcctgaatctattaaactaaaatcatccttgcttgcaaaatctgaagtacaaaaagtagaatactagaagtacaaaatctgaagaagttctcaactagtacaagacatcttattattcatacaaccaaaactagcataacaaaaaagcactccagcagctgccaacagtgataataatccaactcaaacctcactttttatcatcttcctgaaccaacgtgttgagtctttagggtaccgtgtgaaagtgctccggtctacatagacgattccgaattttgaagtgaacccgagccgccactcgaagttgtcaagcagggaccaagcaaaatacccagtgacccttgcaccatccttgatcgccctcttaagctcatggaggtactgatcaaaatattgtatcctgaagaagtcatacagtgcaccaggtagggtctcattgcctggctggtcaatgcctgcaaaaggttcttgttagattttgctcctagattcattctgcagagcacttttatagttgtactgttcactgtccgaaaattgaaagggtctccagtattatctttatttaccattttctccgatgattataatggggtccttgtacttctccttgacatgcatgacagctttgtagatcccccaaggaacaacataaagccagttcgagtacgcctgcatagatgtttaaaaaccagaatttagttcatgatctaccattcttttcaacctttcttgtaaattgttgcttacctgtttcccaattggcacaccgttacgctcatctgaatagaggaccaaaatgtgttagctaggaaggcaaagaattgaaaaggtacaaatatttctggtctaatactgtgtgatttgaaagtgtcatacatgaaattttcacatcccaatcattgagatagctgatggatgtcttgttgacgtggtgactgacataataagttgtgtaatggttgatcgcaatataatccgctgatccttttatcatctcagactgctcacgtgtgaaattgggcagcctttccttaacagcattctgcatagtttctgggtaatgaccatatgtaatcgggtgcaggtacctagcaaaagtttcaagtggaagttcagttcaaccttcatgcggacaccgtgtaagagcaatgattgatgaacagtgtaagatgtatcaccagccaagggtaaactccctggctctatgtgcagctgcgtgatcctcttctttgtcggtgagtggctcataccatacaaaatcgagaaggatgccaatcttccccttctgaatagcctgaaaatcgcaaggtatcatgaacatgagctgatacattggagattttaagaaatgttgaattggatagtaggggcatggatatcattcactagcctggtacttgtcacgatatgtcctgacagcagcggcatgtgaaaggagaaggttatgggctgcgatgtaaggctcggtggcggaattcccaccgggttggcagccggtgcatctgccaggggggaagaagccgtcaccgtagccatgatttgccatcatcctaggttcgttaatggtaaaccagttcttcaccttatgaccatatgtcttgaagcagaagtctgcaaatctcacaaaatctctcctgcaaaatgaagtcgcagacatgaatcacacattaattcaagaaaaagggagtaaggaacgtaagaaagggaggatacagattgtctgggtttgatatttgtgtatgtcggatatgctacagtgaaacctattttggttaaacacctgcagaactttcactgtcaggatttcgcagttagagagctatgggtttcataatttagcacaaaatcttcagaggtgcttctgtagtttgtcaaacaatttaaagggtatttaattttaagttttacagccaaacagatggctttgatcacgaacacttacacaattctggggtgtagccatcccttgtattgatcatggagcacctgtggaaggtcgtagtggtagagcacaacatatggaataatgtctgatgtgcaaatcaaaccaaaaaaaaacctattaattcgagatcatgaaatccgaaatgggcaagaactagaagaaatgccaagaccaacgtactgttagcaagcatgtaatcaatgagcctgtggtaataatccacgccgtctttgttaatcttcccaagtccacctacaacacgcagaagaaaaaccatcaatgaaaggaatatcccatgatctcatcactgtgcctgaccatgtttcagccggtaacttactggggaaaatgcgagaccaggagatcgagaagcgatacgcgtcgaagcccactctcaccatgttgtccacatcatcctgcaaagaagatcatcagaggagccacataagctacaaatcaagagtcatacagaggaacagaaacccattagaacaggcactgaaacacatgagactttcactgaccatgtagcggtggtactcgtcgacggtcacattcgcggtcgaattatcaggagttacacctatccaaaggaacaatcagagccaaatcaacaaccagtcatacatccactagagacgtacaaaatgcaacgcgccgtaatgcaacaacatttcaatatcaggctatgtaattctttttagattgttgttgtcatattctctttttaggtggatcgtcccaacacattgttaattccattatttgaaaaatgcgacaaactgtttatgatctgtatatttagataccacattgctagttttgcctgaacatgtatcatcgatctcaccaggttgcatcaggaaggtgtcccagatgcagggccctcggccatactggagggcgttcccctccacctggtacgccgacgacgcggtgccgaagacgaagcccgcggggaacgtctcccgcgtgaggtcggtctgctccccgttgccatgggagagggagacgacgacgatggcgatgaggagtagcaatggcatattcatgttggagaggaagagagagcggcggtgagagtgtctgatctgctgcaaactgcgtatatatggagaggcaggtgaagtggtcagggcggggcgatgcatgcatgcagcaggggaacagcgattttctctggcacgaatggtggcagcggcaaggaggactccttccaccctgcctttgtggagcagtgtggcttgcactggtcctgagccactagaattttttttatttttttctatttctgtttttaccctgtttttttttcttcttttaatcaggtgatgggttaaacaccgtctggactagtgggcatgacagtgagcttatcgcctttaaatttggaaactgcatggtacgtacctcagtctgaaaatataacaatttctgagatccccaaatacacagtaaaaaaatgttatattttgagatacagatagtatatcatatttaaaaaaactcccctttaaatatgacaagttttttaccaccggattaagatccaactgctgtccatgtcctgctatcttccaccagtcctccaatggtccaccctcaacccactcatatgagggtctcgtctatgccacagcttccaccgccaccgtcttttcatcactatttctgttctacgtgccaccacttgtctatctcgctacgaccgttaaagacccactagagatgttgtttggctagccccaacaccgtctccttctgctctggcactctggctcaattaattcttcccattacctgtatatattctttgtctctaaagcccacactaccttaatttctctgatgtttcctttgtattccgccataggatgtgccattgtcgtcacctaaccactggtttcttgatgcccccatttgcctccaccgtcctattacgtcttcgtggtgtgtcgcccgtctcacctccctcacgatgtcgtggtctaccatcaagtcgccgccacctcgacattcatctaaatcgaagaactcccccttcccccctcctcccatcttgattctgactctgagatcttagttgttttggtaaatttgaaaaaagaagggtaaatttgatcgtgccattatggaaacgttgtattggaaaaataccactactaaagccgaaactaggtgggtgtcactgaattatcataaaattagaaatgtgccatcgccataaatatttccgtcaaagaggaaacatgcatcatttttcttcctctccaagcaaccaccggcggatggtcaagagggcaagaccggctctataatttcaagagccccttgattctataggccctaaacctttttatttgcaatatatactctataaaccatgttttttttataaagtgatattaataaacattactaacatgataaaaagtaaattaatgataaacagtaaagtaagtagtgcaaattaagatatggtattttattctcgataaatattgctgatagtactgtaataaaaaactaaaaggactgtagaaacaaaatagtatgattatgaataccttaaatacgagaccacaaatatacaatatatctgatataaaatcttgatgacaatggcatggtaaatttatagaagtatgagtggcatccacccgattttggttttcatagtggtatttttccaatttaacattttcgtaagggcatgggccaatatattaaaaaaaaactcactatggattgcaaagaccggttgttgaatcaaaactagacccaactataaatcgggtacccgatgtgccccttcccaacatgcaagttacttttctctccatagcacctctgcatgcatacctcatttctctctcttccactctttctacgcgcatgcaagctctctcctccacacgctctctctctcctatacactttttttttcgacacctcctggtatcgatcacctctctctctctcctcctatatactttttttccaacacctcctgtacttaactaggtgattccccgcgttttgctatgaaaattactaagtaagttttaatatgtttttttaataattgagctaagagtgaaaagtatattggttgttaacaataaataaaactgatttgtcaaactatgttcgatgagaaataaatttagtagactctgtaggagattatacatgaaatatgatatcctgcattttgattatatgaaaattcaaatgcaaaaataagatcaaattgtgattctaagatgcattcctaataaaacaaaacatgtgttttctccaaatggcagcaagcacgctcggctgagcaaaaaaaaaaaagaaaaaacgagtgatgactaagcagaaaaaaaggtctggacgacgcagcataggattaatagagaaaaaaagaatccaattctcatgaaattcacgcaaacctgcagctcctcagtaattaaattagagatacatattgttagaaaaatagagaataaaaagtaagttattattcacatgaataataccgatgaaactatagctcttcatcatcaatcacacatttatcccagttttcggacccttaacttattcctacccacgaatcaccatccatagcacacactaattgagctaatccctctttctatatagttgagacccaaagctgatctgtgattaagccacgtcaccactaaaacctcagccgttcgatctgatctggacggtcgcacacaggtgaagcccagcccacttctttccaggatttttcggtttctcctaacccatccgcatcgcgcagaggctatgccgccgccggatgcggcgcttcctctcccttctccttcaccctcgcgccgcttctcctcccccgtgcgcgcgcgcgcgagctgcgccgcgggcccgcctctgatgcggtcgcttcccatccccgcgtcgcactgcctccccccatccccacgcgtcagccacgccacgcgcctgtagccctagggaggacgaccgtcgcgtcccgcaacagctccttccaccgcctcccctcccctcggtgcttcctctccattacttgatgccagaagggagcacgcccatcgtgctgaccacccagcggcgcctccccagccatgctcacacccgtcgtgacgtcggcggcggcggcgccggcgcggtcccggtggccaagctggaggacgccgccacgctcatcgactccgtcgagacgttcatatttgactgcgacggtgagatggcacgctggtcgctcgatggttgattggttgtgattttgttatgaattgtcgcgttctttttgttgcgtagcagcgtaggtgtgatttggaagggcgagaagctgatcgacggagtgctagagacgctcgacatgctagatcaaaggtccgtcgcaaactgcaatggtcttctcgaactccgattccaacttagcattatcaatctgttggagttgaagctgatggggttgtggtgttgcagggcaagaggctggtattcgtgacgaacaactcgaccaagtcgaggaagcagtacgggaagaagtttgagacgctaggactaaacgtcaatgaggtaggattcatgccatgaactaccaaattttctttgtgcaaccaatctggtctgatgagcctggaacgctctatgcaggaagagatcttcgcttcgtcgttcgcatatgtggcgtacctgcagtccatcgatttccccaaagacaagaaggtaggagtatctaatttatatcaccatcttcagaagttaacatgttttggtacgaagatacgtgcacaacgttaccatttatactgttcatgttcagcgattttggcaaataatgtgtgcatgtttaacattttaattgttcaggtttatgtgattggagaggacgggattctgaaggagctggagctggctggatttcagtatcttggcgggccagtaagtaataaaatttctgaacccatgttcagtgctgcattcctgggacagactaacacacataacaatcatcttgcagtctgatggagacaagaagatagaactgaagcctggattttacatggagcatgacaaagatgtaactacgatccctactagcactcgccacctatttcatatgtatagaatggtagttggtgattccgtatctacagcttcttctgtatgttgcgctactcctgttgatcttcaatccgcaaaaagaaggccgatgtgtaccattttcctttatacattgattttggacatggccaagtcaggagtggagtttgaggctgcccttttttattctgatggttgaaatcgttgtcttcttgcctcgacaactactgatccattttagagcttctgctgcttgccctagatcaacttattgtccaaaagtatgaatctgcaccagctggacagcagtgacattgtcctctcactacaggtaagccgatattatcttttatatttctcatccattcattcttgttatcacttgctagccattgtcctctcactccagcttaatctttctctcttttcccctaaacagaaagccaggggtttgtttggaagatttagtatactccgtaagctgaggtgctcaaagataccttctacctggatggttcctcgaggaagtttggcctccccttatatgctaccactat

SEQ ID NO: 53924 - DNA, 1021 bp, Oryza sativa
agttcaacctctaccgccgccttcggccatgaatgccggtcgccgtggttcatctccctccctctaatctctctcttctccttccttagggcaccccgaatcccgtccgcccgttgccgtcgtcctcccgtggcttgccgtcgccgttcgccgtcgtcttcctccgcgccgaccaccctcggtgaggattcctctcccatctattcccctccctctccttcctagccgccgcttagcgccgccgcattcacgtcgcctttgcgccgtcgcctccgccgccggttgccgtcgccggcaacgcgttcgcgcgcgcgccgtcgccgtcgccgtgaccgcttggccggccttgagccgagccgggtcgccgccgcccgtccgatcgaccccgagggcgatctgggccgtcggttccgtggaccggcggtggaccacccgcgtggtcccggtccacggagaaccgttccccccttgagtcgctgccgagtgggccccgcatgtcggcgccgcgcctcctcccccccatgctaacgtcagccctgggatttattgcgcaataaatgatttaaggtttttcttttatagtaataaacacagtgaatcttctaaaattcataactaattcatccgagctccgtttaagcccattcaagtctcagtaaatcaagaaaaatgtgttgaatccattaaaaatggttttattccctgtttcagtagtcttttagcctgtttgcaatgtttgctttgtatgtcgctagattccggttcctccgacgctccggtgttcttcgaaatagtcgccgaggttcctccagcagcagagcaagtcatgcttgtcacttgaacatgttgatcctatattgcaaatgctctattgttttctttcaaatattgtattgttttataatgtttctatggggtgtttacctattgtcatagccatgctattgttgtaccatgtccccttgtcagcttggggttataacatgactagagattggactagggattgcttagccatgct

SEQ ID NO: 53925 - DNA, 1307 bp, Oryza sativa
gagagtatataggagtagctagtattagttttgggggagcagcaaccagagtcgatgaaatgcataatatcaagccaggcgattggtgtgtgaaattgtggatagaaaacgatcaaggggtggaaaagccaggctgggggtacagtactggtacagtacatggaaaaggcttgaaaggggcaaatgggatcagatccagcaatcagcatacatgtacgatcatatatatcagcccaaacatacaaactggagttgctagttgctacgaaacaaacgacttgatcacgagagtatccatatcggagggtatgcatatcaatgcatgcatatatgcttgacaagcaacaatatactccctccgtttcgaaatgttttgacaccgttggctttttaacacatgtttgaccgttcgtcttattcaaaaacttttgtgagatatgtaaaattatatgtctacataaaaatatatttaacaatgaatcaaatgataggaaaagaattaataattacttaaattttgtgaataagatgaacgatcaaatatatgataaaaggtcaacggcatcaaacattttaaaacggagggagtataatgcatcaagaattcaagattccatgcgaaatttgtgatacgaatgcgacgcttgcatacatcaacaaataatgctgctagcacatgcagatgtagcagacgtacaccagatcgatcgatgtgcggtgcggatatatatttaataattaattttgatcaattagcgaatagctaatactccatccgtaaaaaaaaaagaagacaaactctggattttcgtgtccaattttaattgtccgtcttatatgaaatttttttataatttatattttcattgttgttagagacacggaaataagggtttgtttattttttggacggagggagtatgcagcagctggccgggcatgcatgcatggaccttcgtcatctcctgcacgtttgcgacatgtgattaacaatatcccccatgcattttactttgttgtttagctctcgtaagtcgtaagttttgatgcatgcatgcaatacaagcagctagacttaactagccgtgtggttttaaccttaagcttccgtcttcaattcccaaaacactcataattttttattaaaagaagtgtcgggagggacatctgtccctccaaatctcgtcttttttttacttaactagcttagggtagggttaaaaatggttcagaaaatttctgatttcagacacatgtttttagaaatggaaaatatcggttagaatttttttttttggaaattttgg

SEQ ID NO: 53926 - DNA, 1107 bp, Oryza sativa
catgaacatgagttagatagcctttttttttggttttagtgaaaagatgaactctctaacctggtctgatgaagatggccatctttcgggcctaccgaccccaagaacgtactgtacatatcgaatgatccatggatggatcgatcaaaagactcgttgacaagaacgtttccccttttatcgggccaagaacaaatgtcgcggcgtgtgccaaatatgcatacacaaactttgttttctgcaagctagtcgatcgtgccggtcaacagccaggcgcaaccaaaggagtcgctacctagctagccactttctactggagtaggagtagtttctacacgatagatcgatgtagcatcacaataatggccagtggccatacccttttcagcggtagtaatattcttcttcattttccgtattttaatatttgaagtcttttttttgcctcgaagctctggtgagaattttgaaatgtgaaagaaccaatcctcacttaattccgatgcattcgcatgacaagcttctcccgtatctgtattatcaactccctccgtcttaaattaaaattagattattattattaacctattttatttatttcaaaataagtttatttttagaaaataaaaaaaatacaatgagagtagataaaatgaaaaatagttgcattgagaaacttattttgggacaaagaaaatatgctatagagtacatatgcttgtgctcatgtcactcatagtcatagagcttaattctaggcactactagtgtagtactaactccggccaaaaatatagctatctagtacggtatgtgacatcacgtccaaattcatagtactaggtgatgatgttacattcagtactaggtagctatattttgagacgaaggaagtagagtttttaagtagtccaaagataaaaagaaaatactggtaagctgctagggtcatcaagctcaactactccatcaacggtcaaggggtaatatttggcgtttagtgacgggtgaatcacacggaaatccccgctttagaatgtgggatgttttggttttggtataaagttaaaagttaaaaattaaatttatagaatttaccagtacacc

SEQ ID NO: 53927 - DNA, 750 bp, Oryza sativa
atagggcgaattcgagctcggtacccactatggtacacagagcgcaagacgatcgatattattccaaagggcaaagcaagtatacaaggggaaagctgcagaggagagctcataccaaggtggtgtggactagcaacggacaaggggaacacgatgcatgtacgccaagcgtcgctggcatgcgactcacatcagatcagtggatcgagaattaactacccatctactgctgcctgcctgcctaaccagcaacaacataaccctctcgtgaccatctcatatacagtaaatccattaacatacacacaggcatatgcgttcatggttaaacatggtatatataagaaaccacatgtatttaatttgtaatgtttaatacttaattaatactgtgttgtgtgccaatacccccgagcaattggtgcaagcacgctctaaattctagccctcttgtagcggcgtcctagtttctacaagttggccacgtcggagtgtctaagggagaggtgtttcatcttctctctcaccttctctccctaaatcgtgaagtcttggatagagttgggttttgtgttgattgtataagtccggttttgggtgatctcggcagtgttctgttgttggtctaacggcggtcgatcacacttagcagcggccggtccggtgctagccttctcctggatctgtgtgatgacgcttgccctgtgtgggtgggggggataattttttttctggttatgaccctataaa

SEQ ID NO: 53928 - DNA, 916 bp, Oryza sativa
  unsure (1)..(916): unsure at all n locations
nnnnnnnnnnnnnnnnnnnnnnnnnnnnnnnnnnnnnnnntgaaatcagaaattttctgaaccatttttaaccctaccctaagctagttaagtaaaaaaaagacgagatttggagggacagatgtccctcccgacacttcttttaataaaaaattatgagtgttttgggaattgaagacggaagcttaaggttaaaaccacacggctagttaagtctagctgcttgtattgcatgcatgcatcaaaacttacgacttacgagagctaaacaacaaagtaaaatgcatgggggatattgttaatcacatgtcgcaaacgtgcaggagatgacgaaggtccatgcatgcatgcccggccagctgctgcatactccctccgtccaaaaaataaacaaacccttatttccgtgtctctaacaacaatgaaaatataaattataaaaaaatttcatataagacggacaattaaaattggacacgaaaatccagagtttgtcttcttttttttttacggatggagtattagctattcgctaattgatcaaaattaattattaaatatatatccgcaccgcacatcgatcgatctggtgtacgtctgctacatctgcatgtgctagcagcattatttgttgatgtatgcaagcgtcgcattcgtatcacaaatttcgcatggaatcttgaattcttgatgcattatactccctccgttttaaaatgtttgatgccgttgaccttttatcatatatttgatcgttcatcttattcacaaaatttaagtaattattaattcttttcctatcatttgattcattgttaaatatatttttatgtagacatataattttannnnnnnnnnnnnnnnnnnnnnnnnnnnnnnnnnnnnnnnnnnnnnnnnnnnnnnnnnnnnnnnnnnn

SEQ ID NO: 53929 - DNA, 1048 bp, Oryza sativa
cctcacatttctgggagaaagtccatgaagccctaggaagttaccttgcgtttagcacagcttatcatccacagacagatggccagacggagagaaccaaccaggtcctagaggacatgctgagagcttgtgcgctggattttagcaaggactgggagaggtgtttgccctacgccgagttctcctacaacaacagctttcaagcaagcctgaagatgtcccccaatgaagcattgtttggtcgacgatgacggacgccgctgatgtggtctaagacaggtgaatgagcggtatttggacctgacattatcaacgaggccgaagagaaggttcgcctgattcgagaccgtttaaaggtagcacaatcacgacaaaagagttacgccgacacccgaagaagaaacctggaatttaaggaaggagattacgtttatctaaaggtttctccgatgaggggaacgaaaaggtttaaggtcaaaggaaaactggcaccaagatatgtgggaccattccagatcatcgccagacgaggagaagttgcataccagttacagctagcagaaaatatcgccgatgtgcatccagtcttccatgtgtcccaattaaagaaatgcttacaagtgccggaagaacaagctccgctggaggaaattcacatttgcaatgatctcacgtatccagaacacccaatccggatattggatgaagctgaaaagaggactagaaccaaagtctggcgtatgtacaaagtacaatggagtaatcacactgaggatgaagccacctgggaaagcgaagaattcttgaggacggaatacccgcatctattcgaaaactggtaagaaatctcgggacgagatttatttaaggggggtaggtttgtaacaccctgaaaattcgatcgacaaaatcaaaactctaaaaatacggattttcaaaaacctttttaaattaattgcatcatgccgatcttattcgcctattttatccggatttgatctcgaagattattaatcgtgagtaaagaatagttaattaggaataaacc

SEQ ID NO: 53930 - DNA, 908 bp, Oryza sativa
  unsure (1)..(908): unsure at all n locations
nnnnnnnnnnnnnnnnnnnnnnnnnnnnnnnnnnnnnnnnnnnnnnnnnnnnnnnnnnnnnnnnnnnnnnttttccgtcggccgaaagcttccacacaaagctgtcccgggaatccggctgtagctgaattgcctcaagccgatcccacaagtgcagcgcctgcatcgaaagggcccccttgatgtcatggacggacggacccaaccatatgagaggaagctaagatgttaggggtctaatctgacggccggtgacagaaatggaatcctatattttacaatcaactgattttctttcttttacaatcaactgattttctttccaagaaaatatttatgatttaaacatgttatgtaaggagagttggagacagatagaatcatcgtgtttcacgctgggcaccaaagaacagttcgtctaatcaatcaaaagcaataaagctagcgcactaggattacacatgtggattcacagtgaaactttgcagcatgcatggtcccgtgtaaaagttgattgattattgtactatgctaatgggtggacactgtgattagggactgaattatgcagagtaaactccacgttagtaatccattaattccccctctccctttaaaacctgccccttgcattctgttgatgagcacctgcgcctcaccttgtctagttagcaatggcggctgatcaccttgtcgtggccatgcttctcctgctggctttgtcgccgccggccgttgctgacgacacggcggtgctcggccagaaaggcggcgtcgtggaagggcaggcagcggggccggggaggtacgccgtgatattgaacgccggcagcaccggcacacgggtgcannnnnnnnnnnnnnnnnnnnnnnnnnnnnnnnnnnnnnnnnnnnnnnnnnnnnnnnnn

SEQ ID NO: 53931 - DNA, 1746 bp, Oryza sativa
ggatccatggtcatctccttttggatccctgtgtttggccaactcggttttgtcttctttggtggttgccctctaacatggacagggttctcatcctctgcttttactgatcttggtgctattatgaagctttcgttatcgtctggagtgatgctttggtaagtaacatggttacgtttatgtgtatatatgaaattttcaacaaaaaaattgatgatggcaaatagaaagttaatattttagatgctaactgttaatcaagtttttttatacaaataattagaagctcattaatttattctcatttttcttttaccttttcagtttagaattgtggtacaacaccatattggtgctcctcactggttatatgaagaatgcagaggttgctcttgatgctctttctatatggtaatatattccactctaatctgttgtgtattagtttagaaaacaacaaccagatcatgttgtatcatgtatatcattgtattgttttgtgtttctcctctagtaattgaaaaggttgcttattgaacattgttgttttcacttgcaaactttgtagccttaatatcaatggttgggagatgatgatttctatcggatttttgtctgcaatagggtaacttcacgatctcagctgtcactcactatgtggttcatctaactgatgcaacatgaaccataaatttgacatatacttaatgcatgtacatttttagagtgcgggtggcaaatgaacttggagccgggagtgcaagaagggctaagtttgccattttcaatgtggtcaccacttctttcttgataggatttgtgttgtttgtgctcttccttttcttccgtggaagccttgcatacatatttactgaaagtaaggcagtagcagatgaagtcgctgatcttgctccccttctagctttctccattttgttgaatagtgttcaaccagtgctctcaggtatgttattccatttgaaggacaagtatatcaaagtaattcaaaatttaacaataaaattactaattttctaatttatctataggtgtcgctatcggatcgggttggcaaagtgtagttgcctatgttaatgttacatcgtactacttgattggtatccctcttggtgcaatactaggctatgtgctaggatttcaagcaaaggtaaggaatttttgtatgatagaatttcactagttaatctggatttaagttgtgtccctcacttatgttcattctttttgcagggcatttggatcggcatgcttcttggaacactagtccagactcttgtgcttctattcatcacacttaggaccaattggaaaaaacaggttgcctttttttacctctgctcatatttttttcttatcctttttttctgattaaatatcttttttcaaataatttaagggtctctctagaaaattcatgggtcattagaagagcatatttttctcatttaatgatgtgcttcatgtttaattttttcaggtagagattactcgagagagattaaacagatggtatatggatgagaacggacgatcacagaattcaataggaaatgcatgatataaaacttctgcacacttgtaaagaattttgatgatttatgaatcaacctgtcaaaatgggattgtgctcggatttaagattttcaaggtttgaactttcaaaaaaaaatcatcaaggtcacgtatccaccaaagaacaattttaatcatatggcttggggggat

SEQ ID NO: 53932 - DNA, 2514 bp, Oryza sativa
  unsure (1)..(2514): unsure at all n locations
nnnnnnnnnnnnnnnnnnnnnnnnnnnnnnnnnnnnnnnnnnnnatagacctaataaataaacacaaatatgtagatcatttagaaataaacttaaaaaaactatatgcagatcaatttggaatggagggagtaaggcataaccacttttcttatatgttacataatagtactactagtataaggcatgcatgcaagcatccaatttactatgacatcttctctattaaattactacttttttaaatcctctactctcatattatctaattctattggatgcatgcattatatttattaggatgatccaaactacaagataataataattatttcttggtctttgggttaatggaggttgtgctttatattttgaaatggagggagtacactgcactgataaatcttaattaatctgttttgcactgcatattacaggaaggaaaccaatatagatgtgtgttcggcacctcattttcccaatacatctccatcgtttttcgcgcgcacacttttcaagctgctaaatgatgcgttttttgtaaaaagtttctatacgaaagttgttttaaaaaatcaaattaatccattttttttaaaaagatagtgtaacactccgcttttcttgagacattaaaaactaattcggcaaaatcctaattgcgaaaatttcgttctttgtgtgcgagtctaagttatgccaaggatctcaattcaaatcctgttgttccctctcatcgaaatcaaaatcctccacctcaaattcctcttccgattcaagtctccaaatcaaattccaaaattcaatcgcatcctttgaatcctcgctaaacactcgctcccaattccgaaaaataccaaaccctatattgagccttccttgatttctccctgagcgctcgagttcgaatatcgaatttgaatcaaaatccaaactcagattctctccaattcaattcctctgcagaagtctatttttcctcctagttttggatgggccgaatccctctcccctcggcccatctcttctcttagccgttgcccctcctcccttcccacgtgcgccgcacgcgagctgctcgggagagagagctctctcattctctctcggttctctctctctctcctcttgccacactatacgccgtcgccgcgattcgattttcgccaccgcctttgaattcccgtcgcacccttgcgtccgcgcgtgctcccgcgtcgtggccgaccgcccggccgctcgccttttgccgtcatccatggctccaccactagcttccaaagcaaagaggcagtgccaccctcctctctctctctctctctcaccaaaatggcaagagaccgcgaccgcctcgtccccttgaccgcgccagcccgcgctcgcggtttgattctcgccgtccgatccaccgcctccacagcgcccttgcatccacgccgtcgccgcttttgcactgcctacgaaaccgccagctgccgccttgaccgccctaagtcggtttcctccctccccaaatcgacatccccctccgctataaaaactcgagcactcccatctccctcgttgtctcgcctcctctcctcgccacaccattgccgccttgaccgccgttgtcgtcgtcgcgcgtgccgtgggagccggcgagcgcgaggagccaaagaggagctccgggccgccccatcttcacactccctcttatcttccccgacacactcgcctcgacgccgcgctgcctcggcgtcatccgccgtgcgccgccgctcggtcgtgtgccgccatcggccttccacccctttccatcctcaaatcgccgccgataccgtttccgcacgccggtgagctcttcgcccaaattcttgccatttgcatcatcttggataagccccgagtcattcggttgcttgctcgtccccctaaacgtgccaccccgccgttgctatgcttcgccgccgccacgcccgcctatgcgccgccgtggaccccctcgccaatccctcgcgccaccaccattcttaagctccctaggaccaccccaaatcattccctagcgccgtcgacgccgccataagctcgccgtcgacgccgcttgaacccacaccgcacctcgccgtcaccggcttctctcggagtccctctgctccatccgacactagaaacgaaacccttgagcaccggagatgctcccgctgccgcgaatcggactcccgtcgcccgtcgacgaatcccctcttttgccaccgccggaggtcgccgccgcgattcgtcgccgtcgaagctcccccggcgcatccgaaccaagaaacgacaccctcaccttgtcctctctcccccggtggtcattcctcctcccgccgcgcctcgtgccgttccgccgacgcgcgctggcgtccgccgttcatccccggccacgggcttcttcctcctctcgccacccacgtggcctggcataggtgccacgtcggcttgacccggtcaagccggtcagccgctcgccctcgccccttcatccccgtg

SEQ ID NO: 53933 - DNA, 5302 bp, Oryza sativa
  unsure (1)..(5302): unsure at all n locations
nnnnnnnnnnnnnnnnnnnnnnnnnnnnnnnnnnnnnnnnnnnnnaatccgatcccccctttattttcttttccaagggaattaataattccttttcctttagacagaaaaccaaataatccttagaaaatccatatcttctcaaccgctcctccgattgactccgttccacttccaataattccgtaaaattgagatctatctaatggcactattaattagtctaaatagggtttttcttttggtatttttttaggttttcgattgtttgcgtatagtcgcggttaccggattttcgtcgatcatggttttcttgaagattcgtgaagctttgtgaagaccttgagcaaggcaagtcaccctttgacaaattgctcctataattggaaaatcattattattttgtttgcaacttgcattattagaatcacacacttaacttgcttggcctcggtttgcgtgccaaaccgacggacctacccagtagtcgcactatttcctgtaggttgtactaccctgattccttgtcgctctacccttgtggtacttcggtatccgtgctctctgagcgcgtataccaaatatcccacatacaccgttgattgtcgaaaacttgggaaatgggtttgagaagccttgaaacccgacatgtggtgtcggtgtgtttaaaaataaaatgaattgtgaaaactcgcgatgcggggattgtgcctacgtggcactgtcccgtattcgcatataaggaccgattcctgtgggaaactcatcgaacataatcaaagtgcaaccacaaggtggaatgggacaccctagctaagtaacttgtcggttcagggaaacctcgcatgccaatagttgggaacgccggggcggggtcggttggagccaaaccgggttcctggtaaggcaagaacgagaaacttgctaacttaccgatcgaggtggttggagtttgatttgtgaaaactaaaatggcctaaatttatgtgaggatttgatccttctatgtggcatgaggtatccctgggtcggcttgggaaaggctttgttgcgaacctccgacaccgacgggtgttcggaataagttcgtatcttgtgggtaaagtatacccctctgcagaggttaactaactgttcgaacagccgtgcccacggtcatgggcggatgtgaggtggttcccgttgcgtagatttttttgcctgtgctttgtgaaaagttattgtggtgtgggaatcgtaaccagaatcagcctatgtggcagatggatgacctgagtggtcagaaacgaatctgtgtgattcgggatgtctgcgggcatcatagactaggcttcccgagtgggagcggattgttgtgctgctgggcagcaggactctgggagtccgagaaaaaggaaaaaggctctgggagccgcttaatcaagtgaaatggctctgggagccgagaagtaatgatctgacctgggtgatcggtacattaccatttgagttgttgaaaagcatctcttaaagtcaaatcgagacgcaagtctcttttcggcccaaacttagaaagaaataaatcacttagtgatttcaaaagtggtttcaaacaaaggatttgcaaaacaaccttgcctctcttccaagcttgcatcagacacctaaattcccgtgacgtgctgagtacgaaagtactcacccttgctctatataaatatatatagttcctccgccctgaagttgaagatgaagtaaagtgaagattagggtttcgtcctggttcccagccgtcgcctgtggtgttgggtgttagttcgttggttccgccactgctgctgttgttggtgtttcctcgtccgcgtcgtcggttgcattctcgggctgttctgagctgcaacctaagttaaggtaattaagtcctctatttattttaaggattgcaatgattcatatttgtcaccgtgggtaccagcactatgtcctgggactggtactgagatcgcggtttcgttggaagcggttcacgccgtttttcctacgacacgctcctgtcaggtgccgttgtacggcggtgccggattggggtgtgacagatagctaatacttaattaattacgcgctaatatatcggtctgttttccgtgcgttactgttccggttgggatccggagatagcgaacacagccaggcaccgttttttcagcttatagaaagagttacttgatcagttttcatgtacaagctttctaaatcattaaactgtgcttttttgaatgaaaactatatatatttaataaaataaaataaaatatatttttagatctgaagcagacatgcagttgatttttaattaattatgtgctaatctactttcttgatttagtggctgcactaccttgggacatgataaatttatagcgtctttcatggcgatatatagcagttaaaaattgacctgtttacggcaaccaggagcctctttcgcacttgagcagcgtcaaatttgcaaaatattcagcttaaactaccaaagggaaacgagtgtcaagttggtgtaagaatcaggcaatatattctctgtacggacaaatcagagatatgatctggaggcagtcgaaacaaacacgtcccagatccagagggagatcgatgcgatgcgatgcccacgaactcgacaggctaagagggaatcacttttggctaggaaggaaaatcaccaagcttcaattatgcagatatggaatgttcctagttaggcagctaggacctcactctttagggcaagttctttaggtaagtactataagcctctatatattgcccctaaatttgccatataaaattaggtgatgagctagaggagagaagttaggagagagaatgagccacctctcatgtaagggacaacctccacacaatctccaagaaaaatataagatgatgtgagagtaaactaatattagggtttgtgtactagaggtggtatgttgtacttgttacctcttaattaataagaatatgacatgatttaaattagatgtggcacacacctccattataaaacttgcccttaccctcccgagcggccacagtgcaaaaggtgttgaaggttcccacattgcggctttgcaaacagtgtctgatcatcatctttctgcagggtttcaaaagcagaaatttgcagcttcaagaaccttcctggagacaaaatcaactcgtcgaccaacaatccaacatatccatatggttcttgttgccctggagagcccaacacaacaacttaaaagaataaaagcattgtttccatgatttccaggatatgttttattccaggatttgagatggccgcactttgtcatggatggggaaaaaaagaaaggaaagaagagaagagcatcatgaaagcaaagatgatagtagtcgccgctgctttagctcgtcacctttcaatagctacctaaaccaggcctagtaacttttttaattttgagtactactgcactcaacaagttaaattcagtaatccagtcaaatgtacatgcagatcgacgagacattatgtaagcagcatcgtcaagagagtctacagactacagtaatatactagtagtgaattagaggtaaagtgaagtttgtttaattacagcggatgcatctcctggtcggtgtcagagtcgtcgtcggcctcggccaggacgtggacgtagcccttggcctcgaactgggcgcggatgacatcctgcctctggcgtatggtgacagcagagttcttgatggagtcgacggattagagcaagtttaatataatagagccaactacgagcttatagcttatattaagagggagactagtgcacggcattccgtctgaatgggataattaaataacacctccacctccccgagcaagatatggataaggatcaaagatggactcggctagcctgacgtaccaatatgcatggctctcacaaaaatctgcatgtaggaattaatgattggccccacatgcatctagcgcttctccttgagtttgtaggtcagaacatgcatgtgtagtgcatcatcaactattttattaccacgatattctactagtactaaggataagacgatttctaataggtatcatatgatacttgggagatatcaccggtgatacttatcaggtatcagacgattccaatcagatttcacgcgattttcaccaggtatcagttaatacttgcgaggtaccacctgataggtatcacctgataccggttaggtatcaggacatgatacctgaaagatatcaagacctgatacatgtttctatccaaacggtgatacttatcaggtatcagacgattccaatcaggtatcacacgatttctaccaggtatcatataatacttgcgaggtatcacccgatacctgataggtatcacctgataccggttaggtatcaggacgtgatacatatttccgtccaaacggtgatacttatcaggtatcagaaactggtatcaggattacctgatacatatttctgtccaaacggtgatactcatcaggtatcggatgattccaatcagggaccacacgatttctaccaagtatcaagtaatacttaagaggtatcacctgataccgtttagatatcatgaaacctaaaagatatcaaaaactgatacatatttctgtccaaaaggatatggtcctgtacaattcccggaatgagaaaagcacaattaaagtccgatgtcttctcagtgtgaacatgcacccataaatacactgatttgcctagctttatcatattgtattgtcaccaactcagatattgatgtgacatatctgctcgtgtcacgtgcccacgagcactcatgagggttgcaggtctgcaacacactttggttagctgctcgtgtccgcgtgtcgctggagacatgtgtgcacgaaatcagaccgtatcaaggaagtcatagaatacttccttaaactattccatttggacggtatcccatacagtagtttttctcttatattaaagttaacatgtatagtaagtgagctacaaggttatctcttttttttctcctcctctctctatctcttacctatacatttaatgtatttatcttgaagtatgtgaatagctagctcttgtatgagagctaaccctctccaattttcaaattctctttcattcacataagcttatagttggcttatagcctacaagtatacttgctcttagagcaggatctcgttgtgccgtgcaggcaccacgtcgctgcccagcaccttcttgctcacagaagcagcctctccacct

SEQ ID NO: 53934 - DNA, 1837 bp, Oryza sativa
ccggcgcgaggaggtccaacggccggctggcgatgcggcggcggagacacgggagaaggggaaggcggcagtagggcgaggcggcgtcggcgggctcgcggtggcggagtgacgacagcggctgcgacgcggggcgaggaggtcggatggcccgccggcgatgcggcggtggcgcgcttgtagtagtcgtgcccggcgcccatgagcccgccccaccattccaggttccacgttgtgtgtaaagtgtgtgtgagagagagagaggaggaaaggagaggaagggagaggctggcttgctgacgtggcatcctgacatgtgggacccatatgggtcccacgttgactcagctgccacgtcggacaaaactagggtcaaaaccgctgagggacctagtttacactggttttgtaagttgggggatgcgttatattcggttttgcggttgggggatgattttgtaagtcgatgacaagttgagggaccttcggtgtactttttcctctcctctcggacgtaatctgactcggacaagcccagcctactaggccacacccggacttctgcaatcacacatcctcaccattgttaggaataagttcatttgaggccccttagctttacccgaatccgatttctgtcaatccaaaaaccagatacaaccggtccctgaactgataaagccgatttttgtcaccattgttagctgttgttatggagcccccaaccaactatacatccgccactgattaagaattcaaaccaatattgatttggtggtaattctctatctagtactacatccgtcccaaaataagtgcagccatgagaatccgtatccaatgtttgatcgtccatcttatttgaaaaatttatgagaaaattaaaataagttagtcacacataaaatactatttatattttatcatctaataacaataaaaatattaattgtaaaaaaaattcaaataagacgaacggtcaaacgtgagacataaacagtgcaaaactacacttattttgggatggagggagtacattgtctatttcatggtcataaaaggaccttgttcacactagacagcaagcagatcctcgctgggttcaaactatcgatcattttcgttattggtactggggataccgatataaaatttggttaaactttgcaatttttttaaaaaaagagtccaaaacttcggccaaataatttcgtatcggatggaggacgatagaaccgaaatttcctgatcctcatcgatttaagccttgtttagatcctaccctaaaattttttaccctatcacatcgaacgtttgaacacccgcatgaagtattaaatataggctaaaaaataactaattgcacagattacgactaatttacgcgataaatcttttaagcctaattgctctatgatttgataatgtggtgctacagtaaacatttgctaaggatggattaattatgcttaataagtttgtctcgcagtttacatgcagaatctgtaatttgttttgttattagactatatttaatacttcaaatgtgtgtccatatatccgatgtgacacgccaaaacttttcacccctggatttaaacacccccaccctggatctaaacacccccttacacaaggggcttaaattggccaacaatggaagttccatgttttccggtatgtgttctactccaagatttcgatcaccagcactttgtcatggatgggaaaaacagaggaagataacatacatcctctaagtgaagaaagtcataaataatactccagtgctagaaatatattcatatattctctgtagacaaggacatgagggctt

SEQ ID NO: 53935 - DNA, 4744 bp, Oryza sativa
  unsure (1)..(4744): unsure at all n locations
atttcttggtactgcacgaagatcatcttatccagaacaaacaatattacctcttgctcctgccgagtgggactcgattgatttcaccatgagattctctaggaaacacgcatgtatagagaaaaggtgcctaaatcaaaccaaggtgaattaggaggtggggatttacaacgaatcttctaatgagggggcatctctcaaactcagagtgatatttgagagtggtttttgcaattttcccttaaaaataaaacacagtgttgcccatatgacaggcagcaagctagcagtaaccaaatgatatatacgtgtggcataagacttatgtgcaaaatttagctacttcaatataatacttctgcaatcactatgctcagtacatatactccatctgtttctaaatatttgacgtcgttggcttttttaaatatgtttgatcgttggtcttattcaaaaaatttaagtaattattaattcttttcatatcatttgattcattgttaaatatacttatatgtatacatatagttttacatatttcacaaaattttttcaataagacgaacgataaaatatgtgctaaaaagttaacggtatcaaatatttagaagcggagggagtaactaattattttgatcggcactaatttctggtagaaagatgaaacaatgtacgtacattcagtgcttcagtgagcagtgggctaatataaattgagtggttatcagggcaaatgaggcttgctacaggtgcttgactgagaatttatcaagtttctagggtgcacgggttgacagatcagtttatgctgctataaatttgaggagttagagctagcaaaaggaaataaggtatgtttgtacttagtttcctaattatgattgtgtatgcattgatgaatttgggaaacctatgcattgatgaatctggtgagcatagtggacttctctttttcttgacacaaattcatccatgtccatccattcggtttctcatctcagtggatttagagaacatcatcatagtttgtaaaaactccttacagataattctctatgaatgcttttagagttcaatttatacattggatttagcttgcatggtgtgtcgatgcattgtagagtgcttcgtaagttcttcgaatgattctttaccaatatgttatttgattgccccatagagttttcaaggttaactatgctccacatgatacacaaactcaattttccctctttcattgtatatcatttgttttgcgaacgcaattgtatatcttttatggcttttgaaaattttggcccaaccaatccaaatccaggtctttttcgtagactggctctatcttttctcgtcaaaaagaaagtatttatataataatatatatatatgttgcttgctctacctttattcttctttttttacgtagactgattctacctttttccgtcgaaaacaaagtatttatgtgacaacatgcagctagctagcttcacattgatagcactcccactccataacaaacacaatagttggctttggactgtttgctaagctactttattaattatagacaaaattacagagtgaactcttttatcaggtgccatgcatgtgaaagttccactccatccacctctttaaaatccaccctcttcattagtctttgcactccagaattgggcaataatagcttgcaatggcggctcatcatgtcatgagcatcgccgcagcagcagtagccatgcttctcctgatggcgtcgtcgccggcagtcgccggcacggcggtgctcggccggaagggcggcgccatgactgacgacgatgtcgtgggagggcaggcggcgacagggccggggaagtacgccgtgatattggacgccggcagcacggggacgagggtacacgtctttagnnnnnnnnnnnnnnnnnnnnnnntcaagatcggcgacgacatcgaggtcttcgccaaggtaattaactaatctactactactataattaatctacctctctattgattactccctgggtgatttttttttaagaaaaaaaacataatctctctataaaaaagtataaaacgtattaattttatttcgttagaataagacactaataaacaagtaccgtattctaataggatattattttgtggtaaaaattaatgtgagtatattcgaaaatacttaattntaattacacatttatgtgtagtatagtaacgactggtcgtggagtttcatcctaaccaactaaaataagtcatatatttttatatttttttgatagagaaagtacttgtaaagataataaaaaaagtttctttttgttgtacaggtggtttctggactgagctcgtacgctggacgaccgcggaaggcagccaactccatacagcctctgcttgataaggccatccacgttgtccctaactggcttatgaagaaaactccccttaaacttgaggtactacttacctaacaatttcanatattgttcttcatctaatttaacaaaacatgcaccgctgccatacaattattataacaaaatttaagttttctaaaagaacaggattcaattaaatatttgatttggcccctcgttctgagatctgtgcaactagttcaaacnaaatcaatataatatatacacaagaaaaggcaatgatattttgggctctgtgatgaagtagttttcttggatcctttacccagaagttgaatactccatccgttcaattttataaggcatatttgatttttaaaaattcaaactttgaagattttgaccaaagattagtaagcgtacaaataaatttagtttataaaagttaagcctatagatttgtatttcaaagagctttcacatatataatattggtttcatgcccattaagaatatatattatgagaaattgatggtcaaagtttagtcccgaagagtttttttattcgaaatacaccttacggcttgtttggtaactcgatggaaggggattgggagtttatacaagggaattgatgatgagattaagataagaatttgatttttaatcccaatatcttgtttggtagaggagatggaaattgatagagagtttagttggagattaggtcattaataaaaacggatggctgagatttgcttagacaaagtaaaggataaatttcctcccaattacctgcccctacccaggtattgaaaaggagggagttccttcctcaattccccatccctatcccaccaaaattctcatgtctcccaaccaaacaaaacacttaatagcctcatcactctaaactcccaatccctcctactccctccaactaaacgggccgttatagaactgaacggagggagtatcgatcattcaagctcaaaccattttcctactaaaatattgtaaaatgtttctaacttgctaatcaaacatttaaacctacaggcaactgctggactcatacttattggagatgaaaaggcaaaccagattcttgaagcggtgcgtatactttaagaaaaaaatatactacataaatgaaatgccttcagaccacttacttaatttgattcatagtacaggtcagagatgttgtccacaccaagagcaaatttcagtacaatccaaactggatcaatgttcttacgggatctcaagaaggatcttacatgtgggttgctcttaactatcttcttgatagactgggtgaagattactcgaaaacagtaggcgtgattgatcttggaggtggatccgtacaaatggcctatgccgtctcatcaagcattgctgctaacgccccagaggtgcctaatgggcaggatccctatattacagaggagtatcttaaagggagagattacaacatttatgtgcacaggtaagtaatttccttctctgatagtattgttttagatgcatgtcagtccacaacaatttggtgaataactggtgatgatgaacacctgcagcttttttttatctgaatttactgtaaataatatatgggaagcaattattcatagtttttattagagaaattttatgatctttgagaaagtacctagagatatcaagatttttcactgaaaattttactacctcgaagtacctggtatctagagctaccaaatttcacactagaaaatatggtatctccttaaggatttacacttttactaagatcaatcagcaataacctgcagttacttgcattatggcgctcaggcttctcgcgtagagatactgaagagaaagaatgggccatttagcaactgcatgttgcgtggattcaaaggtgtcaagctagttttccttatttagttcaagatgcaaatatagacaaatcaaatgtttggccaatgcttaataattaatcaagtgatgtttattttatcatgggacaaataaaaggcaaattcacctacaacggggagcagtacgaagcaatggcagcaccacaaggtgcagactaccacaaatgcagacaagatgtggtgaaggcactgaacctagactcgccctgcgaaaccaaaaattgcagcttcaacggcgtgtggaacgcggcggcggcgttgggcaggacgagatctacgtcacatccagcttctactacatagcctccggtgtacgtctcattaactaaccggtttatactggagtaatcaatttatcagnnnnnnnnnnnnnnnnnnnnnnnnnnnnnnnnnnnnnnnnnnnnnnnnnnnnnnnnnnnnnn

SEQ ID NO: 53936 - DNA, 762 bp, Oryza sativa
  unsure (1)..(762): unsure at all n locations
nnnnnnnnnnnnnnnnnnnnnnnnnnnnnnnnnnnnnnnatatattttggtgggaacgggaaaaaggttgggttcatagatagcgaggctcccagtgcgaagtcgacccctgcaacgtttaaggttgttgcagaaaaggtttgcagaatgagaagcaaaagcagtataccctaaagttcgtggtcatgcctacttttgcatggatctcatatatgaatactctttgctcgttgatggcttgggaacataaaaatgtttatataggacataaatgttcgataatataattgacatgagtgcactaatatatatttttggtgatcaggtctggatccaaataagaagataatgctggtaaacaaggtgaagcatggggagtactacattgacgcggcttggccattgggtacagctattgaagctgtatcacccaaaaaagggcttcaatagattgatatgaacgattttaagatctactactccctttgtccaataatatggtaattgaatactaaatggaacatattgtagtacaacgaatctaaacagatcttttatccaaattcatagtaataaaatacatatcatttgatctgatgttagtagatctcagatttatatattttaggatggatgtagtacttacttagaaagttaggatatctaatgttgtatgatcgatgtttatatgatggttattatagtaacagagtaacatacactatgttaatagtggagctagctagcagaatacatcaaggc

SEQ ID NO: 53937 - DNA, 960 bp, Oryza sativa
  unsure (1)..(960): unsure at all n locations
atttgtccagtgtactagaatttgtccagtggagactttacaaaattttccatatgcttgatagactcattaaagcttaatcattatgcccacactttggttgcatttaatatttatgcatttatagtcttatgttttgaccagcaaaggtgaccaaaaagtaaggaagtgaaagcggagcagtggaggccaccatcccttctctgcaacacatcaacttggcatggcagattcaatgcttagcacggttccttcatggctccccgtagggtaagtgacttaactttccgtcgttcataattttgacgtagttgtatgcgtggagatcattttggttgatagatacatacattgatagatacatactattgtgttcatccacaggatggaccccttaactacatatttgttggaaatcaaactagccggggatcgaaaaaatgctagggtggaatatgattggtttattttcagtaaagtgatagactcaaatgcgatgtgctacaaagactttattgatgatattgcgaagtcatatccatgggggccaaatgaaactgtcacagttggctacgtggatatggttcataaaattactcatcatgtcacaactgaccaggatatgcttgcaatgtttgaaaagtttgttgatatcaaggtgattccaatgattattcgcatacatggtattaatgaaagtattgatgagttagaccacactcttgttaaagcaagcgcatgtgatcccgatactccttctttggcaaccccatctcaagtggatttcagccaacctagcagcagcactcttccttctcatgtcattgtgccatcagacacatacttagtaaacccattttctatggctgaacatgttggtgttgatnnnnnnnnnnnnnnnnnnnnnnnnnnnnnnnnnnnnnnnnnnnnnnnnnnnnnnnnnnnnnnnnnnnnnnnnnn

SEQ ID NO: 53938 - DNA, 1282 bp, Oryza sativa
  unsure (1)..(1282): unsure at all n locations
nnnnnnnnnnnnnnnnnnnnnnnnnnnnnnnnnnnnnnnnnntgcattctttaacccgaagggcattgttgtataacaataagttcctatgggggtaatgaacgcagtgttttcctcatcctccctagccatgcgaatctgatgataaccagagtatgcatctagaaaacacaaaaggtcacaccccgcggtggagtcgacaatctgatctatgcgaggcagggggtaagggtccttaggacatgccttgttaaggtcggtgtagtcgatgcacatccgaagcttgccgttcgccttgggaacgacgaccgggttcgccagccacttcggatggatgacctcacggatgaatccggcctccagaagtcgcgccacctcctcacggatgaaggcttgacgtttcggggcctgccgccgcactttctgccggaccggccttgcgcccggccgcacggcgagacggtgctcaatcacctccctggggaccccgggcatgtccgccggtctccaggcgaagacatcggcgtttgcccgcaggaaggagacgagcgcgtcttcctatttgtcgtctagaagaccaccgattcgtgtggtcttggacgggccgtcgcccagggcaacctccttgaccgggacctcgtcacacgtgatcatccgctgcctcggggcggcagggacggaggtgctgagcctctcgtcgccaccctcgggcttggacgccgcggcgaggtggtccgcgcgctgctccatacaagcgagcgcgactttgtggtcgccatggacggagatggggccaccgggacccggcatcttcatctggagataggcgtagtggaccgccgccatgaacttcaccaacgcgggcctccccaggaccgcgttgtagggcagactgaggtccgccacatcgaagttcacccgctccgtgcggaagttggcgggtccaccgaaggtgaccgggaggtcgatatgacctagcgcccaagtgtgccccggcgtcacaccaatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaagtgagggcaacctccgaccaccgcgcctggcgcgtcgcctcatgagtaggggccgcggccagaagctctcgcttcatggcc

SEQ ID NO: 53939 - DNA, 1005 bp, Oryza sativa
tggggctcctcaccgggagaccgcgcaggcccccctttgccggttcggccgggggcgctaagtgaggttcttcaccctcgatctgtggaatgttcgcgagagagcaaatgcacaagacacgggcgatgtagataggttcgggccgctgagaagcgtaataccctactcctgtgttctggtggatctgtgtgtgaaagagttacagagagccggagagcaagagagttcaggctttagaacccctcttcctctttctctcctctacgagctcaggtattctcagagtcgtctgagagtctctcccttttttttctcgtccccttgcttcggtgggcaaggtcctccttttatatctcaaggggataccacatgcaccatttttacctactcttcttttggatggggacccaccctatcttgaccaaaacttggctcgcgccttcgcctggaagctaaatcacagcttgtccttgagtgaggccttgcgccgtcactcgcctgacacaggggatagccctgtcattccttcattaatgggtggagatttgcaatggccgctgtccgaatgaccctccgatgggatgggtcatacctacctccactccgccggaagcagatgcaacgtgggagcacggttgtctgccgatgacgtgaccggcgtcagaccagtcacaaaccagtcattcttgtctaccacgtgtcagtttagcatgccacacgtctgcccttcttcatacaatgacttccttgtaatggttgcgatgaagcctggtatgaatctggccgggactgacatacccactccaggagctagcacgccggctccggctagggacgagtgcctagaggctatcatcatttcgacgtgacggggcgaggcgtgtgacaggccgcctgttgccacctaacccgcgatctgaccggtctgtgaccggtcacacactgcgactggtcacggaccggataagcgcgcactgcgccgcattaaatgcggcgtgacgcgct

SEQ ID NO: 53940 - DNA, 960 bp, Oryza sativa
  unsure (1)..(960): unsure at all n locations
nnnnnnnnnnnnnnnnnnnnnnnnnnnnnnnnnnnnnnnnnnnnnnnnnnnnnnnttaacttttataaactaaatttatttgtacgcttactaatctttggtcaaaatcttcaaagtttgaatttttaaaaatcaaatatgccttataaaattgaacggatggagtattcaacttctgggtaaaggatccaagaaaactacttcatcacagagcccaaaatatcattgccttttcttgtgtatatattatattgatttgttttgaactagttgcacagatctcagaacgaggggccaaatcaaatatttaattgaatcctgttcttttagaaaacttaaattttgttataataattgtatggcagtggtgcatgttttgttaaattagatgaagaacaatattgaaatttgttaggtaagtagtaccccaagtttaaggggagttttcttcataagccagttagggacaacgtggatggccttatcaagcagaggctgtatggagttggctgcctcccgcggtcgtccagcgtacgagctcagtccaggaaccacctgtaacaacaaaaagaaactttttttatttatctttacaagtactttctctatcaaaaaaatataaaaatatatgacttattttagttggttaggatgaaacttccaccgacagtcgttactatactacacataaatgtgtaattaaaattaagtattttcgaatatactcacattaatttttaccacaaaataatatcctattagaatacggtacttgtttattagtgtcttattctaacgaaataaaattaatacgttttatacttttttatagagagattatgttttttttcttaaaaaaaaatcgcccagggagtaatcaatagagaggtagattaattatagtagtagtagattagttaattaccttggcgaagacctcgatgtcgtcgccgatcttga

SEQ ID NO: 53941 - DNA, 1634 bp, Oryza sativa
  unsure (1)..(1634): unsure at all n locations
nnnnnnnnnnnnnnnnnnnnnnnnnnnnnnnnnnnnnnnnnnnnnnnnnnnnnnnnnnnnnnnnnnnnnnnnnagtgcaaaaaattttatggctggaggtacgtagacagactacataatcatgaaattaaattgcatctagcaattgttaattgcatcctcaccagtaagagtgaacaatcgaaatcgtaatatggtgatttatgattttttttagatgaaatactgcctgacatttgccgagcagtgttgtatggtgatttatgactgaagcagtctaattccacagttagtaaatttaaatgtactgataatgcaatagaaatgtaaaaccaaataaccataaacaacatccagtcattcagtgttcatcagcactgctgtgcttaacattacgttaaattgtgtatgcagaaactgtatacatttctttgtgtcaatatgctttttatcgcgtccaatttgatgcatagtacactttagttttgactgtgctaatccaggtcattgagtaattagtccctaatctatccatctcctacttattcttcctgtgatcattgccaccccaaactctgaggtcctcatcgatgaaaatgaggaatgagcacaggaaggataaggggagccgggaacgagatagatttagagttgataaaatgtacaaggaccatcaataaattaggaaacatagatagattcagagtttggggtgattcatgcagatgcactaacataactcagagaagacaaaaggtaaaacatagatgcagagatgacaaaatgtacaaggaccatcaataatttcgctactaacatccggtcaagccaaaaggtacaacgtagatagatgcagagatgacaaaatgtacaacgaccatcaataatttcgctattgacatcccgtcgagttgcttaacagaagatagagtagaggggataatgtggacccccgtttttataacaggaatcattcgtgtaaacagtaccatttccctggatcaagtagtctggtacagaggagttcatagctgaaataccaaaagcacatacacgggagtctagtgctaattattacatcataagcccgcaggcattgtcttaaatcatcggaccgagcggtccagaatacatccaaaagcagaaatagataaggcagcggaattcaggcagcggcatgccattgccacaggcaacgaccgtactaagacctactgagcgccatcgtcttcatctccctcctggtagtaggcatagggatcctccgaagcttcatctcccgcttctgattaattttatatttgcaagggtgagtaccaaccgtactcagcaagtcaccacagcaacaatgcatatgaaaggggtatttcaatggatggctatggctcttttgcgctaagccagttatgtaattcttttcacaaacctaagacctagcattgactgatcaaattttagtaccagtgtttgtatttaaataacgacgggtctgtccaccattcattgtgatcccaaagatagcttcccgccattgagtcgtcatggttttttgaggacgtccaccttcccttcttttaagaagtgctccatcagcataaaaatcatcatgcaatatcccatcccacacaggttaa

SEQ ID NO: 53942 - DNA, 1549 bp, Oryza sativa
ccagtgagaggagttctggcgctcctaggaaagagaagtctcacacacatattaaattatggttcaagttaagttctctctctcacacactcatggcagtcctaccaatggcgacaccgatgtagggcacgcctctcggccctacctcaacggctgtcccaccgtagcgcacctgcctcactcaggggtgaatcatctatgcagggatactgcctcgctcggctatctactccactaggtctatacccatacgagaagtgcggttgtacgggggtcgtttcatgcttaacttcatggctcggtccttaattgaccggggacggtactagccttttccagataccacccaaatcctccgtccgccccagtcgaaaacagttatttagtttatttctcctttcacaaatcatgtcctcaatatcatggcaatgtggcgctcatgtctccacatgccgcatctcaattaccttcccaaaggtaattgcaagtaggatgttcatctttgcatgcaattttatttgtaaacaaaacaatttcgcaattgggatcaatatgttcaagaatagtgatgacttgccttgctcaaggtcttgcgggtcttggccttcacccggatccgtggctccctcggtctctaaaattatgtgcgaaagaacaatttgaattcgattagaattcaaataaaatccaaataaatccaaatgaaagtcgaatgcgaaagtcgattcctttattttaaggcaaacccaatttcgattcaaactattttgcgggtataaatgttttgttgtcataagtttttaacttaatctacccgagcattatatccatataataggttagagatttctatcgcgagctaaatatcggacgaaatcctagaattattatatgatttaatttagtctatgactaaatgattaaatataatacacggctaaaatccctagtaattaaatccgaatttctaccgtgaatcgattacttatagggattacccaaaaataatctataataatctataagaattcatctatttgtttagttattaattacatctaaattactaccgcgaattgattccttatagaaattaccaagaataatccataatttatattaaattttgcaattctacgactataattaatctataattaaattctaattattttaaattttctaaacttcctaatctccctctaatttcctatttatttccttttcctttttctcccttccttttttttctttcctttcttgttcatttctttttctctttttctctcttttccttttcttttctttctctcctccctcccggcttctttctctcttcctcggcttctccctttctctctctctaggctccctgctacccggggcggcgacggcgaccgagcaaggggaggaggcggcggcttaccgacggcggtggcgtcgacgacggcgcgacgacggcgcacggcgcatggcgcggcggcacgaaggcgtcggtgcggcggcacgacggcgacagcggcgcaaggcggcgacgcacggcgcggcg

SEQ ID NO: 53943 - DNA, 5492 bp, Oryza sativa
  unsure (1)..(5492): unsure at all n locations
nnnnnnnnnnnnnnnnnnnnnnnnnnnnnnnnnnnnnnnnnnnnnnnnnnnnnnnnnnnnnnnnntccttgctaaaatccagcgcacaagctctcagcatgtcctctaggacctggttggttctctccgtctggccatctgtctgtggatgataagctgtgctaaacgcaaggtaacttcctagggcttcatggactttctcccagaaatgtgaggtaaactgtgtgcctcgatcagatataatcctcttaggtacaccatgaagacatactattctggtcatgtataactctgctagcttggcactgctgtaatttgtcttaacggggatgaacctcgccgtcnnnnnnnnnnnnnnnnnnnnnnnnnaaatggaatcatatcctgttgcggtcttgggcaatccaacaataaaatccatacctatctcatcccatttccactcgggaatcctaaggggttgcagcaaacctgccggtctctagtgctcagccttcaccttctggcacacgtcacagagtgctacgtattctgccacatctctcttcatgttgggccaccagtatacttccttcagatcctggtacatttttgtacttccggggtgcaatgaatatgccgattcgtgagcttcctttagaattaatcccctcagtccaccctgtttgggtacataaatcctctttttataccataggacatccttctcgtcggttgaaaattcctttgcaaatcctgcagctagacgttccttcacctctcggatttcctcgttgtctttctgagcctcttctatttgggttctcagaagaggttgaatgtccagggtgtttacctgccctcgaggcactatatgtagatttagctgggccaattcctctttaagctcaggtgccatcccttccatttccaaatgattgcaatggctcttacggctcaaggcgtcggccacaacgtttgctttgccggggtgatagtgaacctcgagatcgtagtccttgattaattccagccaccgtctttgcctcaagttcagatccgactggataaaaatatacttcagactcttgtggtcggtgtagatatcgcaatggtttccaatcagataatgtctccaaatctttagcgcatgaaccacagctgcgagttctaggtcatgggtagggtagttttcctcatgtggtcgcaattgtcgcgaacctcgagatcgtagtccttgattaattccagccaccgtctttgcctcaagttcagatccgactgggtgaagatatacttcagattcttgtggtcggtgtagatatcgcaatggtttccaatcagataatgtctccaaatatttagcgcatgaaccacagctgcgagttctaggtcatgggtagggtagttttcctcatgtggtcgcaattgtcgcgacgcataggccacaacctttccatcctgcatcagtactcctcctagtccttgccttgatgcatcacaatatataacaaagtccttcctgatgtcgggaagaactagaataggtgccgatgtcagcttctctttgagttgctcaaagctttcctggcactgttctgaccacacaaacttcttctcctttttgagtagttgtgtcattggccgggctatctttgagaacccctcgataaaccttcggtagtatccaaccaagcctagaaaactccgaatttcggtcaccgacttgggtgctttccattccataacggcctccacttttgcagggtccactgctactccaccggctgagattacgtgacccagaaaagcgacttccttcaaccaaaattcgcacttgctgaattttgcgtataacttgtgctttcggagtttctggagtaccaatcgtaagtgttccgcatgttcttcctcatctttggagtagatcagaatgtcatcgatgaataccaccacaaacttatccaagtagtccatgaatactttgttcataagattcatgaagtatgctggggcattggttagaccaaacgacattactgtgaattcatacaacccatagcgtgttgataacgcggttttggggatatcctcggtcctaatcttcagttggtggtatcctgatcgaaggtctatctttgaaaacatcttagctcccttaagttgatcgaagagatcatcaatccttggtagtgggtatttgttcttaatagttacttcgttcagtgatcggtagtctacacacattctcatgctaccgtctttcttcttaacaaatagcactggggctccccaaggtgacgaactggggcgtacaaatcccttttcttgcaactccctaatttgctttttaagttcttctaactcattgaccggcatccgatatggtctcttggatatgggggccgttccgggtatcaggtcaataatgaactctatgtcacgatttggtggcattccaggtaaatcttctgggaacacatcaggaaatcgctgcactacgggcattccctttaggggtagcatggtaaatatacctccgacacgttcggttagcctaggatcttgatccatggttgctctcatatccgatccccagggtgtggtcagggtaacttctctacgtctacagtcaattactcctctatgctttgctaaccaatccatagccaaaatgacatcaagagtttgtggtatcaaaaccataaggttggagggaaacaccacatccctaaggcgaataggtacgtcaatgcaagctgtgtccacggctatttcacccccaggtgaatgtactaacattggttgccttagtttaactctggttaaattgtgttgttgacttgctttcagagatataaataaatacgatgctcctgaatcgaagagaactttaactggagtggagttgagtgaaaacatacccattagcacgccttggtcctcctgggcctcttcagctcgaacgtggttcacttgcccgcgtccaaatccggtagcggtcctgttagtctgcggagtcctgaatagacctcgtctaacagcaggggtagtagtcccgtgaatagccgttgcattagctccggtgcgaataggtgtcttgtttggatgggggcatttgttggcaaaatgcccatactccccacagttgaaacagcttcctggccttactggtccagtggcggcctgattcggtgcaggagctcggttttgaatggtaaccggcctgtggagattgccggaggcggcaggtcgactggttgtcaccactgttggtctccatgccgaagaggttgcccctttaggacgctggggtgccggtctggggcgggcggttcatggcaagccttcttttacgattgtgctccacgatcttccggtcgttttccagcctaacgaccttattgattaaactctggaaactatcgtggtcttgtccaatcatgggcccgcgcaactcgtcattcaagccttcaatgaatttgtcgatcgtttcctcctcgtcggcaagatctctagtcgcgtagcgcgctagctgagtgaaacggtttaggtactcttgtactgtggtattcccttgccgtagtctcctgaactcattcttcttcatcagcatcaccgcggcaggcacgaagttgtcacggaaggctgtggtaaattcctcccaatttggttctccagcatcttcttctcgggctcctttgtatgtgtcccacgagtctccggctggtccttccaattggtttgccgcaaagatcactttatcggcctcacgtactcgaacaagagttagcttcttctcaatgatccttaaccaatcttcagcatccataggttcttcagctgtggcgaatgtgggtggcttggtcctcataaactctccaaagcttgatccacagcggttgccttggttatttgcaatggcttgcaaaagttgggtttgggtggccataactccggccagggtggttaggtcaggtgtctcagtttcttcattgctggttgacgcccaacgtcggcttgccatctgtgtaggttgatggaataagtatcctaattttctaactagctcttatggttctatcccattaagggagttattttggtgtgaactttgtttcgcaagcatggtggaataaactcatttataacacaacagcaataatatcgtaaataacatcacagagttccacaaatagtacataaatcatgatgcaatcgactgcacacatacgcagtccaaataaggttcatccaaaagatacatcaaactaaccatctagctactcgtcaatctaggtaaggagggggggtgtgtgtctcgcatactatccaaaaaccatctgatacgagatcgaagttgcaaggagtccgtcagtctagtcctctagccatccgcaggatcctggggcaggtagagggtggtcgctggcacgcgcaaacctgagtccccacggctcagaagtagtgacctctggatctagcttgggcctcttgcccggaggtcgtgtgctcttgcgagcagtgctgagggtgcgagggcctccgaggaaggtgatgcggggaacaggggtctcatcctctgaaggatcagtgatgtctggctcgatctctggctcggtgtcggtcccctctgtctcggagtcgacctggatcggagtctccaaactggaacccagctgtggagaaggtgtagggatcagtggagtgtgtatcatctccgggacaggtggctgtgtcgttgccgggtccactaggtaaggtgctgcctcggtagctagcatactagcctctcccagaagagcgtggaatgctggtgggtacggcggggtaaggaagaagtagcggtcacggcctacttttcaactacaaagttgtaggtcgcgtcgagggctacaattttgatataaagtttgtcttcattagagttcacatgaaaaaattatgaattattttttatataaagtttttagaccgtcatgtttagggaccggggtgacacaattgaataagttggaggacctaaacgagtgatctgcaagtttagagaccgggatgacacaatcgaataagtttgaggacctaaacggtcgatttgcgagtttagggaccgggatgacacaacggtacaagtttagggaccggtgatggactttactctatacaataacttttcctggcggaaaagccatcaccccaagccatatgattaaaattgttctttggtggatacgtgaccttgatgatttttttttgaaagttcaaaccttgaaaatcttaaatccgagcacaatcccattttgacaggttgattcataaatcatcaaaattctttacaagtgtgcagaagttttatatcatgcatttcctattgaattctgtgatcgtccgttctcatccatataccatctgtttaatctctctcgagtaatctctacctgaaaaaattaaacatgaagcacatcattaaatgagaaaaatatgctcttctaatgacccatgaattttctaga

SEQ ID NO: 53944 - DNA, 9154 bp, Oryza sativa
  unsure (1)..(9154): unsure at all n locations
agggtcttgaccgagagcaatcaggagtggagttgtgaagatatagaccgggagaaggatgactgcacaacagaagagaactagccatgagcgttgtagatagacacccaacatgtgatattgcttggcgccatatgattgtccacacaatgtttctaatgcgctcgccatgccaagctgcaatttacaacaatgtgcatatacggttaatttgtagtatatactgtttttatatgcatatcaatagatgacttatagtgcaaattaatatttagtaaaaagaagttttcataggagtgacttgtagtatggtctggttatgttttatttgtatattccgttcaaaaaatctaggtaaagacttttgctattgttgcacagctagtagacagaggtagtacaaactactttaattacagaagaaaaaaatatatatcagaagatccaacaagaatacacatgaaaaaagacccggcaaaaagaatacatgaggtagatgctatatactccttccgtccctaaatatttaatgccgttgacttttttaaacatgtttgaccgttcgtcttgtttaaaaacttttgtgaatattattaaaaaatttgagtagtagtagtatatttaacaatgaatcaaatgagaggaaaataattaataattacttattttttaaaataacataaacggtcaaacatatttaaaaaagtcaacggcgtcaagtatttagagacggagggagtactaattaatgtctggagagaaagccgtgcaagggaaggatggctaggtcaagagtctacttcaaagttttactagtaatttgaaaatccaaggaggcaaggtctcacatgattaattttcttcctgcagtatgtactatatccatttttttttaaaaaaaaaatcgagcctatagcttcttagctatagtacaacaatgctggacaagatcgaacactctgttttgaacctataaagacagcaactgaacatccattgtttgtctcaattaatcgatgggcaaattaaagcacaacaaaaaacttccagcgcgcgcggcgctgttagtctctgaatcggcacaattaagtcaaaacttaacgtcatcaaagtcagcttttagaaataaaaaacagctagttgccgaaaacacgaaacaggtaaaaagaaagatcaatttgaattgttacaacgtagtaataataatttaaacccaaaactgtgtaatgataactctgtaataataagtaaaaagggaatcagcggcatgacttaccaggatgccattgctgaagcgcatgaggacggtggagacgagggcgtagcggcgagctcggtacccccgatgtgtccgatgaacgcctggctgatgacggtgacgccgaaggaggagaagcgggcgcagatggaaggacccgccaccacccacagcttcttgttctcctccaccactcgccgcctcaccgatccaacctcttcttcctcctcgttgctcgccggcttaggctccagcagaggaaccgtcggcctctcatcatcctccgtcgtcctctccattgctactctgctctgatagctagctctccagtgcacaacaatggagatcgatggagttaataggagcaggaatatactttgagttgcagatattagtagctgtctgaattgaagaaggctgcagggagggaaaagaaagcatccatcgatgatgctcaggtctccccatctaccgtttaatggcggggccagagacgatcgagcgaggaagtacatgattggccctgtggttgctgcagatggtgggtaggtagggagggcagtgtgggaagaaattaataaacaattacacaagccctgttcttttctttaaaaaaaattggataaaattttggatactagtaacacgcttttcgtacgaaaactttctatacaaaagttactctaaaatatcaaattaattatttttttaataattaaaacttaattaatcatacattaatactatcttattttacgtaaaatacttaattatctcatccaacgatgccaaccaatgcgtcccggaaaaaggagatcacgggaaggaaaacgttacatcattgcatggagacaccatcgacatcgagtcgccgtctcgtgtcggccatcgatgaacttttttttcgaacctttttattttttaaaatttaaaaatgaactcttacaaaatttaattttaaaactagaccttttaatggtactggctggtctgatgtggcgaaataatattgtcaagtcaaatgaggatgaacatgatagtttatgatagtttagtttcgttatgccagccggggtggcgtggttaaaagttttaaattttaaaaataagttttgggatgtttatttaaaatttaaacacaaaaaaggttaataataaaaaaaatggccatcctattcatcaattcatgccctgtgaccttgttctcgtcaacccatcggcagcacaccaccaccagctaactcacgatttaattcaacatcatggaatatagttcaattgcatcaaatcatatcttctgctatctagtagctgtgtgaattgaagaagggaaggctgcaaggaaaggaaagcatgatgctcgcgttttatatccgcacgttttctaaactgctagtatgtattcttaaaaaaaagttattttaaaaattatattaatttattttttaaatttaaaataattaataattaattaattatgtgtttgtgacttgttttgttttgcgcatattttcagtcctctctaatactcttctctctaacacaacctgctgtgagattgcccctaaattatatatggttctgcagatggcgggtaggtagggatgacagagggggaaattagttgtactaccttgtaagtatgattaggattctccgacaacgagtgatcaaattaacaggaattaacagttggatcgtgtggcaaggagggcaagcacgtgttctttgctccaacaaaaagttggactccaaccaaaagttggataaagattaagatttttatggcacgcttttcaaactgctaaacggtgcgttttgtgtgaaaactttctatatgaaagttgctctaaaatatcatattaatctatttttcaagtttttaataattaaaactcaatcaattatgcgttaatatcacctcattttatgtaaaaaaaaacataatttttatcttcatcttcacaagaaaagaacaccacctaatgtgctgtcaatgttttcttatcctactaaagctttctatacgtagtccattaatgggatgtttgcccggccnnncngcannntgnnnngatnnnnnnnnnccacccctacccccacgccccccccccctccgccacccgactccggagcagttttggtccaacgtggcacacacgtggtaatccagtcagcataaaaaaataaaaaatggtagggcacttatcagttctgcatcttttctaggtcaccacatgtggacccccgtttttataacaggaatcattcgtgtaaacattaccatttccctggatcaagtagtctggtacacacgagttcatagctgaaataccaaaagcacatacacgagagtctagtgctaattattacatcataagcccgcaggcattgtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaagcttcatctcccgcttctgattaattttatatttgcaagggtgagtaccaaccgtactcagcaagtcaccacagcaacaatgcatatgaaaggggtatttcaatggatggctatggctcttttgcgctaagccagttatgtaattcttttcacaaacctaagacctagcattgactgatcaaattttagtaccagtgtttgtatttaaataacgacggttctgtccaccatccattgtgatcccaaggatagcttcccgccattgagtcgtcatggttttctgaggacgtccaccttccctcctctcaggaagtggctccatcagcataaaaatcatcatgcaatatcccatcccacacaggttaagaatttagagtctagccaagtgtaatacacgtcccggtgcacaataaccgcgagcactgctaatcgaatagatttggtttactcacactgcagtggatgtacactttacccgcactccgcgactgcccaacacatgagcctcgtcccaacacatgagacgcgccacggcaaagccttttgataacctcgcattggcagtacccgctccatgaacttaaatcctcatgcactctaggcgtccatgtttctagcagtgagaggagttctggcgctcccaggaaagagaagtctcacacacatattaaattatggttcaagttaacttctctctctcacacactcatggcagtcctaccaatggcgacaccgatgtagggcacgcctctcggccctacctcaacggctgtcccaccgtagcgcacctgcctcactcaggggtgaaccatctatgcagtgatactgcctccgctcggctatctactccaataggtctatactcatacgagaagtgcggttgtacgggggtcgtttcatgcttaacttcatggctcggtccttaattgaccggggacgatactagccttttccagataccacccaaatcctccgtctgccccagtcgaaaacagttatttagtttatttctcctttcacaaatcatgtcctcaatatcatggcaatgtggcgctcatgtctccacatgccgcatctcaattaccttcccaaaggtaattgcccaagcatatagcatttgacaaatattagtatgcttgattctagaatagcatttctaagcatttgtcatagttgactagggactcatacgtaaacatggttatgaaggaataaggggtaaacaataatcaaggcatggcataatcgcaagtaggatgttcatctttgcatgcaattttatttgtaaacaaaaacaatttcgcaattgggatcaatatgttcaagaatagtgatgacttgccttgctcaaggtcttccgggtcttggccttcacccggatccgcggctccctcggtctctaaaattatgtgcgaaagaacaatttgaattcaattagaattcaaataaaatccaaataaatccaaatgaaagtcgaatgcgaaagtcaattcctttattttaactttattattcgcgaactaaggcaaacccaatttcgattcaaactattttgcgggtataaatattttgttgtcataagtttttaatttaatctacccgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcatctatttgtttagttattaattacatctaaattactaccgcgaattgattccttatagaaattaccaagaataatccataatttatattaaattttgcaattctacgactataattaatctataattaaattctaattattttaaattttctaaacttccctaatctccctctaatttcctatttatttccttttcctttttctccctttccttttttttctttcctttctttttcttttctttttctctttttctctcttttccttttcttttctttctctcctccctcccggcttctttctctcttcctcggcttctccctttctctctctctctctcggctccctgctacccggggcggcgacggcgaccgagcaaggggaggaggcggcggcttaccgacggcggtggcagcgacggcggcgcgacgacggcgcacggtgcatggcgcggcggcacgaaggcggcggtgcggcggcacgacggcggcgcaaggcggcgacgcacggcacggcggctccggggtgacggcacggcggcttcgaaggtggcggcgtggcggcacgacaacggcggcgcgtggagaaggggaagagggagaggaagggggagatggagtggggaaaatggggaggggtggagttttataggggagaggagggggaaagaaagagaagggaaggggcgacgcgacggcggcgcggcggcgcggggcgcgaggcggcgatgggatgcgcggcgacgggacgtcgacggcggcggcgacagcggcggcgcgcggctcggggcgggacgcgacgggcggcgacgcgacggtagcgcggcgcgacggcgacggggcgagacgacgggcgagcggcgatgggacgggcgggcggctcggggcacgaggcagcgcggcacggggcgcgtcgcggggtgatggggcggcgcgcggcgcggggcgcaaggccggctagggcggcgcagcagcgatggcgacggcgacaggcggcgatggcgacatcggcgcagcggcaggcgacggcgcgacgggacggtgacggcgacggcacggcagcggcggcgcggggctcggggcatggccaggcgcgtggcaaagaagggtctagggctaggtaccgaaatcgaacacctatgaggcaatgaaaagtgacttttcctatttatcccgattttagtgtattttccatataaatttgattccacaattcctaattttacatatgtgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttatttctatccacacctaatctttattttaaatttatatttattttaccaatttgtttttaaggtttattcctaattaactattctttactcacgattaataatcttcgagatcaaatccagataaaataggcgaataagatcggcatgatgcaattaatttaaaaaggtttttgaaaatctgtatttttagagttttgattttgtcggtcgaattttcagggtgttacagataatatggtgacctggtggagttcatggttggtgtcttcaatggggatgtggcagcgaagcaggaatccaagcccagtttcagtaggccaacatgcagctggagcaagactgtaagaggcggcatcccggtcgggtggcctgagatggatcagatggcgtcgcataggcactgtattgccgatgatggcgccggcgggctagggtgcacggtggtggcaacgaattgcattcagcggagcgatggttgctgggagaaagtcggggagaggagaagcgctatttcagggtggtgcagtgtgggaggttggtaacgatcgctatttttgtttttaatcggtggttacatgttgcggagcaggagattgctaattgtagggacggatttaactcgccacataagccattggatgaaaatatctaatggttaaaagagaattatgtacaatttagtggataaaactattacattttatatcagtatatctctactatattatacaaattgaagatgtttccgctggaattttgatacgtcattcgtgttggtttttcagtttgttgtacatcgtctatacacaattcgacgtaagtatagaataactattatacactctcctcctatctcaaccactcctcctcccagcccaccccaactggcccacaccattctatcagcccatcctgcgtgcctccactcagagccgcaggtgccactccccgtatcagtgtcttttttctttcctttttttcgttttcttttctcttgatcatcctgatcctctccctatccttccaatctcctctcttttctctccatgttctcttctttcctcttagttatctctttcaaatttctgttatcataaaaatttttgttttgatattatcaatatttaaggtatatgtggcaagtttgtaactttagaaatgtttttcatctatattaaaaaaaactttcactgattgaataatcaaaatttcaatctttggtcaatgaggtatagagaaatacgcatgcgtcaacttatggaatagccacccaacgatttgtgaggctatggaaatgtgtacaaaagagattctttgtgtgatgcatgaagcgagcgcaactaggttcaatgctatgtatgattcctgattttgttttgtttgtcttatttcggtttgtcgtttaaattagtggagtttttatcaatcatgaaaattatcttcacttgttgcagtattttttgctagtatacatatagatataaaattgattctttggtgcaaggttttgtgccaagcatgaaacgctatgattcgctttgtctcttaactctgaacgcgcaatacatttagcttgtagtaatatatgcttcttttattttactttcacactatctgaactcttagaaaaaaataattatgatacgattgtgtcaggtcaaatactcaaatgtgcaccagatgttcagtcttttacatacaagacatgcgtgctcatgacacacgaacacaaccgatgatttctatgatagtaattatatatagaaagctgctatatattcaaacgtacacaacttggagtctaggacaaagagcatggccacctcgatctattgatagctcgatccgttattaacatactacttatatatcatgatactcagttatactgtaataaccagcacacaaacatcgatcatacaaaaaacgatatcctaacttccaaagtagctagtacatcgatctcaatatcatttgtatatttctcgaagccgttttttgggtgacacagcttcaatagctgtacccaatggccaagccgcgtcaatgtagtactccccatgcttcaccttgtctaccagcgttatctccttacttggatgtagacctgacatcc

SEQ ID NO: 53945 - DNA, 2899 bp, Oryza sativa
  unsure (1)..(2899): unsure at all n locations
nnnnnnnnnnnnnnnnnnnnnnnnnnnnnnnnnnnnnnnnnnnnnnnnnnnnnnngccgtcaacccgcaaggagtattcgtagataagatccatgcataagtaggcatgatcacgaacgttggggtattctacttttgcttctttgacactcagtttacaagccttttctgcaacagccttaaacgttgcaggggtcgactttgcactgggtgcatcgctgtcgatgaacccaacctttatcccggtccgatcaaaatgtatgcattggagataaaattatcaagtaaaaatattaatttatatatgtaacataattatacaaataattaaatgcacatatttaggggtatatatttacataactagtcagctagtagccagtctgaagcatgcctgagaagttaaataatttagctggctaattaattaagtaatcacgacgtacatgggaagctatgtagtagaaggcggacgcaacgtagaggtcatcctgccctgctccgccaccaccgttccagacgccgttgaagctgcagttcttggtttcgcagggcgcattcaccttcagtaacttcactacttcttctctgcacttgtggtagtctgcaccttgtggtgcggtcgttgcatcgtactgtttgtcgttgtaggtgtagttaccttgtttttgccaaatcaacaaaacaaattaaatctcacttggttcattaagcactaaacgttaattgattatatgaatcttaaaggattaaagggtcgatgcgtatagtaaacagaacaagtaataaggtagtatctagttaccactgaatccgcgcagcatgcagttgctaaatggtccatcctttctctccaggatctgcacgcgagaagcaaaaccgccatagtgcaaatagctgcaaattgttgattgatcttagtaaactacggttcaaaagactatatatgcattattttccatattttctacagtaagttcagatattaacaggctacagcctacaggcttcagtagttcagtttatttagtattcactagtacaatgtgtgcaacaaatgaattaatgttgcactttctaagtagtatattattcaccagcttgcagtggatcaagatataaaattaaacaaagatcaaattatacttaacaagagcatgaacttattaattgacctgtgcacataaatgttataatcttttcccttgagatactccttcacaacatagggatcttttccttcgggcacctttggagcgttagcagcggtgtttgataacatggcgtatgccatttgtacggatccacctccaagatcaaccacccctacggttttaaagtagtctcctcccaatttatccaggagataattcagagcaacccacatgtatgatccttcctgggatccctcaagaacgttgatccagttcgggttacactgatatttgctcttggtgtggactacatccctaacatgtattaagacccagagtactaattaaagagattattaagaataaaaatttattaagaatcaaagcaagaaatggttttgagttaaaaaaattgtatgatatgatgtatatcattgtggaattgcacgtaccgcttcaagaatttggttcgccttttcatctccaataagtctgagtccggcagttgcctagtacatgtttgattgaattaacaaagaacaaaatttagagagtacaaaaggtcaggccattttgtttcaggccattttgtttcagaggaaacatatcatcattaacattttgtcagtagttttaagaaactatttcgtcagataaaccatcatacggaaacatccgtacgtattagtaattttaaatttaagttcccgatgcaggtttcgtttaataattagataaagagcaaatcaatttagttgtgtacgtaccccaagtttaaggggagttttgttcataagtctggtaggaacaacggtgttggccttgtcaagcagaggcaatatggagtttgcggcatcctgaggacgtccagcgtaggagctcagcccaggatccacctacaacaacacacaaattaattagtcagtcagtagtaggattaaaatagctcaattaagtaggtagtaacgaatcgggatcatctagagtcgacctgcaggcgttcaagcttataaaactttctagcattgcccatattcatatatatgttaatgaatctagacttatatgtgtgcctagattcattagcatatatataaatgtagataatgctagaaagtcttataacctgaaacggaggtagtaggttagattaatgtggttaccttagcgaagagctcgatgtcgtcgccgaccttgaggaggtccagcttgttgtcgaacctgaagacgtgcacccgtgtgccggtgctgccggcgtccaatatcacggcgtacctccccggccccgctgcctgcccttccacgacgccgcctttctggccgagcaccgccgtgtcgtcagcaacggccggcggcgacaaagccagcaggagaagcatggccacgacaaggtgatcagccgccattgctaactagacaaggtgaggcgcaggtgctcatcaacagaatgcaaggggcaggttttaaagggagagggggaattaatggattactaacgtggagtttactctgcataattcagtccctaatcacagtgtccacccattagcatagtacaataatcaatcaacttttacacgggaccatgcatgctgcaaagtttcactgtgaatccacatgtgtaatcctagtgcgctagctttattgcttttgattgattagacgaactgttctttggtgcccagcgtgaaacacgatgattctatctnnnnnnnnnnnnnnnnnnnnnnnnnnnnnnnnnnnnn

SEQ ID NO: 53946 - DNA, 2761 bp, Oryza sativa
  unsure (1)..(2761): unsure at all n locations
ggaggtgggtctcgggatgagagcggcggctggggtgaggctaggaacggggtggcttcgagctcactatggaggcggcgaggtcaacggcgagctccatgacctaagctctgccgcccctattgtccccgccttcccgagccgagcaacgcgaggcgcgagtaagaagaggagcgagagggagattgaagaagaagaggtgcaaggacctccgccgccggctgcccgagcgagctccgtccacctccgtctgagcttctcgcgaaaggccaaaggggagaagaaggcatcagcgaccggatttgagggaagcggctcgctccgcctccgcctccatcaccggccacccgagctcctctcccctgctctctcatccttctctcctcgaggtatgaagacaccctcccatcatcgacaacagtggagcagcgccctcccagcaactccgccgcctccagcgccattctcggtgcactcctccgccaaccgcagacgccgccgccagtcggccgcccgagctctttcctcctccgcctccaccgccggccacccgagctctctcccgtctccaccgccagctgcccaagcaagctctacctttgctgtcggccgctcaagcgagagagagagagagagagagagagagagagagcagggggattggggagggatttggttgagggaaagggatggcaggtgggtctagggagtttttttatcttctttgctgactggattgccacgttggcgccacgtgtgcaagctcaagttaaaaaccgcttaaaacagtgctcaggggggttatttgttcggtttgcatagttaggggtgaaggatgtctggttttatagttcaggggggtaattcgatcgaccacgatagttcgggggggggggggtaattcgtactttttccttaatgtgttcacgtgttttttccttgacgacaagatctactcatttagaagccaacaactacatcgactctggatttttactttgaatttcattgtttgtttactttctacgttgtctaaacctaacacggatcagttcattataacatatgcttgcataacattagataagtcagatggaccattggatcttttcatcttaaccttgttgttcgcttgcaatgatcagtcaggtttcctacaatgttaaaacaaaatagttcaacacttgttcttgctatgttcaaaattatgaggtagaggctactgatcacagatataaacattactttgcgtcaatttcagtctattactcaagatgcataagcatgtctaaacaaactctctttgtaccataattttcaaaatcaactggaacaaaaagcgagaggtgagaacatgcatagcttaggaggagagggggtggtaatggttgaagatctcatccatgcacgtccatccattttagctttggtggccgctccaagaaacttcgggcagcatgcaacacaccatgcttactatctctatgcaataggtgtaggtagtagtcaacacaacttaatttggcagatactatatctgcgatacggttcatctaccttgttctcacctgaatatgattgatgacatattttgttttttttgccaagcttttgaaagtctagtgacacactacacgcgtgacttggtcgatactaataataactgaggtacgcaatcatgcatatttattatatatatatatttcttggtttggaactaaaaacaagtggagtactagagacaagcctttagtggcctcatcatcaatcgtttagtgattgaagtggtctctttatcactgtacataatggcagcaagcatcaagcatatatatactctcgtaaccatggtgcccatggaagaaaatggcttaaagaaagaatggaagaaaaatggctcctagatggctagccatttcaagcgaacaattgaacatacacaaagccaacacaacaaagtttttaaatttcaagttttgtatgcatgacttccatattgtgttggacttatgagtgatcagtgcaacctgctcgtgtggaagcatctttattgaatgttgatccttactgaagtttaggttcaaattagaacgaaaaacacttacgagttgtgtattcttaggttcattatgggactctatgcagataagtatttagggagtagacacatactcacatcacaaaatagtaagcacgttactagatgcatacacaccatcatactctagttatgtgaagcaagcaatcaaacgttcataaaccaaagtaagcaaggctcgaatttagatgtcatatgtgccattgttgtattcttttcttaagggttcaaatttggaaacacgtacgttcaatgcatatgcgttgtttcgattttagttcaaattgcaggggaacaaaatgtgtgccaactgtcttcttggttgattatgttatgccactcttttcttggttgtgcatgaacaactaagcaattacttaaatcaaactatatgtgtcatgcttttgttgttatgtaattaatgagcaaatatattattttaattattcaattccaagcatcaaacctataaatgtccattcttaattcaaaatccagactcataaataatgatggaagacactattactttaacgagtagaatgcactgctctatgtagaaaccttaggtgtaatcaataaatcactaaacaatactaacacattgttttttttacacacaannnnnnnnnnnnnnnnnnnnnnnnnnnnnnnnnnnnnnnn

SEQ ID NO: 53947 - DNA, 2715 bp, Oryza sativa
  unsure (1)..(2715): unsure at all n locations
nnnnnnnnnnnnnnnnnnnnnnnnnnnnnnnnnnnnnnnnnnnnnnnnnnnnnnnnnnnnnnnaatcaaacgttcataaaccaaagtaagcaaggctcgaatttagatgtcatatgtgccattgttgtattcttttcttaagggttcaaatttggaaacacgtacgttcaatgcatatgcgttgtttcgattttagttcaaattgcaggggaacaaaatgtgtgccaactgtcttcttggttgattatgttatgccactcttttcttggttgtgcatgaacaactaagcaattacttaaatcaaactatatgtgtcatgcttttgttgttatgtaattaatgagcaaatatattattttaattattcaattccaagcatcaaacctataaatgtccattcttaattcaaaatccagactcataaataatgatggaagacactattactttaacgagtagaatgcactgctctatgtagaaaccttaggtgtaatcaataaatcactaaacaatactaacacattgttttttttacacacaactaaactcccaattcatgttgaatagtccactaactttgtgtagaaaagtctaaaaatatagggaaataacaaaagtcaaatcccacatgaaagtaacgcacagagcaataaaactaaaacttgggtcaagcattgaagaatgagccaaaaaaaaggggaaaccgcccactttccctcttcccaaagccaagcgaaccatgctatttaatccactacactatttgtgagccttttacaactgtgctcccactccgctccactccactagttttttccattccctgtgtccccttttcagatctccctttccctctccaagaaaagaaaccatcaaagaatacgcaacgagataggggggagtggctactatcaatctccatgggcgcctatgaggccaccaaggtggtttttgcccggttgcaagcgcttgagcccaatcttgctccaaacatcattggcatgctcctcaccaaggataacaatgagatggacatgattcatctcgcatgtggccctgacaacctcctccaatctatcattgccaaggtgcgcaccgacctcaccaacaagccttcccctcctatggcctcctggggcttcccgtccgatataggtgaggaggcatctttctccattgacaaggtggggtgtgatggaggtgaagagttctcctctaaggagtatgattggaagttaccaatcggtggcaatcaccatcggagctttttgtcaagcaccgtcaacacccctgggtggaagccatgtctatactaccaaaggttccatcttcaaccctataatatcacatttcttagatccacacactaatctctattgtaccagcggaatgaccacccatcttggtagcgacgacatgcaagagtactcttctcgaccacctcagatagaccaaagtgacctaaccaacaactgcagtgcacgacagatctacttgaccttcccgcctgattccattttcagcaaagaggatgtctgcaactactttaggtatcacatgttccaccatagtgcccctattgatgtgtcttgtttcaatattggagcatttcataatttaatgaatgcaatctgttttggcttgtttgtgttgtgtggggacaaccagcatgtatgggatggtgcaagatgtgcgtatcccataccaggagaagcgcatgtttggttttgtcaccttcgcctaccaaaagacagtgaagctaattcttgccaagggcaacccacattacatctgtgatgcacgtgttcttgtcaagccatacaaggagaaggacaaggtccccaacaagttcaggcatgttaatcattgcctaattccactttgtatttttgcacatatattaccttttgtgagtacttctattgtttttcttaaaaattgcataaagtctattgattttattaaaattgcagaaagtttcagcaaagtgactctcctagctacatgaatcacaatagattgctttattctagggtgccctttgacctgcgacgacaccaaataggtgagcagtgatatctatgtggtgcttgtgttttgatctcttttttttaacaatttacaaggagtgttacattgtgttagggccgagaattttgtatagggacatggctagtcatgaggcatcttttaggatgaagcaagatgaacaacaacatgcgaccgagctgcaacgtcgttgcttaatgaggcttccgcttctcaatcttcaggattggggccatcatctcagctctcccatgggttcacatgtgcttctaggacaagttgataacaaatataatattaatgagaatgacaatcccattcatttggaggatgtcacattttgaggtctagttcttggtcgttgtaatgtcttgtctattaattatgttttttcggaaagtttattaattatgttgtactaaggttgtgacttcttgttttatttatagacaataagctgaagaatgagtttgctatgagggaaattgcctctactgcaatctccacagaagccaagcgcacggtcatctctacggaagaggggaagagagaatatggtcccaaggcagcaacacctaatgatgcttgtggattcctggaaaggtaagatgatnnnnnnnnnnnnnnnnnnnnnnnnnnnnnnnnnnnnnnnnnnnnnnnnnnnnn

SEQ ID NO: 53948 - DNA, 8083 bp, Oryza sativa
tcatgaggctcttttaggatgaagcaagatgaacaccaacatgcgcccgagttgcaacgtcgttgcttaataaggcttccgcttctcaatcttcaggattggggccatcatctcagctctcccatgggttcacatgtgcttctaggacaagttgataacaaatataatattaatgagaatgacaatcccattcatttggaggatgtcacattttgaggtctagttcttggtcgttgtaatgtcttgtctattaattatgttttttcggaaagtttattaattatgttgtactaaggttgtgacttcttgttttatttatagacaataagctgaagaatgagtttgctatgagggaaattgcctctactgcaatctccacagaagccaagcgcacggtcatctctacggaagaggggaagagagaatatggtcccaaggcagcaacacctaatgatgcttgtggattcctggaaaggtaagatgatgatagaaaaaggtttgctagatgaacactaaaacgtaggatatttattttggaaaaaggacagaatataccattaaacttgttacctcttttatttgctatatttttccttttttttcacatgtgtgttatataattctctctgacttaaacaattcttgctttagaagcaaatacaaaagaagataacgagtagacaagtaataatgttgatcaaatgtttttcttgattagaaggaaccaatgggaaaagaaatgcaaaggcaaggataggataaagcagttaagaaactaattagcacaataaatgcctattattaagtagtttttgtgcaagtcatgctagttgccgaaggactttctggtattgatatgtttgttgatgtttgtttttctggtattgacatgtttgttgatgtttgttttgtagtggaatggagtacaatttgcctcatagccccttctcatctcctaccaaggcttccaatgttgcagcaacagctcacactagtaacatcagcagcagtagtagccctcataaggtggcctcatctctattcctcccaacatgcacccttgagctgccccctacaactcatgcttccttcaagcgccaaggtaaaatcccaaaccaaatctcttccctaaatcactgtacatttgcaattccatgttgcatttgcaattactgcagttatataagatagactattttgttgtatgtcttcagattctctccttgctgaggagtagttggtttataagactacacatagtaaaggagagggggcttcatctttgctgagtaagtatcagtaattccaacctttttggagtgaaacaggaatcaactagtcaatattatgtactatatataatctgcctcctgtccaagtcttgatgatcgtgttattggtttgttggtgttatgtgcagggaaagcattaacagatcatacataacgagaagaatgccgacaaagaaaggaaaaaaatttagcttgttttagctatagttcttgggtatatggtattactatagtaccagtctttcagctcggtgtcaagaacaaagtatcaacttgtatgctcttttaaaagtatgagacaatataataaaaatatatcgtagctcatgtagtaataacaaatactagcagtgtgaagtggcactgctacatatacaaacattgaagagagcagtatatcagcatctgctactaaccaactgtttctatttagataaaaatgcttcacgaattgcttgatacctgggtcgtagcttgtccagaggtggcagatgttccttcacgagtggcaagcccagaaaaccctccatccatgcagacagccaagggaacttgtcgctggtgatcagcctgacaccggtgatgtcctcatatatcggaatcacatacgacagagagcccagagacaagtcgacgaacccgatcctctctccaccaaagaatttattctcatggagcaccttttccagaaccagcagctgctccatggcaacttcctatgcgtcctcctgctccttgccttgtgtggtgaaccacttccaaatcggaggtgacagctgcaattgtggatcaatgattacttgaaagtttagacttgcgaaaataaacaaaaaaaatcgctgaccttgtccagcccaaatttggaccagaaacgtgccatggcacgttcatagtgatcttcaggcaagatacggtggccggagtcagtggcggatccacaaaatcgattcgttggtgtcataacgtgtctatcggtgtcatattatgctaattatgcttagattatgatgttataacatatggataagcagttttgctataggttttgccaaaagtcatcggtgtcgcctgacaccgacctgagtactgtagatccgcccctggccggagtccttccaaacgtcatcgatgaactcgattatgacgtctgatggtttgccttgatagatcagcacagggaccttctgatgcacggggttgcactccagaagcaggttgcccttattcctcagatcttcttcgatgtcatactccacgtgtttgatccttagtgcccatatcactttgacaacgtaggggctcgaccatatgcccaacagcttcatcttctcagctccctcttctagttcttggtgatccatggttaagattgcagagcaatgctgtggagtgagggtttcagtttgattaatctgctacatagtgctaatggttttcttgtgaaggagattagtttcaaagtgtagctaactagctatgagttagctttggtagcttgattttgaagtactctgtctgcactctgcagtggcttcttgctttgacttttaagtaatatgtctgcatcatgttaagttccactctatccaaacctgaataaggcaataggtgtaaattccatcatttttattacagtattgagatatttgtttaaagatgtacaattaataaacttcaattggatgcgttgaacacttcataatctatctgctcataattcgtaatagtaactgccacttaaaatgagcaaagagcaaacaaaggagtcagacatgagcacaactatcttgcgcattacgattcagattaagagcaaaaaagttaaaagaaataacaagttcaggatatcagttccaggagattatatatatcaaaaccatactaattttctaaggtttatctaaaggaagaaaaataaaatggagtcactgggaatcagtgatgcatctcatttgcattttgcaatttgtaacttttcctctttcaatcttgataacatttggtcgacctccttcagccaacccggcaaaaaataaacgtcaatttacctacagttgcaaatgtgggttgcagcatatctgcttgatatagattctcaatagctactcaaggaaaagacaaagattcagaaatcatgaaatatatatgtttgatggcaaaactccatctttcagaaagtactgccaactgaaacttctaacaatccatcaagtggtcaaagatacacttcactaaatcaactttagttcttataaagggggcactctagggcttaaagtggttaagtgggtgtgccctataacaaaattcatcaaattaacacttgtaatttataatctgccaccgaattattgtcatacttgtaaaaaaaaaaagaagctaaaaacaagtaatatgaagaagatttcctgaagaccagacagtaagaagaaagcgaaatgtccaaatgttttgtttggtgagctattctcctcgtataataatatcacaaattcagctatctagttcaaaacttgagactggcaacctcttcagctatctcctgaagttccaatcctaaacccttcctgtacataccacagatatttcagctatcatttatcatctcaaaaaaatggatttatggagcaaaaagcttcaatcaaatgctaaattcctatgtgcataagataaaaatgtgtagttacactgcaccgactcgactccagaggacaagtgattagtacccaagtattttgaatttctgatacatgtagaatgaagtgcagaataactgcaaatatgtttgtttggttttttctattacctcgaggtggaagatgtgtgtcagccggcggccgtgccgacagcaccgccggtccacgccgaggatgtctggatgtgggctttctttacatgggctttgtgatgggcctggcccatcaccgtcagcttctccatccgtgcggcctctcttcccttcccttctccacacgaatcggacttcgggggttcttccgccgccgccgccccgccctcgccgccggcggcccggacgatgttgggccacctccggcgatcctcccaccgagtactcattgccaacctcgccgtctactcataagagcgattccttttcgctgttcctgtgctaaagccctttctctttttattccgcccctctttctttctccaaatctactagttgccggactactgcttgcctgcttgtgttcttgctccatttaccaacccagataatgtcatgatgcagccttgttttgactgtaggcacgccccaagtctgctcaacattctattatttgttttactgggcactagttgaactagtgaaaaacataggggtttttattgtctttcctctaattctccaagcagtgtgaacactttaagtaactaacccctaccctttggaggtcttcaagattctcacatcgacagattaatgtaacaagcactttgctaacggtagtttagcagtgtctgagagattagtctaacatgtttaagttgttattgatccaacatgcattcttaaactggagaataaatcaggagtttttagcctttctgtcactgtaatttcttgaagagattgcttcttgctacctttgagccattggctaattctattactaatctcactgctctctacattgtgcaggatacagagttcacaaattgaggtactattctcctttgtcctttccttcggacaacattttacacccatttaacaaagtcatcctcccatttatacacctgtttttagttcatagcaggctggtgtagcaaccataccaccagaaatttctctgcagatacaagtaatagagtttcaaatgatcgagggcatcaatcaagggagttgaaaccaagtcttgtgaaggtatgtacacaaagttaaactgtatacttatctttgtgtgtctttcatccacaagtttttaactttatgggtatttcttagttgcttagtgtgccaaattggtccagttacatattcctgtcatccttatggagttttgggataattttctatttcttcacagttaatctacatcccatgttaccatggcacattcccttgtttatgttccaggttactcccctaaggcttaacattcaacccgtttcatttttctaatccaacagtttcactaagatttctgtcattacgatggttttgtttttgtctatattatgactcgtcttttgagactgctaaatggttgtttttagacaataggcatagactgctggatgtttcacagtcctagagttctaaaagatcgatgattgattattgaagaaattgtctttgtattgcaggatgatgttgcaatcatcgaacgcatacaaaacagtacaaaggaattgagacaaggcccagttgggaaaaatctgtcatcggcggagaaaaggaaatttcttgtcaacactgtacgtgcagctagttttccatattgtctggtttattgtttgactgcatcaagtctccacgataattaggtttataattgcttcctggtacacatcaaatctattttatttttatgagtacataaatctactaactactggaacttccaaattgtagctgcttgacctggaagattcaaaagaaggtgtttacagcactctggatgcttgggttgcctttgagcaggattttcctgtggcctcaataaagcaagcacttgtagctcttgaaaaggaggaacagtggcatagaatcgtccaggtttcggacattatgatttgcttgattttaatttaactttgtggatctaatttgaaaaggaggcttcgtttgtgcacccagaattaaataaatggctaactgcatggttaggtgataaaatggatgtcgagcaaaggacaagggaagactatcagaacatatgagcaattagtgtgtgcacttgagaaggataatagagcggatgaagcttgcagaatctgggagtttaagatagcccatgatctacaatcagttccatggcggttttgccgtcttatgttgggtatttactacagaaataataagctagatagacttgtcaaggtatggatctcaagcccttgtccatcaagtaattttttattgttgtattttaagttgatgatcctctgtagaagtttgatgggtcttgagtgatcaatgatgccgcttagtctcttacagattgcatagtatgataaaacctacttacgtggattacattacatttccctgtttttggtgatgatattagctcttcaagaatcttgaagcatgtggccgtaaacctccaagcaaagatatcgtacggaaagttgaagatgcatatgaaatgcttggtttagtggaggagaaaaaggaattgcttgagaaatacaaggatttgtttgacaagccatcgagtaatgacaaaaagaaaggccggcagttcaaaaaggttgagaagaacatcaagccggcttagacatgtgatgggacacgcctgcacctctaagcttagagcatagaacggaaacatctgaatagaaatctgccagtgaagttgttactctttcctttgggatgagaatctgattatcaacagttaagattagaagtatgcatggtagtgcagttaacattgttgtgagtcattttccttcgtccagatttgttgctgacagtgcatccatatataatgggatgagaacctaatctaatgcagcaagtaatagtatttgccgtatgccctctgattgtgaatacaccttgtgtttgttaactgatgcctcatgctcaatctctggccgcgatccttcatcagcacttagaaaaaagaaggcaaaatttgctacaggacatgcaaaaaacgtgtaattagctaggagacaccacaaaaacgtgccatggctgatggatactaaaaaaatcgtgtaattgactgtaggatactggtcatattattttattatttccagatcaaaagaggtgagatattttcctaaatgcccggattgtctcttctctttccttttctcattcgccgggaacgcgcgcggtggggcgaggtcggcgcgagctcgacggcgatagcgggcggcagacgcacagcgcaacggcgaggccggcggggccgccgccgacgacggcgaggtcgacgggcctggagcaggcggggcgctgagtgtccgctgaggagctcgcgccgaggagcgggacgaaagcgttgagtgagtcggtgttcgcggcgaaggcgctgagtgtccgcggcgaagacgacaacgacggcgagggcggtggcgcgtcgccaccaactccctctccggcagcagctcacgggccatcaacatctccctggacaagaggaaaactggccagctagtagctagcagcagccaagcacacgccggcgagctcgctccaccagtaagaagatggctgctagctagctccttcagacttgagagcttgagcaggcaacaatggtgagctccttcagacttcagacttcagagcttgagcaggtagcaaggaggcagctgcagccggcgaggggctcgatctggtctctaatttgcaagtcggcgcacgcacagacgcccgcttgtgcgtgccagcaggcagtccgtcgtcagtcacaggctcataggtgcgagccagcagacaggccgaccgccatcgaagccgccgccgccggacatatgtgggccgcaagccgagcggcgcggatgggcgcccatgcgacgtctaccacgcggaagcacctgcctccaacaccggcaatggcgatggatcaaatcgatggaat

SEQ ID NO: 53949 - DNA, 2288 bp, Oryza sativa
ctaattacacaattttttaagtgttctgtagcaaattttgcaaaaaaaaaggaatatttcaatgtgcatatgtccctctcttgacattgcagtcgtgtcgtgtgtacgtagaaatagaaatagttgctcctagttgatatcggattgtgttcaccctgatttctgattcttattctgagatcgaatcggatttgctttgatctccgatttccttcctacatgttgtgcagattgctatacatgtgtgtatatatacaaaggcatagcacctggccgatcggttgaggtgtgctgcaacctgcaaaccggagggagacaaagaacatggcgattacggaggaggatgtgccggcggcgaagaagatgaagacgacgacagaggatgatcatgaggaggtgttgctggcgtatcccccgcgcaagaaggaggatgggaagaagatgaagaaggtggtgaagaggctggggaaggaggaggtggagaggctgctgtcggtgacggtgaccgtgccgaccctcagcaaggaggcgatggaggaggacgatgaggaggatgtgcgggagagggagatgctgctccgagccgcatgcgcaaggaccaggtcctcatccgctcccagttcgaggccaagggctacgtcgacgtcctggacgaggtctccgacgacgacgacgacatggagatggagccgttgtaacataacctcacctgtaatctgaaatatactggaataaaacacataccgaccggcaatttcttttgattacggatttattttttaagtagttaagatcttgattaactagacccgtcacatcagcgtcacctctaaaacctacagcatcgagcttcacaatgcaggttggaaacatctgaatatctgccagtctcttgcccttgagcttcacaatgcaagtatgtatcccccggaaaaaaaaatatggagtatgtacggtagcacagttgttggaatataaagctgtgatcattgtttcctagaactgtcgcttcaagcattgttgtcattccttttgcctccgtccagatttgtttctgacagtgtacgtatccattactcagataagagcctgatgtggtgcagcaagcaatggtatttgctatgccttctgaatgttaatacatcccgtgttttttaactgatgcttccaacaacgggagtggattctaatcgctcgaggggatatcccctcgtatacttttttcttctaaatttgatgcaaatagttgtgaaaaagtctgaaaaaaattgacaatatagagtataatggtacctgctagctagtacaccaaaattcaagttcaaattcgatctacacatcgagaaaaaaaaaacaaatttagatataaatagtgcgctagtattcatatgctgattttttcttttttatatctcgacgtgtgagttgggtttggacttaagatttcgtggagttgtatatatgtggtgtatgaatattatcaaatttttccaaatttttcataaccgtttagatggtttttatgcaaacgagggaacccttgagagattaaaatatagtttccctccttgggacatttgttattccgtcttcctctgtccagatgtgttactgagcgagcatccagaattacatgagaacctgatgtgatgaagcgagcaaattgttggtatttggcgtgccgtctgaacatgttcttgttctcttgttaattgatgcaaccattggcacatgggttaatgggccaacccaaaaaaaaaattactagctttgcagagccagccgattgatctgtcaatctgtatgacaggattaattgagatggaatcgtattcgctgttgtctcctatttcctttgtgtacaagttgtgcaatctacggtgtatataatccgattcaggaggtgtgcggctaatataatccgatacgatttcgtattcacgacccaagaatttgtatataatcggatcgaggtgtgtacatctgatatgtgttgaagatcccagactggctagcaatctgacccagaggaagacgaagaacatggcgatgacggaggaggatgtgccggcggcgaagaagatgaagacgacgacagaggatgatcatgaggaggtgttgctggcgtatcggtcgcgcaaagaggatgggaagaagaggaagaaggtggtgaggaggctggggaaggaggaggtggagaggctgctgtcgttgaagctggccgtgccgaccctcagcgaggaggtggtgatgcctatgcctgacgacgccgaggatgatgtgtggca

SEQ ID NO: 53950 - DNA, 1892 bp, Oryza sativa
  unsure (1)..(1892): unsure at all n locations
nnnnnnnnnnnnnnnnnnnnnnnnnnnnnnnnnnnnnnnnnnaaccccgcgcctgacctttcagggccatggggaagaaattcgccatgaccctgtcgtcacccccggcggcttcgatcccggtcgtgtagacctggagaaactcggcggggttgacgctcccgtcatatttttcggtgatggtaggccggaaccttgggggccaacggacatttcgaaggctcgccacaaaggctcgacagccgacaccaccaaccggggacacggagggctgattcccgcgtccgtgttgaggtgacactctggacgaggaagcgccctccgttgcgtgggtagcacgttggtcattacgccgccgctcgatgctggtgcgggcgtccggccccccacgcagatcttcccgggtcgaaggagtcgaccaacgagtggtggccgaatggcgaacggcagctgccgctcgccgcgcccttcgtcttgacaacgcggagccggtggtagcagcaccagaggccttggtggcggaggaccgcccaccagcatctaggcgctgccttgcagtcatgaccaatttggccacatcgtccagccaacgttgggctggagactccgggtcatgggcgacaggcgggtgacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtgaagggggcggtggagtacgagctcgacggcgtgggtttggctccccgtcgtcaccgctcatactcggggagaggtcgtgcgcctttgctggctcggccattgggctgaacaggaaaagcttggcgcacacgaaggagtgcgagagctcagaagatcactcgcagagtcccctacctggcgcgccagatgacggagcgtggggctcctcatcgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttggtggattcgtgtgtgaaggagctacaaagtatgagccagcctctcccttgttctgggttcctaatctggaaaagtccagtccaaaaaaacctcccatctaagtgggcaaggtcctccttttatatcttaaggggataccacatgcaccatttccctcttttttgtggggacttcccccaccttttcataaatggacggagatttgtatcgttgtcgtccgagtcaccttctgatgggacggcccacaactacctccactttcgccgggagcagatgcgacgtggaatcgtggccgcctgctgacgacatgaccggagtcagaccagtcacgtcggtcattcttgtccaccacatgtcagcttagcaatctacatgttcgcccttcttcacacaatatcttgcttgtaatggttaggataaagcctggcatatatctgatcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcatagaccggataaatgagtgcactgcactgcgttacatgcggcgtgacacactcagccaaaccgcaataaatgtggttaggtgagccccactgtgctcacctaacccatacaccccgagcgaaaacc

SEQ ID NO: 53951 - DNA, 1710 bp, Oryza sativa
  unsure (1)..(1710): unsure at all n locations
cgtcctcctccccccacgacggcgcggacgagcttgccagatccgggcgcgggctcgccggatctggcagcaggggccataacggcagcggttcctctcctccttccttcttcgtgaccgtcggcggtgaagagtagcggtggcggcggatctggggattggtcgaggcgacgcacggggctccggctccgccaacgcgtggccttggaccgtggcttcgcccttcccgagcccaggcgcggcgcttcgggcggttcttctgcaagcgcgggatcggcttgcagagccacggtccccactgccatgggtgcgcgcatccgacgtagaggtttgagaccacaagctagggtcacgcgttgtacatggccttagcatcaggaactctgttcttaaaaaaaaggtttttttttacttgccacttataacaatcatcaaagaaaatatttaatatttactatatataattttaattataggtaacttttttacgtacgttgaaaaggatgggggtaatgtctttttcatataagaatagggagtagggaaggaggggagagaggtggatagcctagcgacagaatcagttcaaggtgaagttcatattaagagatgaagggagtgggagattaagaggccgaaaaggaaaagggccacgacggggtggacgtctatgaaatgcgctactgtggattactatagctgaatatgaacttcaattttctcgttttctgttaacatgttttttaatttattaaatgatatgtttattataaaaattttctatagagaagctgttttaaaaaaccatataaatttattttttaaatttataataattaatacttaattaatcatatgctaataattttttctcgtttcccgtatttttttaattaaaacatgcgtggacattttacatacagtaaaactaaatcttcatcacatgaaaatgatattagaagatttatcattggaactattatttttagatcattgcatttttatgtttcattataacataattggaaaaggtatgtagcatattttttaaacaaattcatcaaaaagctttgctagaacatggcaccaaccaaacaagggggaaacaccagcggaaaaggtatatgtatagcaatcaaatacaaagcttaagtaaaaacatgagagagtatataggagtagctagtaactagttttgggggagcagcaaccagagtcgatgaaaatgcataatattcaagccaggcgattggtgtgtggaattgtggataggaaacgatcaaggggtggaaacagccaggctgggggtacagtactggtacagtacatggaaaaggcttgaaaggggcaaatgggatcagatccagcaatcagcatacatgtacgatcatatatatcagaccaaacatacaaactggagttgctagttgctacgaacaaacgacttgatcacgagagtatccatatcggagggtatgcatatcaatgcatgcatatatgcttgacaagcaacaatatactccctccgtttcgaaatgttttgacaccgttggctttttaacacatgtttgaccgttcgtcttattcaaaaacttttgtgagatatgtaaaattatatgtctacataaaaatatatttaacaatgaatcaaatgatannnnnnnnnnnnnnnnnnnnnnnnnnnnnnnnnnnnnnnnnnnnnnnnnnnnn

SEQ ID NO: 53952 - DNA, 740 bp, Oryza sativa
  unsure (1)..(740): unsure at all n locations
aagcagctagacttaactagccgtgtggttttaaccttaagcttccgtcttcaattcccaaaacactcataattttttattaaaagaagtgtcgggagggacatctgtccctccaaatctcgtcttttttttacttaactagcttagggtagggttaaaaatggttcagaaaatttctgatttcagacacatgtttttagaaatggaaaatatcggttagaatttttttttttggaaattttggaaacagaaataaattcagattttttctagaatggaaacgaatacggtaaggctactatccgatgaaaactagaatcgactgaaaactttctaaaaacaaattaaaaaatgaattcaaaacgttgtagtattgacaacgtttgcccgtgtagggagccttgcttgatcttccagctcgctactattttgcaaggcttatggtgaatagcgttggttgaacctggctttttctgtttttcgtagccttgtagtttagatttgtcattttctattaatttggtctagtagttgtggttttcttatagttttccttaattaactatgcactgtaaggtttggtcacgcgttttctcctcaaaataaaacaacttctttttttatataaaacgccggcaacggtctgaccgtttgaaaaaaaataaatatacgccgtttcttattactacaaaatttccacatatnnnnnnnnnnnnnnnnnnnnnnnnnnnnnnnnnnnn

SEQ ID NO: 53953 - DNA, 1520 bp, Oryza sativa
  unsure (1)..(1520): unsure at all n locations
nnnnnnnnnnnnnnnnnnnnnnnnnnnnnnnnnnnnnnnnnnnnnnnnnnnnnnnnnnnnnntcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaagtgagggcaacctccgaccaccgcgcctggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggggctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcccgcaggcctcccctttcggttggcccgcggagcgccctcgacggcgaggacatgaccctcgtcgtcggtatgggctgacctcttcttcctcctcctatcatgccgccctgtctgagcggcggatccgggggcggccgaagctgccacaccggaaccggaggggttccaggtccatgcctcctccttacgagccactcggtccgcgagctgaaaaagctccgcggtagcctggggctctttggaggcgatcttttcgagcatgcggttgtgccgcacaccccccctaaacgcgtaaatcaccgcgtgtgcagggatgcatggtatggtgttacggacttgacagaaccgctgaatgtacgagcgaagtgactcatcatcccttcgctgtactgcgtgcaagtccgcttcctcacctgggcgcggatatgtgccttgaaagttcatggtgaactgttggcacaaatcctcccaagagtggacagatgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggtagcacgttggtcattacgccgccgctcgatgctggtgcgggcgtccggccccccacgcagatcttcccgggtcgaaggatcgacgaaggagtgg

SEQ ID NO: 53954 - DNA, 15380 bp, Oryza sativa
  unsure (1)..(15380): unsure at all n locations
nnnnnnnnnnnnnnnnnnnnnnnnnnnnnnnnnnnnnnnnnnnnnnnnnnnnnnacctgttcctaagttactctccattgacaaagcttttactgtcgtagtactttttgtgactggcttctttcttctcgttccgtttctgcaaaagcaaaaccacagactaaaaatgaacaaaaccacagcacatcaatggaccagaataaataaatgcaaactacaccaagtccccacaccaaacaacatgttgctgagcgtagttatagcatgaaaaaattggtcccagagaaacagacaaatatttaatgcgcatatgcaaagggcttcaagaaaacactaacacattatcacaaacatcggtttataataaatcatgtacacacatcattaatatgaagtagacaacaggcaaatcgcatttatttgactgggattatgtattttactacatgctgcatgcaccaaacagaaaaaccagactcccacctgccaatttgacgtagcaccaatataccatgttacataacatacctggtaggcttcatggttagcaactatcctccttatgatagtactagtagtgatgtctaaagggctctccagtctacggtagatgcccatagcccttggaacagcatatggatttaaatcatcctgataggtgcacaagtaacagttgttaatgatcaatgctatacatctttatattctaagaaaatgtattgagtaagtaaccttcataaagtccatattctcagcaattgtcccatgaacaaccaacgaaatattaaatgtggtaatctgcacagaaaaaggaaattagctacctccagccacactgcaaagacacataccctgataatcataagtaacagttaaagggtatgaatttcagatggtcaatttcaatgataatattgcatacaaatacataatctggttcttaacaacatatctaacggaaacttagactacatcaaattaaacttttggaaccaagccagctcctaaacttttagtttatttgactgtgacataaaattaatgctacgtgcaatcgtgcatctgcagaaaatcatggataagcacaaatccgaccatatctgttaatctgtatctaaaatcaataatagctgtgagcaaggcttttgctggcgtagcataaatatcatgttcaatctttgaactgtgcatgcatagttgtgccatgttcaatgaactattactagcagttgcatcaagcaattcctactacagtaagagagcatcatgataaagtagaacagaaaactaaccatatctttcgaaacatcccatggagcaccaatgatcacttcatcaacataacggcaagccaaaacactcaaacttctctcatggaggttcatgattgggcgatgtggtcctcttggtgaactggcaaatacggtaaacaccaagtgcccccaaaaacagaatgttatgacgacggaattgagtagagatgctatgcttcaatacaaatacaacctgactataaactaagatgcaaaactgaaaaacagtaccaagcattgtaacttggaaaaattgagacagtggaaaaaaaaaaaccatcattattaccttatagtctggtctgtgtgaatacccacaagcaggaaatctccaagctctcgagcgaggcgcaatatctaagtagaagaaactataaatacacaggaagtccaaatcactatgtcttagagagatcatttcagtttgcacccttgcaataagaaaaagaaaaggaaaaggaaaaccacaggtaaaaccatacaaccaacaaatgcatagccaagttgctctacatgctgagacagacatttgacattgcgtttacctcaacatgtccagcatggaatagatcaaatgcaccatctatgtacactatccgagaatctggacctggaccctgcataggtaaagctgacagtcaacagaaagaataagtggccgtactcagcaagtagttttatctagtgaatagtatcaaatgtaaacagcttgaaataaatgataaacgactaatgcaatgattaattaatagttgagcttagcagcatgttagttcttgttggaagttcaaggatataacttatattctttactaatataacctcagaacaaatctaagttgtgaaataatccatttgtcgtcaggtcattcaactcaatgtttactagataaagaatgcaaccaaacaacaaatgtctttcaaatggcaaaagtattagtaaaatggtaacaggatcctgaaagccaaataactcgcgctctactgtttaaaggcaaaaaaaaaaaacatctatgaggcatttttatgctgtcaatgtttaattcatgccttcaaaaaatatgatatctcaaaaaaaatgacattcaaagttttacatgagcagttcagaaaatgatcctctgtgaaagaatgtaaagagctgtaccctgctatttgagaactgaactattctccgagatgtaggaagaaaatgagatatcctagttccacttccagatccactatcatcaattttctggccatgcccgtgactgaactgcctttgtagtgaagagtggttgtgactatcagaagctgatctctctctaacacaaagaagcattcttcctgtagtttatttactagaaagatgagctgggcagttagcatgaaaataaaacctattcatgaccataagcaatttattgatacagaagggaattatgtagttaattgtctggagagcttaatagcttatcagttcatcatataataataaagcaatagtttgaatgttttcctaaagtaccacttcaggacaaatcaggtgggcactgatcttgtctacaaacaattatttggttgacctagaaataattgtaatgttggaaattgctatggtattgagccaaagaaataacttgtaaagttgtagtacataacaagaaccatatattcccttgcgatggaagttttaggttaaatttcactatgagtaaaaactttaatgattaaaacagaaaagaacagaatcaggtccaacaatgtctgtcgttgacactccttcgggtcttttaatctgtttaaatcgaccaacctttttggcaagagcatatgcatcagtaccatctgggagcagacaaggatcatcgccatggatgatataatctatattatactcattgaataatttattcatgaaatcctcagttatggcgtaaggtgcatctggaataacatcgtgtacccattttacagcacggaccattatcaacctgtatatcagaaaaagaaacataaaaaaatcattcaagacaaaatggttttttttgaagtggaaaatatgggtatatgataatacataatacaatcaaagaaacaaaactgcaagtctaaaagaacaaaaatgcctaaaattccatatgacatggggtcacacgtaaaattggtaacacaactaaaaatagaaagaaaaaaaaaacaatatgtgcagtaactcctaaactggaaaaccagacacaatgaaagtcagtaaacaacaaaagaaaaccagcaaaaataacaaatttatagtgttgctaaaccaccatgatgatgattaaatgaggaaaaaaaggttgcagcacctaacatctaaaatgccacacataccatgtcatatgtgagcagcttgtgattatcaacaagacaaaggaaagcaaggaatcacttagcaggtacttaaggcaaactgagcagaaccaaacctgcaagtctagtatggtttatcgttaggaattaataagttttttggatttgtttgaatgtacagaccaaaaattcattgtttagtactttcagcagagcaaacctttttttttctgagtttctccttcaggcacccaaaagaaatagagctaatctttttcgttactgctcagatattgaatccgtactcaaatgaattagagaaacataagcagctcatccaccaccaaagttatcagaaacttggtccgacgactaactacaacccacatgtcacaacatttcccttagcaatttcaagtttccagatagaattactggactagtgctcgaattaagaccgacagacacatatatgatgtgtggggggaaaacgtcgcagcttcaaaaactaatctaaggatatccttataaaagtgctccactagtaacttgtattgtgcaacagtacattgaacgcaactaaagagtcgaaactgaaacaaatcagtgtgcgatacaaattaagttatgaaatagtaaaagcagtaacatattccccatgattaggacagaatcagtgtgcagctgaaattgaaacagaagataggaagtttgatgcaacagcttctcgactaaaccattaacccaagtaaaagatcgcccataaggaacaacccacaacagttacccctaagaacttgaaatgcccacagaacactgcaagatatgtagaggaaaattcactacctataggctgatttgcctaaatcattattaaagcacacaaccagtatcaggtaacagtttggtaggattacatcgtgcatcattcaagaattttttttaaaaagagaatgacaaagggtttggagtgaacctctcgtggaggggcgtgaccggcgggcccttgttggcggtgatctcgtggtcgctgacaacgccgacgatgagctcgtccccgagggcgcgcgcctggcgcagcgcgttgcagtggccgtagtgcatcatgtcgaagcagccatccatgtagacgcgcacggggcgccgtcgtccgcggcggaaccggcggcggagcgcgtcgacgggcggcagggcgggaatggcgacggggccggcgaggtggagcgcgaccacggatgcccccagcacgatcccgccgatgacgcacgccgccaccagcttggcgctgctgctccccgcccccgcctccataatgaattgggagattggacagtgcgagagagacacaacaggaaggaagagggagattggtcgtgcgcaagagggcgtgggaggagggatctagggttagggattggggcgcgtgggtggaggaggtatcgccattcgaggtgaggggagggcgcgacgcgaggagatcagggtgggagatgcgggagaagagaagcctctggttctctctcttgtctctccgagctccgcgagagagatgagggggattcgctgccacgtgggaccaatgagtcaatcagcgtggtcccacatggcggtgtgacgtggcatagcagaagaagaagttgccaggtttggcccacgcgtcagggagggagctgttgtctgtactctgtactaatccacgtatggcgtcgaaaataaaaacgacaataacaacacactaacacgacattagcatgaggatgggggtttatggattggttcagctaaccgcccgaccgaccaaatgatgttgtgctttttcgtgttgaaggatgattaattaactcgatggcaggaaattctaaccaatgtgctgtgtagctaagatcatcggatggaacttttgttgattgattaggacgttggatatgctgcccatatgctgcttcagttgcagccagcatcagatgcgagccccatacactcaggtggagcacctcaaatgtgaagatgaagctgaaaatgacatttttggtacgtgtttggttctgtttctagcttaaggccctctttatttaggcttaggtttattggcctagacttttaagtcagcttattggtttatatgatttataagccggtggatttaatgtcctaagtttagtagttgagtcatacatctacctcacataagccaaaaaagcttctccaacctagcttttggcttaatagtattagagtggcttatggtttcaaaaaagctaaacggaaaagctgcttgtttgtttaggcttagacttttcgacttataagttagcttataagcctaaacagagaggcctaaagatactactactgtctattgttgatattgaatacggagtactagcatttcttgccttcgtgatggtggtgtatgcaaaaggaaacttgatctgaatgacccaatgaaacaagtaacatagtcagcactcagcacaatgactaaggttttcctcttcttctttttttccttgttacccgggacaagtatgagtgacagtgtgacgctgacaccaattccagcaagtggtcaaagaataatagcaaaaatatctcaactatacagaaaactacgaatgaaactggaaactaatttttcaacacaaaattaataagactttggaagccagtccaatcggggcattttgtgtggttgttactgaacctctgcttcttcctcttccctcattcacaggcatagggtttcgatttcaactcatttatggggtaccaggcaaaaaaaaaatcgtgcgtttaggaagcaaggtaacagaaaagaacaaattataaaaggaagggtttttttctacaacaaactgaatttacaacatgttatttccgagtacactacacaaacaggatgtcagcaaaatacaaacaaatccctccaaactgtgattaaagcgccatctctgcttgaagtttggtcagttcagccaaatcattggctggttgagatgaagttgtaactctcgctgatggttccatgcgtgtactctgaggtggttcaggcagctcatggtcgagctcttcctcctccagatcttccagctctgcttctagttcatccttcaaaatagaaaatatgagagtcaaacatcttcggaaaattggcatcgtgtgcaattatgtattttgtgtcttggtggcatgcctatttcgagttagataataccatcttgcacacgttttaattgacgccagaggggaaagagatagatgaacagtacctcgtcgaaatcagcagaagcgccaattggtgttgcaagtgcctcctgtatctgcctcatattttctgtgtgttcatttgcctcttcaatggcattttcaatgtcatcaatactcctgtgaaagaaatgttgttatcagttgatccaagcacatgcctgatgctaactagactgttgcctcctgtatggattaactgacactcttgctgattttaactacttgctataagtttgtatctatatttaagttcataatgtgaaagacaaaaggaacaacaatacagtagaaatgtacacacatttggcatttagagcatcttatgcttctgaattcattgtattaacgattcaatttcagaaaccatgaatggagggcaatcagagacttacactgactgatgaatagctttgacagcagatgatccagagcgcaaagcatcaacggtatctgtggttgcctttgcgctctcaagcattattatctaccaaaacaaacaatttcctgtcaatttgaatttataacaaccttctggaatatcagaatgcttcaaaagtcaagattgaatatgcgcccatatatctcatcacctgatcatgaactcgcaattggaaatttgctagctgctcaatttgtgtttcatacagcttctttttctttagacactgaattgcagctgcaacaaacaggtactctctcatatagtttatagaagtgtcacaagcttgagaaatatttttctcatcattaaggaaccattaccataggtacacatgcaagattactgacccacagtttttctactctgtatcatacatgagttgatgtgcaagattactgacccacatattttctactctttatcatacatgagttgatgggtaatgtaagacatgaccaggaagcttgtatttggccataacaaaacagggtaactgctattgttctttacaggcttcttaatctcctagttgcaaagttcttcaagtattaatgcataacaaacaaacatcttcaacaagtttatgtattatatacatttacataaaaaatgtgatataagtgtaaatgtttcttaacaaacaaaaaaatttcttgaaagaaatgcttaccgcttttgttcttagcttttgtataatccttagccttttcaacttctgcagaagccttcttctgaagaaagcactctttcttctccagcatttctagagtctgcacatgcaaattgtattaaaattaggccgcagtgaatggtacatataagataaaaaaaatcagttctatttataactggagcaattatctcgttagtatcagctgaaagctccttagaatataagagatttccatcttctttagctaaactaaggctctcttcaacattatacatcatttttgttgtgatactatatgcagcaatagcaaaccgaaggcataaatattgataccacttcagcagggactaggctggaacaatagcgatcaccctaatatgaagtttgtttttccttttcataaggcaatgatttttttcctcaaacatactttactattttttttaaagttattatatgtctactgagaggtagactgaacttcatagtgataaagactaagaacaagagtacatcagaagtgtcaccatcaacaatgtagcttataagcttattatttccttgtaagttttaacaggaaagtgctttataaaattgactagaggaatcccagattcaaccaagtatattcttctagatgcagcgcaactaacagtcaagatatacaactggctagcaagtttggccatgtcaaaactgaacttaagatattgctttttcattcagtattgtcttctagagatccattttaagaacacacagaaacacagtcaatcacattcattgctgccttcaacataagatggtcagggtagcttcatgagattggtttgcctatttacttgggcaatgcatggtcatgaggttttgcttccatatatttccaaggtggtcagttgttaaaataaacccttcttttttactaaagcttttcttcggggatactaaaactaattagctatctcttcaaactgtgcagccataaactcccaaccccgtcatgctaacattagatagcttgataatagtcccacagctgataaatttctgcggagacaacacagaatacaaagtaatcgagaatagaaaaggaataaaagaaaagggatgaacaacctcatggagacgatccaaagtggggagcgcagaggaggcagcctccttcttcttgctcttaggctttgatagcagtttcttcagcatcttcttgtcacacccacctctggattcttactgtcagatgatgatggcctatgttaggaaggaagaggtggatgattaatggctaaatctgtatggtcgttccagtagggtgaaagaccaagaggagtcgaggggaaagtaaaggaaatggaggttagagtcagattcgttgagaattgtaggaagaaacagcagggatagctttaagcctttaagcatgtgaaggaagataaaagtggacctgtgcgcttacgaaaaagaaataaggacagtttcaatgagatcactgtcttgagatacttgctccatgtttgacagtttgcctatgtgtgaccactttttgttcaataggtttttatttctggaaagatactttcaatgctaaaatcaagccttgttgttacaagtataaacaattgtaattatcaacttgcttcctaaaaacactaaggtcttaaaagcatgtgttgtacactaaagactaccgcagatgaaagggaggaggtatcagtcaagataaaatatcaaattcactatgtgaaatttgtatatattttgttgaataaatttcaagcaaattactttgactgtgactattctactgccaaaagaggggtataaatacaacacaagaaacactttcaactttctgatgacagagaactgtagtaggttatgttggattaggtgtgccttgcatatcttggcaaatccctgggctccacgttcatgtggttagttgaatgtactctacaaagcttgttgtgacaacagcctgcacctctctgagactgaagtctgaacctaatactcatcccatcatttttcttacttgaaacaaattaagctcttaagacaattttgtaaataatgcgcttctctttttaggacaagtagttgatctgccattattcgtcttaacaaatgatgatgggatgatacaagatgctgttggtgtctttttaccaaagtgggggggtgaactgcagcttgataaacttcacatacaactaaaaggcaaacaaagaagtagtcttgctccatgagttatttttcttgaaaggattgaattgatgccaaatggagtaaaattccaactcctacatggctaataataggctaatagcatagaagaaaaggtcttagcgaaatctggtcagaaccatcaccgtgtacggtacagctacgaaagaacagaaacgtacatgtatgctttagaaaattcaattctccacattacataccaacgaaagctacggatccacttgctcaaggactctcaaatccccccagacgagtgcaaacctgaaaagaaacgcgtaggctcacttggtatgcgaacaaacgaacagcaaatgcagcagcagcatctctccccgaccttaagaatattgggaaaagaaggggaagaaaaactccttacccccaggcctgagcggagcataccaaccttacctaccaggctaccatcgcccgcattgacgacgccgagccgtgcggccgcaccctgcaccgcccccggaagctcaccgccgtttgtggaagtggaactcaaccctgaaagaggcaaactgcttccggtccgtgacactgccggcaacgatggtgatgccaccagacaaatcaaacggcccaaaatttccgaggaggagtaggcctttgtgggccttcttgtaagagagacccattagaactattttatatatatataatataatgaaaatatattacatctctggccttctactcatggatacacagccaacaaatctatctatctatctatctatctatctatctattatattattaaaacagccttgaaagaaggcaccacgttcgctgtggaggctagaaatttccacattaatcggagaaaaaaaaagagtccaagtagaaacacaatttaaaaataactgaaattcgaaattaaaaaataagcaatattgaaagaagagtccatataagagcccaatacgagattattcaaaattcagaataaaattaaaataaaatccaaaattagaaaagaaaaggagagtccaaataggaatacaatttagaaataactggaattcagaaataaaaacaaggaatattgagaaaaaagtccatataagaacccaatacgagattaattaatattcggaataaaataaaaataaaatccaaaattagcaaagagaaaagaaaagttcaagtaggaatacaatttaaaattaactacaatttggaattaaaaataaaaaatattgaaagaagaatccatataaaaacccaatacgagattaattaaaattcagaataaaaaataaaataatattcaaaattagaaaaactaaaagagagtttaagtaggaatacaattttgaaacaactaaaattcaaaaataaaaaaataagaatatttaaagaacattatacggtattaattaattaaaatttgaaaaaaaaataaattctaaaattagaaaaagaaaaaaagatttcagttatgaatacaatttataaataactaaatttagtgacaaaaaactattgaaagaaaataccatctaaaacacatgacgagataaattaagtaacatgtctacaaaggagtagagtgttggcggttgatacgacatataaaaactgttaataaaacaccaaatagaatcctaatgacgattaaaaggagggacgatgggcaggccatgaagcaaacaggcaaggcgggtgccgggacttctagaaaataaaaaaaaaataaaccccaatgataatcatattcgatttttaaaatcttaatgacaataaaaaggagaagcagcagccgccgacggttggcgggacttctagaaaataaaaaaaaatgaattccaacgatagttatgttcgatttttagaatcctaatgataataaagactaggtggcggatgggccgtagaggagtatagtggcatcgtttgatgggacttctaaaaattataaaaaatgaaaccctacaagacagtgaactataaaaactataaggtccaatttttaaaggttcgaaacttctaaaaagtaaaaaaaaaatccaatgataataatattcgattttaaaatcttaatgacaataaagaagggagacagcgggcgagccataaaagagtacaatggtaaagccgctgacggtttggcgggacttctagaaagtaaaaaatgaacccgaatgataattatgttcgatttttaaaatttcaatgacaataaagagaaaagacagtggacgggccgtagaggagtataatggcggcgtttgatgagacttttaggaattataaaaacgaaacccaatgagacaataaactctaaaaactataagatccaatttttaaaaggttccaaggagaataaatgataatagtagatcgagcaagcaaataaaaaaggatatgacataagtaagggtagtaactggtgtgacttttcaaaaactatttaattagaaattcggggatgagaagatttgttctttcaaagtcttaagacaataagatagctatttaaataattttaagtaaaatcatacgaaaaaatatatgattttgtttgggtgctagtcgcgcaattacgcgggccacccagctagtttcagtagaaagaaagaaaacacatccaacaagtttcagaagttaaaaaaaaagaattaaaaaagatgtgatgggacaaacccccaacttccactaataaaagtatcaactgaaataacgttttcaaaatcacatagattctagcataaaatttcgtaggtactacaccatccaaactggaataaaagctccgtggctaccaattccaagagtgcaacaccagtacgcatagcatcatgttgttcctgtgaaagcatcatacaccaagagtgaagtcgattggaacacataaagataacctacataatggtagataatttcttatggttaaaaattatcgttacgacaacgtcagattgaccaacatagcgcactagttccaaataaaatcattattttgtggccctaggcactccccttaggttgtgttcttttgaaggggttggtaacctccatacataaaacggagtgatagattaacacatgattaattaagtattaactataaagaacttgaaaatgtattaatatgaatttttaaagcaactttcatatagaaagtttttgcaaaaaattgtattgtttaatattttgaaaaacgtgcacgtggaaaatgagggatgtgagtaagaaacttacgggaaagaacacaaccgtagccaattacccaaaatattttttgcgttgcggggagagggatattaaaggcaaaggatacatcgccaagcaaaacatgcaacatgacagtaaaaaaaagatgttggagtaaaaaataaacaacattacttgttcccctccattttctctatgtgagattatctttcgttaagattattttttgtgaagcaacaacgtaaacactttgatttttagtggtaccttgtacctcccattgtggtcctttgataggcatgcaacccatctaaacctctacatgcagaaatccaaaaatagcacactcctctttcccttccctcacatcgaacgagtgatcgatggtgtatcttatcactcctcccctcacctcaccttacctgagaacaccacccattgccggagttgataccaaacaaggaattcatcaatggcaacgcatacggtgacggatccactagaggagctatggaatcacacaatgtcgatggacaagacgcacctgatgtgcttctacccgagcaagatcaccatgggtggcgtctggacgggcgacaacccgctcgacttctccatacctctcctcctcttccagatcctcctcatcacctccaccacccgcgccgccaccctcctcctctcccctctccgcctccccacctacatctcccagatcctcgctagcttcctccttggcccctccatccttggccacctccctcacttctccaacctcgtcttccctgtccgtagcctcttcgtccttgagtccatggccctcctcggcctcgtctactacaccttcatcgtcggcgtcgagatcgaggtctccgccatcacccgtgccggcatccatagcttgggcttcgctgtcggctgcgcgctcccgccctttctcgtcggcgccctcaccggctacgtcgcgctcagcactgacgacaaacgcaagggtgacactttcttgaacaagctctccttccccatcttcttgggctccaccttctcctccaccgccttttcggtcctcgcccgaaacatcgcagagctcaagctcgccggcaccgaggtcggccagctcacgctttccgcatcactcatcaacgacactttcgcttggaccggcctcaccgtcgccacggtgctcggccactcgcgctgcaccatcacgcagaccacgtggacgctcacgtcgggcgtcgtcatcttcggcgccagctacctcctgctccgccccatgctcctgcggctggcgaggcgcgccgccgagggggaggcggtcggcgaggaccgcgagtgctggattctgatcggcgtcatggttgcggcgctggtggcggacgcagggggcacgcacgccatattcggcgccttcgtgttcggcctcgccgtgcccaacgggccggtcggggtggcgctggtggagaaggtggaggacttcgtggtgggtgctctgctcccgctcttcttcgccctcagcggcctccgcaccgacaccgccaagatcaccaacatgcattctgccgtgctgctcatggtcgctgccatggtcgctgcggtcttgaaggtcgccgccgcaatcggcgtcgccggtgtgtttggcatgccactcagtgacggcacgtccatcgggctgctgctcaacaccaaggggatcatcgagctcgtcatcctcaacattgcaaggaacaaaggggtaatccattttaattaatcgatcgccatgcagtgcattgcatgtcgtgattaattaagggtaggtagcttcttgtgttgtgtagatcatgagtgaccagtcgttcacggtgctggtgttcgtgtcggcgctgatcacggcgatggtgagccctttcctggggatggtggtgaagccggcgcggcg

SEQ ID NO: 53955 - DNA, 6897 bp, Oryza sativa
  unsure (1)..(6897): unsure at all n locations
agaaccagcactcggcgctcatcttgctcccgttccacaagtaccggtcggtggacggcggcctgaaggtgtcccacccggcgatacagccgctcaactgcaacgtgcagagcttctcgccgtgcacggtgggcatcctcgtggaccgtggcctcgccgcggtgccgggtggcgggtaccgcgtggtggcgctcttcttcggcgggagcgacgaccgggaggtggcggcgcttgcaacgcgcatggtgaggaacccgaccatcgacctgacattgctccggttcgtccagaagggaggaagcttcactgcaagcgagttcgacgcgctgaaagagcggaaggccgacgaggggtgcctgcgtgacttcctagagagggcgaacgagggcggcggcgcgacggtggagtacagggagcgcggcgtgttcaacgcgagcgagatggtgggggagatacagagcgtggaggccatggggaacaaggacctgttcgtcgtcgggaaggtgcccggggggtccgggctgacggcggggatggcggagtggagcgagtcgccggagctggggccgatcggcgacctgctggcgtccaaggacttccagacgacggcgtcggtgctggtgctgcaggcgtacgggaggccggtggcagtggtgggagctggagcgggagccatgtcggtggattttggcggcgacagcgtggcgatggcggagaggacagccagtgggcgtaggccatgggcacgaccgggtgtatgatcatcgatcatcggagaatttttctttctagaattggtgaccgttgagatagatgtaggaatagctgataatatggtgtggataattgcatattatggtataaaatttatacatagtgcaaagcttaaacatagttcttggaaaaataaagctaaataaccatatactagcatgttgttaatcaagcagtcatcactgcggtgcaacattttgttatttagagggcctgaggatgagaacaacgcagggaggtttggaaatatcagaagaaactcaggatcagtttcactttcaaaaatatttgtaaagtactacagtagtacgaaaatgacatttcacgtgtataatggtatgcacagcatatcgtaggcctactaatttcaggcccaataaaattggagttcaaaacaaaaaggaacagtggcagatatgggtccagatacgcactgggcttaactcaaattcttcagaataagtttacttttactcccttcactaatggctgaatctgtttcgcatataccgggcccccaactattaaaaccggtgcattttatctcccttggtggttttagagagcggtttcgctgacgtggcacctacttgacggtattgaccgggtcttcattccacgtggcgttgatgtgacgcttatgtggcattaaaatcaaaaaagaatgtgcatgacttatttgccattcacaaaaataatattgtggtacccactgacatgtagggcccacatgtcatcttctctcattcccttcttcctcctccccctctctcttatctctctctcccccggcctttctcttcacctggccagagcggcggtggggatggcggtgagttgtggcggcaatggtggtggggacggcagccgccgcgggtgggggaagagagagcttgcctctgcggccgccacacggacgacgtgggcagagtcgtggctgcgacatgccttgaggggggagcacacggggatggagcggaggtagagcgagtgtccactcgagcgagcggcgccatgcacgcagctgagggggaggaggcggcggtggcaatggtggtggggacggcagccgccgcgggtgggggaagagagagcttgcctctgcggccgccacacggacgacgtgggcagagtcgtggctgcgacatgccttgaggggggagcacacggggatggagcggaggtagagcgagtgtccactcgagcgagcggcgccgtgcacgcagcttagggggagaaggcggcggtgtaacggcgcgagggcatagggggagcacgcagccagcctgcacaccatggcggcgacaaccgctgatccagctgtagaagaaggccggtggaaggcgcggctccacccaatgcggacgtggcgcgcggtagaagatgcgggcggtgacactgaggaggacgttgtcagggaggtccccccaccttacccaatccatggcggccaccatcggatgccgccgtcttcgctccctgccacacccgctctccgcttgcccccgccgcccttcctctatccccgacatgctgctccccccaaccggtggcaaccacccaaagctccccactgccgtccccaccatcggatgccgctcctgaggtttcgaaagcataactggtaaaaacagttgtttggccacccacggaaaataaaaatataaacttgaaaaggagtttcgaaataagctaacaatcagacaatgagaggagcatgcatctcaagaatatcatctctaagtactagagcgacacgtttgtctttttgaaggaaaatctgagaggtcgtatatattcattccaggtcggtcggtccactaatcagaccagcatcatcaccagcttgtactttgctatacatgcgaatgaaaggaaccagtcaggtgtggcaacctttatattcgtgactggatatcatgagatatgatgcttcatcgatcgatcgacggcaggttccagatcgaaaagaagaagcagcaaatgcatgtgttccttttttttaaaaaaaaatcgattttatggggggtataaattaccggtacccaaaaaatatcacaacaaatttctgaaccttatatagcaggtggcttacaaggttaattatatggttagcttaattgcatgggttggtacatatatatttcttgctggactctatgcccagagcttaatctaatggttacgattaattaatatacacacgcatatatagacttattaagaacattttactatgcattatatattttttaaatagacgggttgtatacaagcctctcatagtagctagtgctaattaactagttggtatgtactgcgaaatagcttggttggataccaaatttagtcctacgaatcatttgataactttaatatagcacggtacatatttggattaaggtcaacctttgccccaagtcaataataattttagtagtgccataacatatctaagattttgcactactaaaattttacgagggcactaacccaaacaggcactaacattatttacaatgacatggaggatacatatatgtatagctattgctagctactaacaattagtactagtaattcctaaatattataatatttatacattggaaaggtagttgtcctaaaagtcatatttaagactaattaattgtccaatccccaactgatcaattaatctatgatgcacaagagtagctactagctagctagatcgttcttggcaggaagagtttacatgggtggagacatgaagcacgcagtgtcacatggtggcaggcaggtacaagtactatggtacacagagcgcaagacgatcgatattattccaaagggcaaagcaagtatacaaggggaaagctgcagaggagagctcataccaaggtggtgtggactagcaacggacaaggggaacacgatgcatgtacgccaagcgtcgctggcatgcgactcacatcagatcagtggatcgagaattaactacccatctactgctgcctgcctgcctaaccagcaacaacataaccctctcgtgaccatctcatatacagtaaatccattaacatacacacaggcatatgcgttcatggttaaacatggtatatataagaaaccacatgtatttaatttgtaatgtttaatacttaattaatactgtgttgtgtgccaatacccccgagcaattggtgcaagcacgctctaaattctagccctcttgtagcggcgtcctagtttctacaagttggccacgtcggagtgtctaggggagaggtgtttcatcttctctctcaccttctctccctaaatcgtgaagtcttggatagagttgggttttgtgttgattgtataggtcgggttttgggtgatctcggcagtgttctgttgttggtctagcggcggtcgatcacgcttagcagcggccggtccggtgctagccttctcctggatctgtgtgttgacgctgtcgctgtgtgggtggtggtataattttttttcctggttatgaccttataaaggattgtaatcttgtaattttttcctgctctatcaataaaacttcgcaccgtttagtgcgagtcgttcaaaagaaaaagtcattgaagtataatctcggttactattttatactattgagaataagtttacaaaacctaataagtttattatgagatctcaaacgtacttaagatcggatgaattgtatatttaattgtttatacaagaacaacaaatacaattaataatatatgggcaccatatcgatctagcttggctatcctgggtagtcgatatgtgtcataagggcaagcacgtggcaccactcaccctttttagccgactgtgcagtttaggtgtgattataagttactccctccgtttctaaatatttaataccgttgatttttttagcacatatttaaccgttcgtcttatttaaaaactttggtgaaatatgtaaaactatatgtatatataaaagtatatttaataatgaatcaaatgatagaaaaataattaataattacttaaatttttttgaataagatgaacggttaaacatatttaaaaaaatcaacaacgtcaaatatttagaaacggagggagtataaatatctattttcgtagcagcgagattactagttccagtatttcactaagtggagatagataatattttttaagaacagaagaggtagggatgggtcgaaataaataggggcatttgaaaatttataattggtatttttaattttgtaacaatttaactcgaatggatgacaattctagcggtattttttaattttctatgatattttcgtaataacgatttaaacgagtggtaaatttataattgtccaaaataaataataaagtgatcatgatggtgccaatgatcaatctcgagtcaggccagggctaggacgactggaggatgtaagctatagggttgaggtgacgctctgttggggcgtgaatgaccgatacacctgtagtatgtatatatgcgtgcgtgtgtcacagcttgcacagtagcagtgtcgcgcgactgccactgcacgctctggatggacttggttctgaccggccggttgatcgattgggtgcatatttactatgcattggtcattgcacgatggccagtctacagtacgataactgatcgatgtaagaagccaggcacacgcatgcacgtctgtgtgttactactgtacaagtgtagatggctatgtcaaagaatattgccacgtccatatataagcctagctacgtacctagctatatgcacgcctacctaattcgttataattgtgtagtaattccacatttatttatcctgtgaactatgtaataattgattatatttttttaagtaaatgtcaaataattgattttcattttccaaaaagaaaaatatggattatgactatgaactccaacatgcctatccaccactacctgcatgtgtttcgacagtcaggatttatgcacgcctgccggaacaggatttatgcactacgtacacagtagagtgactcatgagctgttaatttgctccaattaacaagcaaattgctagcaaaattagctaaattcgtgccgaagagttgtgttgtacttaattgttactggtgtatcacgggacaggcatgaaacgccagaagttacactatagcaaacagcactcccgatgttagtttccttcaagaaatgaaacattatatcgatcgatccatccatcgaaaattcgaaatgatggatatgcaaagtgtggtcgcaggtacatgcacgtgatagttaagttgtagtatacatatatatagtccatatatagtttgaacttttactgcttgtcgcccgaaataatcggcattctgtcgacgaccagcgccctgcagggcggtgcacgctattcagatcgacattatatatataatatattcatgtcattttctcacgaccctgccagtaattaacgtccgttgatccacggcctcttatcgattcagctataattaaacttcactgtcgatcatatacttattcaatccagtatagtagcagcacatatgcatcattctcaatcgatcaattagccattaattgtcctaagcatgcagtagatagatatatatcgatccagatatgaatgatatgtggaaattttgtagtaataagaaacggcgtatatttattttttttcaaacggtcagaccgttgccggcgttttatataaaaaaagaagttgttttattttgaggagaaaacgcgtgaccaaaccttacagtgcatagttaattaaggaaaactataagaaaaccacaactactagaccaaattaatagaaaatgacaaatctaaactacaaggctacgaaaaacagaaaaagccaggttcaaccaacgctattcaccataagccttgcaaaatagtagcgagctggaagatcaagcaaggctccctacacgggcaaacgttgtcaatactacaacgttttgaattcattttttaatttgtttttagaaagttttcagtcgattctagttttcatcggatagtagccttannnnnnnnnnnnnnnnnnnnnnnnnnnnnnnnnnnnnnnnnnnnnnnnnnnnnnnnnnn

SEQ ID NO: 53956 - DNA, 1213 bp, Oryza sativa
  unsure (1)..(1213): unsure at all n locations
nnnnnnnnnnnnnnnnnnnnnnnnnnnnnnnnnnnnnnnnnatatatgttcttaatttccaccacttttattattccatgatttcgtcagttttggtctcgggatggctagaaaggtaaaagctgatttactagtactacactttccaatccggagtgatggctactgctacgactatcagtgtcatggttgacctaccttgctatgatcctctgaagatatagaagtactccggtatactgctgctactttaattagtacttcttctgtttcattaaaaaaacgaatatacgattgaacgtgacatattcgagtacaataaattttagatagagatatatataaagatctgtttagttggtgaaataaaaatttttaggtgtcacatcggacgtttgaccggatgtcgaaaggggtattcggacacgaatgaaaatactaatttcataacttgcctgtacaccgcgagacgaatcttttgagcctaattaagctgtcattaacacgtgtaggttactgtagcactaatgactaattatgaaatacttaaactcaaaagattcatctcgcgatttatatgcaaattgtgcaattagtttttcttttttatctatatttaatgctccatacatatgtctaaagattcgatgtgatgtttttatgaaaagtttttagaactaaataggatcttgtcggtgacatgggatcaggagtatcatgactagaggtttgaggcagacacaaacacccacgtggcctggcaccctcgggggacgtcgggcccgagggtgatgtgttcgccctcctcttagtccccccgagggggtcgggccgcacccgcctcggccccgagggccgaggcgccccgacccctcgtgggttttcgctccgcgtgtatgggttaggtgagcacactggggctcacctaaccacatttattgcggtttggctgagcgtgtcacgccgcatgtaacgcagtgcagtgcactcatttatccggtctgtgaccagtcacagaccggtcagatcgcgggttaggtggcgacaggcggtttgacgcacgcctcgccccatcccgtcaggacgagggcttctaggcgctcgtccccagctggagctagcgtgttacctcccagagatggcacgttagtcctgatcagatatatgccaggctnnnnnnnnnnnnnnnnnnnnnnnnnnnnnnnnnnnnnnn

SEQ ID NO: 53957 - DNA, 3229 bp, Oryza sativa
  unsure (1)..(3229): unsure at all n locations
ggggcacacttggccgttaggtcatatcgaccttcccggtcaccttcggtggacccgccactttccgcacggagcgggtgaacttcgatgtgccggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaagaaggttgccctgggcgacggcccgtccaaggccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcgaggccggtccggcagaaagtgcggcgccaggcctcggaacgtcaagccttcatccgcgaggaggtggcacgacttctggaggccggattcatccgcgaggtcatccatctggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaacactgcgttcattacccccataggaacttattgttatacaacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcgaaaacttttgagagcctccgctccgcccgcataaaactgaaccccgataagtgcgtgttcggtgtacctgcgggcaagcttctcgggttcttggtctctgcccgaggcatcgaagccaaccccgagaagatacgagctatagatcggatgcgcccccccagcaagcttagggatgtgcaatgtgtcgccggttgcatggctgccctaagtaggttcatatcgaggctgggggagaaggcgctacccttatttaagctcctcaaacgctccgggccgtttacttggacggaggaagctgagtgtgccctcactcagttgaaggcgtatctcagctctcccccggttctggtcgccccggagccaaatgaacccttactactctacttagcggcgaccccgcaagtggttagtgcggcgttggtcgtggagcgcgatgaggacaatcctcattccgcgcacccccaccttgtgcagacttggcccgggagagagcagggaggagaggcccccgagccgaacggtggcccaaggcccccgacgaccggagttggccctctgcccgcttgtcagacggtgctaggagcccccgacccccaggaaggccccgaggccactgtgggaaggccgcacctatcgccctttgaccccgaggctaaccctgtgctgattcgacccgggaaagagcagggagaagaggcccccgagccgaacggaggcctaaggcccctaacgaccggagttggccctttgcccgcttgtccgacgatgccaggagcccccgacccccaggacggccccgaagccactgtgggaaggccgcccctgttatcctccgaccccgaggtcatcagcacagaagacaagtgcgccccgggtggctgctcggacgaagagcgccccggagatgtggcccctggcgaagaggatcggccccgccgaaaggtgcagcggcccgtctacttcattagtgaggccctccgggacgccaagacccgataccctcaggcccagaagatgctttatgctattctgatggcctcaaggaaattgcgccattatttccaggcgcatcgggtcacggtggttacatcttaccccctcggccaaatcttgcataaccgagagggtactggacgggtggtgaaatgggcaatcgaactctctgagttcgatttgcactttgaaccacaccacgcgatcaagagccaggccctcgctgactttgtggcagagtggaccccagctcctgagcccgtctccgtccccgaggccagctcggacccctcgcagctgcctcacaccgcctactgggtgatgcagtccgacggctccctgtctcttcagggcgccggtgcgggggtcacgttgacctcgccgagcggagacgtcctcagatacatgatccgcctcgactttcgagcgaccaataatatggcagagtacgagggactccttgcgggactcagagtggcagctggactggggatccgccgcctcctgttgttaggcgactcccagctggtcgttaaccaagtctgtaaagagtaccggtgctctgacccgcaaatggacgcctacgtgcgccaagtacggcgtatggagcgccattttgacgggattgagcttcggcacgtgcccaggcgggataacatgatggccgacgaactctcacggctcgcgtcctcgcgagcccagaccccaccgggcgcctttgaagaaaggcttgcccagccgtcggcgcgacccgaccccttaggggagacggaagcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacatgctggtagaagggatcctctatcggcgcgcggctaatggaatcctcctgaagtgcattcctcgggaacgaggcgttgtgcttcttgccgatatccatgaaggcgaatgcggagcccactccgcctcgcgcaccttggttnnnnnnnnnnnnnnnnnnnnnnnnnnnnnnnnnnnnnnnnnnnnnnnnnnnnnnnnnnnnnnnnn

SEQ ID NO: 53958 - DNA, 1439 bp, Oryza sativa
tgtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtggctaaccgtattattacggataatggcacacaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatctgagctcaccctgaagtctcctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgacctcgtcctacgctgcgtccaaacgcgtgctggattgagcaagctctcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaggtttcgggctcgggccaaccccgcaccccctcgggcgtgcagggttggccgggggctgccacacatgcactttcttatttctcttatttcagtatttcaataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatacacacag

SEQ ID NO: 53959 - DNA, 1030 bp, Oryza sativa
gattccacgtcgtatctgctcccggcgaaagtggaggtagttgtggcccgtcccatcaaaaggtgactcggacgacaacgatacaaatctccgtccatttatgaaaaggtgggggaagtccccacaaaaaagagggaaatggtgcatgtggtatccccttaagatataaaaggaggaccttgcccacttagatgggaggtttttttggactggacttttccagattaggaacccagaacaagggagaggctggctcatactttgtagctccttcacacacgaatccaccaaaacacaggagtagggtattacgcttctcagcggcccgaacctgtatacatcgccggcgtcttgtgtgcttcctgtctcgcgaaccttccacagattgggagcttagagtctcacccagggtccccggccgaaccggcaaaggggggccagcgcggtctcccgatgaggagccccacgctccgtcagatctagattcatagtactagaatgtgccacatgctcatggtaccagggagggagtattgttatactagtactgtactaactagaaaactgaatgaaaaagtatgcaactatgcatgcattagtcatcagtgtgtgaattgaccattgttggtagtcttagtacagtcaatggctactgaactgcgattgatcatgctactactccttagtgtattagcttgtctagctagccaattaaaccggctgctatactgtagtacactgttattgttaaagcctgcaactttcttaaataaaaggctgaacagaagcagagagcaagcccatttactcgtgcttgctgtgttgttagtgatggcatttgtaggtgatgcagactgtacaatcacgagcagtattgttcaatgaatgaacacacagcagtatgtaggcagagtatgtgtacttggtgcatttgtagttgatgactgatgaacagagacagttctggcctggtatgcgagcgaatcgtgaagatattcattgctgtcgttgagctcaggtgataggggga

SEQ ID NO: 53960 - DNA, 1712 bp, Oryza sativa
cgcacactgtttaacagatgtgcttaagtccctagaagacacatggttccaccacatctagaaatatatggcatatgtggtataaaatccgagtaaataaactcataaaggatttaccaaccgcctggaaaatgaccaaaatatataatcagcctaagccataatattggtcaataaaagtgcacacttacatggcaaaaagcaatgatattgtatccaatcaattgctttatgaacccaaacagcgccttgacttatataaaaaagtcagcggggagctatataaagcattactgtttggcaccttttaaaatgcattgtaccaactcctaaaaagttgagtaactgcggtataaaaggattttaaggtattgggcacataatcacgcgcacttttgcctaagcaaaaagatgcctaagtccctaaaagaacgtgacaggccacacctgaaaatatgggctgcaaacatattaggcctaggccaaaaaatatgccttcgacaccctttaaaggatgacgcatgtaacatgctcccgagtaataaatctttcgggtgatatagaccaagtgtagctcatatgaatagcttctgatctaagtgattatgctttatgggatactccaaaatagatataacaattgaattccgactggcgcaagtattcggttgataatccttacggggaataataaatagtccagtctttgagcatagaaaatagacccatgatcatcaaattcatgttgcatgtatccggaacaagtccaaattgaaggtatgatacttatgtttgaggtagtaagcccctgagtatataacttgtcgttctgtcgtagtcacaattgtccattgatggtagcttacgcagttggcatagagacaagacgaccaatatagagataatattgcccaccagaggtggcaaaaatattggtagtagtgaagataatgataccaatcaaaagtgatgaagttgcatagccgtggaggcgaagaaaccagtcggcaacagtcaggtcagccagcaatgaatatgaaggcgcccagcgataaagttgtgtagccatggcagtgaaataatcagtcggtgacagacgatgcagctggtgaagaagatgaagatgcccattagtggcgacataataagccatccatgaaggcgaggataccggtcggtggtgacgaaagcaagccgacggtgaagatgtagacacgcatcaaaggcgatgacgaaatccaccaatcatgaagatgaagaaaatagtcggcaacgacaaacgcaaccgacagtaatgatgataagcagcaatcatagatgatcaaatataatgacgaagttgcccatcaatagcagtagagtgggctatgttgaagaggcttgataggatgttgatgaagataacgatgtcggtgatccagtcgatagcaaccatgaaagtgaaataataagtcggcgaagacatagtcatccattagcaacagagttgatgacagggccaatgaagcataggtgctggtgataatgtcagtgacaataatccatccaattggtgtcatagctgttacagatgcttcacttggaggaaagtagatgatgttgtccaactcgtcgaaactgagctgattggttgatgcctctgccctaaagcaaagacgaagataatgactcctgtcattgactcgttggctaattaattgattgcttcagct

SEQ ID NO: 53961 - DNA, 1232 bp, Oryza sativa
  unsure (1)..(1232): unsure at all n locations
nnnnnnnnnnnnnnnnnnnnnnnnnnnnnnnnnnnnnnnttatttcagtatttcaataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatacacacagcaagatgaaattgacacaaaaatttcttcatttttgattacagattaagttgatctatacaaaaaagaggcccgaaggccttagaagaaagaaaagaagaaaaaactgaaggatggcgggggtctgggggctcaatccgatgcacccgggtcgccggcctcgtcgtcactgttgtctgcaccaccggcattgccctcctcgtcggagttgggggcgaacgcgagccgaggggccgagccctcgaagctgtcgacgatatggtcggcggtatcccggacctgcgcgcgcgcgtggtcctcggtcccaggagggaactcatccagcgccatccatggagagaaattggggtccctggcctggtaactcgctaggacgagctccaccgctccttgggcgaggtccctcgaggatgacttaattgtcttctcgagctcctcgtggagccgttggagagccccggccatcttcgagaggcgctgggcgagacctccctggttggcggcgtactttacggtccgccctctccagaggcccacttgccgaccggcgcaatctaggcgggagacggcgtcccaaagcatgccgggcccaacctcgcctgccaagcggagggcttcgacctccccggcggacgagtccagcgtgccctgcagatcggcgatggtgcgttcggcagctgcgaggcgggcggctaagtcgctttcgcccgcggccgccccgccgctgcgcgccctcgcgtccaactccttcgcccgcgcctcgagctcagcggcccgttggttcagtgcggccctctcgg

SEQ ID NO: 53962 - DNA, 1841 bp, Oryza sativa
ttcccgcctgcgggcctctgcggccgccggatcctcggtctcagactggccggacttggaatggcgggagggacgcgacgggatctcgctgaaacaaaagaaaagaccagaagacgaacaagatgggtgagtgaaaactcatgttgagagaatgaatacagccacgatgggtgagagacgaacctgcgagggggtcggttaaacgaccactttggaggggaaatgaggtttccccgagatggttctgtctcccccatcttgcggggccgcttcttcttgcgctccccctcgggctgcgatgctggcgcggccccctccgggcgcctgctgttggcacgcgccgccccgtcccctcggggaggagatgggggaggtgttcctccctgcttcctcttcccccgggcgttggcagggcggctgctccccgggccactgtcacgggacccagaagcatgaccccctctcggggtagattgttccccccggcggctcccgcctgcgccgtcgtggccctttggagctcgctcctctgaggccccgaccgccatcataatggtcaggatggaggcgcggtccggatcgctgcagagggggaggattccttggggaatgagggccgcctccacggagttgagattcagcacccgttggaccaatatcttgaagtcctcaggagccccgtcccatctcactccctggtgggtcctcatgaagtcttcggacccggtgtactcccaggcgccccgagcgcgccgctggagcggcgcaatccgacgacggaggtagtcgccatacaccatggcccccgtgagcccctgggatcgcaggcccgccaggcggtcgaggacggcgtcatagccatcccccagatctaccggcgcccgccagctggaggcctgcaccgggggctggctcggaagtcggaggcgcgcttcgtcggcaaggggggtgtagaaccagtcgctcttccagtcgtcccacttcttgcggagggtgcaggggatgtagcggttcgccaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtacgccatctggagatcgtagaactccagaacatccatgaagaaagaagaaaatggcggaactagccctgccattgcaaaagggagaaagaagacggaccgccccgggtagtctggcgccgggcgtccctcgcccagcgtgactatctcccggccggtggcagattccggcatgaagcggcgcggcagcccagcctgcctctcgctcacgatgcgggagggcggcagcacgctaccatcgagcagagcggagccccgtgccatggcgccggaaggaagagaagattaagagcgagcgcgtgtggcaaaggtagggcacaagaaagaaggagttagggcgcaagcggcgaagacaagggaaataatggcgaaaggaaggaaacaaatcccttcctcagtgcctttatactcttgccaacgctgtgcccggctcctcgcttctcgcgcccaatatttcgcccctcgtttctcgcgcccacgcttccactaatcccattcgcccgcttgcggcgcatgaggtggatatgcggttgtggcagtcgagatagatcatattgtgcgcgcggtaattacgctcgccgaccaaagcgacgttaccatatctccagacgaaacgaatcgccatgtccagattcgtgtgctactcgagtaatgtggcag

SEQ ID NO: 53963 - DNA, 2606 bp, Oryza sativa
tgctgctgcttgggatgttcccttccgatgggtacacgctcattgaggagaatggcgccctgaagcttggatggaaggatctgtgccttctcactgcctctgcttggcgcccaattcaggcttcgggacgttagtactgagggggaatttatagagctgaagtatcacttgatcttacttaggtgcaattacctagtccttttgcttcttttagctgctcaatttggtcaattctgagaaaagaaaaataaaaaaaattctgatcactaattgccagatctccacacggtggtagttactgatgtgcagcttagctttagcttttattctgttcatgctccagttaaccattctgtccagtttagtttattttgcaattttgtagtgcttaatccttgctgacattgttttgggggaacacgcaaaaggatccttactgacattagagatgcagttcttatcgtatgatcattgatcacaaaatgaaatatctggtggttagtgagctcaattagattgttgatagtgtagcattgtcaatgatcaccaaataatattgttagtgtccatctactatgagaatttacatgtacatttaagttaatgttcctaattttctccagaaaatgacttagggttgatctgaatgccaaattatcagcaatgaactaatgatgggtagcacatgagttgtgtactagaaagtcaggatgttagtggttttaattcatgccatctaaatcctgctaattcttttcttctgaaatatttgaaaccactgacctacactgctcatttagacattggtgtatcacttttctaacatttttgcattacaataatcttattatgtaattcacttattcctgtatccggcatctactggatatacatggttttactttttaacatcattttcacctttccgtccgtgatggttattagcttgttaaaagtcttgcttcctggacacttcggccagtatagccattttgtatgatcagcttggttccatgtttctttatcacaaaggttacgttccacgattgagattctggtgattttcttatttgactatccccatcaagaaatcccactccactagttttgctatttattttttgttcccggctaacctaagccaaacaggcttcttgggcattgtttacctggatgtcgttgtcttgcatattttcttcattacaatatcatcacgaatgttttggttgggatttgccttgagttagtaacattcctaagtagtttcgcatgttttttttttccttctaatgctggtgttgtctaccatttgtttgcgtcttattggcctacccgctttatgcaaaatagtagtatgtctgaatgattgctgtttattcactgccagattactacacattgatactttgtttactttgctaaagattggcagtttttggcactgggcacacctgcatttccaaccaaccaatgccatatttcactattagaagtagtagtaactgatttagcttcctagtcacatttccaaagttggttatgtgccaatgtggcaatcttgaacatcactttcattcaagggttggaacatagatccacctgatgatgcaattaccctcaaatgaatcacttgcttctactttacactcattatggtgttgtggagtgagagagggattgggattgggggcaggcagagtggggagagaaggcaggctataaatttgtttcccaacaatgcctttagaccacctttgcctgcttgccatgatggggtgatgcatggcattggcttctttcttctactgctactactacaaaagcttccctctttctcatgttctctctcctgcaaggcttcaagggtccaagcaagcaagcaaagggcccaatcttttcttgtccccagggcccagcattgccattgcccccaaggagaaggactagtccttttctatcagcagaggggcctgttgtctcttgttctcttgtgctagtgtggggagctactggcacgaggtcagcttggaaagacactgacctctctaaccccctttggcttgtgcagtgcagtgcaatgcagccttggagttgcagaaaagggggttgctagctatagtttggggaatgatgatgatagtcaggaagtggttgttgaacatcttcaatccatcgcaggaaagagaagggcactctctttgcgtttgatgttcttcaccacctgatgtgatggttaacttccctctactccctgatgcttttagttataaagggtaatttgcaaggactcttgccagaagagagtacagtgattattagttgagcatttcttctgaaactggttgctgatagagttacttagaatgaatgaattaaatgggggatgatgattgtatgagtggggcaaaggaacatgcagtgccatggtcctgaatattccccaatcatggagcaacaaaccaaatcaaattgcacactgtgtgaatgtgatgtgtgtgagactgagaaagagagagagagagagagcaaacagccaagcaaacatacctacaacacagttgctcctggcttatcacattgtggacctggggtgttgggaggactgc

SEQ ID NO: 53964 - DNA, 2921 bp, Oryza sativa
tatacggcgaattcgagctcggtacccggtaatttgcagtgtacagtagggagttactactgtgctgtgctctctgcctgcaatgcccattgttgcacaagcactgcagcgcacgtctctctcgtgccagtgccaatgccatgcttacaacagtctgctctgtcttgggttcagttgatgactcgatcaacaagcagaagctggaaagagaagagaaaattggaaaaataaaaaaagaaacaagaacagctactgcagactttacagtttcgccattgctgagctgacgatcccttcctgggctgggttcacatacacaagagcaagaagctgacacgcacacatcgcatctcatggccatcgggcgtcgcctgttgagccatcgccaattcgccatcgcatccggatgcgatgggcggcagtggcacagtgtgggctcgcgacagccatggacgacgaccaccacagcggcggcgaggtctctctcgagggtttggatcgctattaatgatgattgtgatcctgatttttcggatcgctgttaatatgctagccatggtaaagatcgtctcccaagctacagcgtcagataaaatcatttcagcatttctgactgaagtgaacgatggccccgccggacgacctgtttgttgctaccactccgcgatgacaagaccaaatgcctcagaaattggtctgcatactttgatctgaagctgtctatttgacggacgggcttaacaaatgagctctacaatcagttgcagggacagcaccaactgcagactgaaactcgcctcattttttacagttttcagtcaacaatgctcgtggtctgatttttaatgacattggtcctcagaagtttatagtatagccagctgctggctccaaatcatatatagtcaacttagtagactattcatacaataattacctataaatatatactacactattaaattctgtggtcccaccaatcatacacacatgtatcttggagtccgtactgcagctggctacaaatctgtagcccgctgctcttctcactctccttttatcttctcactgctggcctgaatgctggaagggtacattgcctgatcaagcttaatcctatttgcagacggggatgattggaggatggaattcggctttcttgtttctgctgtctgtctgtatgttagttggtagcaatattaaatgggggaaatgatgagcagaattcagaggagttgggtgaaggtattcattttggtagtaaaccttgcctactcctgcctcactcgccggagaccagtacggagtactgcttactgtacactgcagtctctcctgccatgccttcccgtactctgttatccgctgatctggcaacctgacatacattcatgctagtatttcacagtaactatgcaagcgtaaaaatggaagttacattggatacaactgttagctgatcagcactcagcagtagcaggaaaagtacgtacagtgcctgtggaattcgctaacaatactgcgtaaggtgaaggtttgcagtcacacatgcatttttgacgattctgaccaaattcacacttcatcagaagtggagcactcaagctaacccatgcgtgtacatgcacccatggttcactgatgacagccatgaggataaatgtggcatgcgttaaaactgaaaactggaatataagtgaaggaaacaggagagtacaaactcacttttgctagtaattgggcttgaccttttgtgccatatccaggcccgctatggccttcacatacttgcgcaatcttacacttggagtatgtctatttcacctcccttgtgctcttgccctcggtcaaatcgcatccctcaaccgtaaaaccgggtatcgtttttgagggtggtttttttgacgtggtagcctagtcattgaaaaaaaataaaaaaaaatatatacattgggtctacatgttggtgactaattttattcttccttctctaccactcccttctctcctctccaccctctctccacgggcgaggttgatgatctacacgatgaattcatatggtcctcctaaacaactccattgtgtggtacccaaaagccgtcaagctttgcttccacggtcacaccgtctttctcaagtgcttccaccactggtcacgtggcaggtccttccacgacatgaagcctaatctcaccgagtgtcgcatgtggagttcggagatggcggtggccacaataatggaggtgggcttaatagatgcctcgtgtgtggaggaggcagcgtatcaaagttatataggccttataatccaatcaagtttaagaagagtaatgtaatgtaagatacaaatggatcaacgaataatgtttgataagaacaaggatctatttgattgggcttaaccttgggcttcactttttccgaagacacgaattaagtttgataaggataaggttgtgtttgattggactccaacttcacttttttttctaaggctaaagtctaaaataaaaatgggttagagtgatcctaaaaaagaactagagagacggtgtggatgctccataattctgctccaaactccactttcagtagttatatttagaagtaaaagcccttctaaacatgtactaaatacactgagtaagagcacaaggtatgaagatgcacaaggatgagcaacttagttggtagcacaaggtgcattctttcaccaaagaaaagtcttgttcatccccataaatttcagttggtgatgtatttgcaaattggaattctctatgcaacctcgcaagaatggacaacatcacgggcctgttcattttgatgccattttcaaccttaccaaattttggtaaagttgccaaaaaaaaagtggctatatttagtttgctgccaaattttggtaactatataag

SEQ ID NO: 53965 - DNA, 3691 bp, Oryza sativa
  unsure (1)..(3691): unsure at all n locations
nnnnnnnnnnnnnnnnnnnnnnnnnnnnnnnnnnnnnnnnnnnnnnnnnnnnnnnatctggattccaattggaatgggcccttttgctttgcccccaaatgattgactgcctcaagagaattttactcctgtagtgaccactactgcaattgtttttagcccattggagattcaaatgctcctatataagcacccattttctctgacctgcaatgttagtagtgttcctgaaatggataatcgaaatggacatgcacaattcaagttgatcgaattggataccaacaaaataacaacaaatgaagttttgttcaaagttagttgctattcatgcggcggatgaagcattggatcaaggtgtagagacaggattttatcagaaacagtagaaatgagattgggctatgaccattcacaatgtggtaaaaccaagatgtttccagtttccaacgatatcttcttcacctaccctggtcataagaaagaccatacaacactccaagcaagcaaggaaaagtaaaatactggaatttgttttgtagttgtcttttatgccacttataccatatcaggatccagccttgacacaatttgtaactttattccttgagttatggacactacatccaccaaagcttaaagcttatcttaatgcaatttacgtcatcatttcgtgtatcatttctctcgatgattcctttttctcttttgttcatttctgacagggggacatggggagtttttccttttcactgtatagaagtgataattctgcctaattgcctgatcaatttttagaactcggtgacacttgtgctattaaactgaagcctttttttttgacaatttttaggtggttgagcttgttagaagagctgttccgcttgcactctcaccggagaacgattcaagaaaagaagagctgaagaagctccaggagaagaaggaagagatcgacaagctggcgcacaagcaagtccggcgcatcctgtggtctggactaggtttcttcatgtgccaagttgggctcttcttccgccttactttctgggaattttcatgggatgtgatggagccaattgccttcttcacaactgcatctggcctgctcgttggttacgcatatttcctcattacctcaagggatccaacatatgaggacttcatggaaaggttgtatttgtcaagacacagaaagctttgtgccaagaatagttttaatatggcaaagtccctcgagttgcagaagcattgcaagtgtcctctggaaggtcattattcccatagttctaagtttcatgacttgtaacaccaggattggattgtctctactgttgttacttgataatgtactctttacttgtagaattgatagaaaaaaacacatgatcaagtcattgaaggggcatttataaaaaaaaacaacatcaacctaacaaaagcttgcatacttactgtagataaatggaaacgatttatattcacagaaatcagaaaccacttacagatttagcttgatccttactggagataaatgtgagctttcagatttaggcgttcttatctaccgtatgaaatttttacacaagatgtgttattagagcaatccaaaagccacaatgccctgcttatagtgaaaggggacaaggcacaagcagtgttgccatctgagtgcttaaattccttgcaaacaaaaacatattggaatatgcaggacataaagatgccattttgatgccaaagagcaaaacaaacatcgtttttctgcctataaagatgtcaacgcaccgaaaaatagccaggcttgccattggtaaagaattggatgaataaaatgacaacttgcaaggaactgcacctttgcaaacccaaacgtgcagttgaacaggtgaagtattcaacataacaccctggtaactggtaaactgcagcctacttcaaaggtgtcgtatggtgaccagctcacatgttctatacaaaaaattaacgcaaatgcttacagtttggtataataattaagaccataccccaacaatttctttcacttcatccggtggcttgcatttataatcgtagtttcttttgatacattccttacacattatatttgtgattttttatatgattcatacacatttatacaatgcaaattaggtcgattgatattggggcaatgatattttatttgaatctagaggtaatcaagtacctcaaaaaggtcgccaatttaaacatagttaaagggcacatctaaataacaaccatatcatataaataagagtagcattacatgcatatagacagcacacttcggtttactgtgtgggtaacctagataggtaagaccgatgtacactgattgcatgaagcattcactaaccatatagctaacagtagacgatgagatcgtaaaggcttgaacattcatggatatccttctagaactttaagaagggatggatacatgcatattacaaataagggtatcagtttctctaaatatggcttggaattaaattgcattattctgtcttcgttattaaatatgatgatcaccccttgcacaagttcaagaattaattatatcctgtatgcgagcataggcgtccatttgtacttgccgacattccgggctgcagaaagcgctctctcccctgttacaacatcttataattaaaaaagagaggcataaaaggatgtgaagttttcaatccacctcatcattgtacaatagtatattacaattgttcaacaataatttaattctttttctaaaaaaagaattcgcacgtgcatgtcaaacaaataaaaatcttccctatctataaaaacaaaatacactagtaccaaccacggatgaaaagttatataaattgatttcacctaaataagtaaaagtgatcataattagtagcatgtgtacaagttaattatgtatggagattagaaaattaattaactaaaccgtgcatgtatacaaagctattatcatttatcaaagaaaaagaagggttatcaattgtcatcaacaaattaattaatcagctaggttaggtacctgaagatgtagacgttcatctgtggactaagtgtgcggttgcaggtagcgcaaaacctcataaaattttgaggacgcagcgtagggggctgtgaactgatgggaacgccaacattatcatcaacacctcgtcgtgtttgatattcatctgccacgcccacgccccggtttctgctgcttggctggcctctcctcgtcctcacctgctcactactcatgtactccggctgctgctggccgccgacgggcaccagcggcggcggcggagcggcgtcgtcgtcggtgttcctctgacaagacaagctgtcgcccatatctcggccggctgacactgtagctatagctgaaggagaaatgtatgtactagctagctaggaataatggagctaatgatcgagccaatcagcgcgcgtttgaatatataatgatacagagtgatgcacatgcatgcaatcaaggaattaacttaggaaatatagcatgtatccatgcatgtatgcgtaaacgagggatttgatatatgtcgctccaaataattaaaaggctttcttaatttacaccagtgagattaggatcccgtatatattgtagtaatccggaaattaagagcgaatttctcgtgtttcatgtacg

SEQ ID NO: 53966 - DNA, 4177 bp, Oryza sativa
ggcgaattcgagctcggtaccccgctagctagctaggaaattaatcaatccttttgcttaattacctgcatggttggatacgtgacatagcactttacactacacacagagatcttcatctgcaagcatgcatgctaatatacatgtatatggaagtggatttttttcctctcgaggggatatccccttaaatttaagttacatgtaaaaataaggggatatctttttcaagggagataatttgagttttctaatatatagtagtccatgcagtacatattaattaacttaccgagattatttatatggtaggaaataaataatcgtccccactggcatgtggccctgatattaggcacaaagtaggaggtgtatcacgagagaaataggggcgatgattaattcagtgttcaagtgggggccgtacgtggcgattaatttgatccgaccaaaataaaaaaaaagttaatagagattaaggccctgtttctttcagcttgggattattataatccagattattgggagtaagctggaagaaacagacaacttattgaattaagttattataatctggagcccagcttattataatctgataagctcatttaggtgaggtttttccagattattgagtgaaaaattatccaccatgccaccccactctctttttagacttgcaaacccaataatctaggctctaataatctaggaaagaaacaactaaccgtttattctactgcagattataacaatctagcttatagtaatctgactcaataatctagattataataatccaagctgaaagaaacatggtctaatactactccgtaattgatatgtgctaccaatgttatcttgcccggcccttgtgcggcccaacataattatgaacgtgtgttctaatatgtttctgattcggaagtcggaacgcgtactcacgagataaaatagagagagaagccttagccgccggtgatccctagctagaaccacccctctgcatcgatccccaaatcaaattgagattgagatcgaggcgtcgagcgagcgatatggctggcgaatttagtgatctgatgatacaggagggggcgaggctagggctgaagaggtgctccaacgcggagggcggcggccaagaagatgaaggtgaaggtgaaggagaggctgacgagggaagaggtggagcggctgctgtcgttcgtgccgaggccgtttcctcctcgcgacagaccacggtgcgacgatcccgacgtcaacgagatggaggatctcctcgcccacaccgtgctgctcctcaactccaacaaccaagtcatcctccgggcgcaggccagggcccgcgaggagctccggaccaagggctacgtcgagcgctgggtcaccaaatccgtcgccgacatgccggcctcaacagcctagctagctaggccctccatacctagctacctcaattcaagtatcaccatcgatctctcctaactgtattagtaatataatgtagatgagcatgacattacgatgatttgcttcttcggtggtgtggaagcatattttattactgattagtagcatctgtatatatctgtaaacagattttattacgacgacgacgaccaaaaatacgtactaggtttaatttgcggattatatttacgtcatccgattgactcccgcacgacgccctcctccgatccgtgcatcggcgtcgtctagccaactcgtccgatccgattaagagaccgaacgccgatcgatccggccaattggactcgaatcctacttgttttgcctcccccaggtatagtgatgcatatataaatgcagaccagcatcgctagctcagctcgtgtccaccaattcacaaaatcgattccaatacccaacaaggcgacgccgtcggaggaggaggaattaaagggaagagaagaagatcgatgtgtggcgatgacaaatgagctgaagaggtgctccaaggaggcgacgccatcggaggagaaggccgccaagaagatgaagaaggaggaggctgtgaagaagaagaggatgccgatggaacgggtgcaccacctgctgtcgatggtgccgagggcgccggttcctcttccggtgatccgcgatgattccccggagctgaaggagatcgaccaacgtcgtgcaggctctcaacaccagctctcaactcatccgccggatgcaggccaacgcccgtgagcagctgcggaccaagggctacgttgactccgacgacctctagttgaaactgatcgatgtctgtatgatgctgcaaactgtcattaattaattattagcgatctgaaccatcgagtgtcattagctattgacgatctcctcaaccatcgatgtatctgtattattatactgaaccatcgagtgtcattagctattatcaaagttttcgtgctcaactttgatcgtccgtcttatttataatttttttaaattagtatttttcttgttatgagatgataaaatatgaatagtaatttacttatgacttatgtttttattttttaaaaaaaaaattaaataagacagacgatcaaagttggacgcggaaaactatgactgtacttaaaatgatgggacggagggagtacatatatttcacctcacctactatacagcgggaggctgggatgaatcttgtagtgtgtgccctggtcttctttttttgttcagcgttttggttgctaccatgtcaaaattaatatggaaaatatcaaaacctagaaaaaattttggtagtgccaaagccattttttttggcaacctatgtgttattattggcatttttttagcaaaccaaaactaaccaaagaactattcaaattgccaaaaatttggtagggcacataattttggcatcaaaaccaaaattctttcatgctattgctttggttgtcataccaaaaataaaccgaataaaaccttactaatgttatattttgctacaatcaacgatggcctgaggtctatttggcacagctcagcactagctccacccctcctggagctggagctcagtcaaacagtttcagctccaccaaaactaggagtggagctttctcacaaaatgaactagaattgtggagctaggtttagacagctccacaactccactacagacccaactcctgaagctaaatttaggagttggagctgtaccaaacaggcatatgtgaatgagtgacctttacaggatgtcctgagtgctgaagacaaaatgtaaaggtagatgagcctgcagtatgcaatcacgctattctggttttgcaatgcttggacgttgaagctgttttagctctatgtactatcttttatcaaactgatgatacaagaatccttccgatgtacaaaatgcaaagatctcaaaacttagacattggtgtgacatggtacataggccttgaagaagaaagaaagaatcacccaatacttgcgggttgaggcattctacatctgtacatgccatgctagtgaacactcaagttatacagtatagctcttatacaacgagcaaagatacacatgaaagaatttatacgaaaaaataaccaccagggaactgctcttttgcaatcccaaagtggtaaatgtgaagaagatccatccaaatcgtgtaacaggtgaaggaatcaacatacaccattgttaaccagggatctacttcaaaggtatcatgctggtggcctgctaccatctttagctactatgaagtattgcttaaaatctggcacaaaaacatttcatcctatctccattttggaattaatgtagtgccaccatgccacccttactatactcaattcattataatgctgcatcagatttcatctcactctaaccctctttgttcccgaaagttctgttgctccaaaatcccagaaatgtagaatgtagtgaatctcatgtcactgttagtctgttattaatgtatattgcattctgtcataaacctttccccgttggtcatatatttcctccagtagcccttgtaatcatgtatgcccaaatcaagccaaggtttcatgacaccattgtagtgtagagtaacagacctttttatatcggtttgactaactccataatcatgtccaagacctgattggacccatgaatcttccaaaggatatatcaaatcttgaaa

SEQ ID NO: 53967 - DNA, 1402 bp, Oryza sativa
caaaagaagcagtcctgacattgctatttctcatataatttgttatgaagtttaattgtacaagttttttttttttacaaacaaagcagaagatatagatttgattactaagatcggactcacaatggtggaagatcagcatctgcaatggtgtcactgagcatgcgttcatgctcttggatgttttgtttcagttcacgtgtaaatgtttcctggttcttcagctttgcaatactaggatagtgagctcttgccatgaaaagttgatccttaagcctcttcacaataaaatctttcatcacttccttatactcaacagaccagaggcagtagctaccatattcaagttcacaggatctggggttctcatgctcgacttcttggtcttggttctctttcttatcaatagtagtatcctgtcacagaacagattcagagccttgtggcagaaaaaggaaagggcatccatcgtacacaaacacctatcaggttattgtgctactattgtcttcaaattcatttataccaagggaaaaaaatctgaaatttgaaaaagccttttctaatgtatcattatgtccataatgcagttgtgatttgccaaagcattaacaaacagaagcaccaaacatgtgtgtccaagatttgcagagtaatacaaaattattcagtggttctgagccatagaataaacttgtaccagcgaaaaaaatgggcacccaactaagtttcagaggaaaattcagttctatactgtgctgcaaactatgtcaagtatgtgcattcttaactgattgaaagtactggcaacagtgagacatctaagaagcaatttttaaggtgtgaaatatggccaaaaggacaagtcaactgtatagtacaaaattattgcacttttaatcaacacaaatgtatacattattactgaagccacactggaaataaaaaaaaatgttcctactcaaatattttacattcactatctgtcttcctgaagatcccattgactgtaaaatcccattactaatcaacttatcatagcaagaagtacaaacattataactaactgtgctcacagacaagaataatccgttggttactccaaaccaatgaaatgcacatatattaaaatcctaagattgcaaataagcatagaaactatttcttacctttgatctccaggataagtcctttaactggtatcttctttgtgtatgaagttctgaaataacattggatactataaaatggatgctggtggtatcttacagttcttgttttacaaagtaaatgcagtaacactctgcaaaatctgatctgacatttcttacctttgttttttctggtctcattttttagctgaactaaagaggaaacgagctcgagcttttcttttgatttg

SEQ ID NO: 53968 - DNA, 3148 bp, Oryza sativa
tctaatgaaatcgaaatctcatgtcccctctccttcgctgcctcgctgatcttcattgttccttttaaagtggtttgtctacctgacctaagctaagcaagctattagagcaagttcaataatatagtccgctacttactccaaaatttaaaacatcatatatagtcaatctaatagctcacttatataatatatagctatagaaatatactgcattattaaatacataattcatctatcttttttacatagtttattagagctcatgctgtaactggctacaaatttataagcacatttttgttctctctcctctcatctctcctctacataagtacaaatctgatgtggtagcttgtatagcccgcttatgtcaccttattgtacttgctcttagtagtacacaccatttggagcagcacatcttaaatactcctaaaccaacatacaggggcggatccaaagtgggtgcagggggactcaagtcctccctacacccacaagacccatagatattccccggagcacctccttcaattttttcaccatgttcctatatggctggaggttgaagaaactgtgtaattgcctacacccacaagacccatagatattccccggagcacctccttcaattttttcaccatgttcctatatggctggaggttgaagaaactgtgtaattgagttcccctaaattttttttttcctagatctgcccctaccaacatagtacgtggatcggttataagctaaaagttgtttaactctatctaccaacatatagagattaagggcttgtttagttggtgaaaaattttggattcgttgtcacatcggatatacgggcatatatttgaagtattacacgtagtctaataacaaaacaaattacaaattctgctagaaaataaattaagactaatttaatacttcatgcatgtgtccaaatattcgatgtgataggtaaaaagtttttgttttaggaactaaacaaggcctaagagcaaggtacaatagcatactattagtcagctataaatatattttaatgagataaaagatgagagagaagcagcgggctacagatttatagccagctgcagcacaaactccaagacgcgatgtgtgtatgacatgtgagaccacatattaattgtaaagtaagtaactattgtatgaattggttattagattggctataaataaattggagctagtagtgggttgtactctaaggccccctttgattcaaaggaaatttataggaattttaaaggatttcattcctatatgaatttttcctatatcgccctttgaataaaaggaatggatcctatgaaatcctataaaatttctatggaatgcctcttcccatataagttttagaggaaatttaacataaggtagaacctcttgataactcttttttgagtctatctctctcatccaattcctgtattttttctgcggttaaatcaaacggtcatttctgtgtttttcctgcgttttgcaatcatctgttttacacttacatttctatcaaaattctacgttttttttattcctatattttctcaatcctacgatttaaaaggcctaacagttcgaccagcagctgggaaaatggagtactactaggactcgtctcgtgaagtgaaactgcagcgcccaaatgactatagtccccaccgtacgaacgtaggccctcctccatgactccatccatgtgcccgttgcccatccatcaacccaacccaacccaacccaaggatttatcagttttcctactactactactcctgtcctggagtataataggtactagtactcttcactcaccctagtgtagtagtatatcactgcaatttcaatctcggtcatttttactcgctgccatgcgttgcacgcccacagcatcaacacgctgatggcctgatgctgatatgcatgcacatgctgtcttgtcagcgaccaaaaaactttgggcttgagcacgcacatcgcaaaactctactactattccagatagattcgtcagcaatcaagtaaactaaactaaattaacccaacccctggttgctttgcttcgcttggttcaaggttaatttgagtcagctctcagtcagtcggtcggtagcagccagtatggccttgcgcaaatcgagcaacctgttgccattaacctactacaccaattgtcaatcaaaccacttgcgtgattcgtgccaagatttcatcaccattttaaatagcaaaggcgtttttctatcgcatgctacagttatagataatccaacaaatatactgtccgtagatctgcgctacacatgcacacgtgttcacgtacatgtaaaatacttcaatactcccctctggctgggttggcgtgggctgtgttggattactcagacgatcacaaatgtatataatcagcatgtaaattcaaacaaaatacaactccaacctcaaaaaacaatctacatatgctctctcagctcttcactaaagactaaagactaagtactccctccgtgaactcatgaatgacatactctttccgtcctagaatatattatattattacgaatctagaaactcgtactccttccatcccataatgttacaacctagtcccatcctaggacatgtccagattcgtagtcctaggatgggtctcatcccatcctaggttgcaacattatgggacagagggagtatgtcacaacctaaaaatcccaaatatataaattgttgtctaaattggaattattagaatttatttcaaaagcctagaagagaagatctaattttaaataataaattccaatataaaatggggccagataaaattccattaaatactttgcttgattctatagttcctagagttttctgggatttatttgagccaaggaagtatttttaataaatggaattgcatttcatgaataatttaaattggaaaaggttttaaaagttctcttttggctttgggccgaaagtcggcccaaaacctctctctctctccctcggcccagtcggcccaagtcagcccgcagccgcccgcgcgagcgccctcggccgctgacaggtgggtcccacctgtcggactcgtcgtccacctccagccgccgcgctgaaaccc

SEQ ID NO: 53969 - DNA, 3179 bp, Oryza sativa
gagtccagccatatgctgccgccgctccggtcatcgtcgtcactcgggaaggccgccgtcgggatcgccaagtcgtcgccgtcctcgtcccgtcctctgtttccaccgaagaccgccggggcattgccgtcatcgtcgacccgaacgcctccaccgtttcgacctcgccgccgttgccatccgttgccgtccgtcgtcgtccgagccctcggtgagttcgccgcgtcgccgtctatgtgtagatgccctccgtttgcggcgctgcaccgtcgttcgccggcgagcgcgaggtgctgagccgccgccggtgatgacgtcatcgtcgacgtcagcgccgcgtcatccgtagaccgcggtggatcgaatcgatctcagccgtttattccgtagaccgttcccgtgcaccaagtccaccgtgaacccgagcccgctgacacaataaatcctttttccttttcaaaaatgattctttattgctcataattcaattaaaacccatataagtgttttaatccgatttaatctttaaaaattcataactaattcatcttagctcggatttagttggttcaagtctctaaatttttctaaaattgagatctacatgttaaaaatatccacatgtactgttcatgcttttttgtgtgctgttttggtgattttgctcctttctgtttagattccgacgtttccggagagtccgtttttacaggagaagaatttgaagagttccaaggccagcaaggcaagtcacacagatcccaaacaaccctttgagcatgttgatcccgtttaaagctattgtttctattcaactattgcatttattttcgaatgtcattgggtgtaattaacctattgtttgttatagccctttttgttcttgattactttattccttgataccttgggttattataacttgactagttgggctttatatattggttcagctagatattagataggattgcttagccatacttagaaacattagcacactattgggataacttatgactcactattatttattatttaatgatggcttaatgatagctcatgatggttaatcatgattggttaattaattaatttgccaactaaaacctgataatggtgggttgtgagcacatgattttgatggtcgtgctcatgacaattaaggaccagttcacgagtttcggttgtgaaacattaccgtgccaaccacaagccagcgtgggcaacggctttaccttttgtatagtatggttcattgcggggcaccagactgagaagtggcggagataagcccacgggggtcgctggggagtccatgccttgtttataagggggtgattatgatccaggaacggtgcactgtggtgagctgtgttgtgcgaggggtattgtcacagttcctttccaaggtaccgtggtggtattgaggcgcatggtgacatgttgtggagctgtgtcttgtgggtacagtggtacacctctggccagagtaaaactattcgaatagccgtgcccgcggttatgggtgggtctaacaatgtctttcgtgattagtttcacatttctcaccataataaaagatgctataactggtaataatttgattagctcctggtttggaatggttaattcctggtttggagatagaactgtgcagccgggatggttgttcagaatggttgggcctatgcaacagggtatgttgtatagcgttggattaatattgtttaattactacttaactattttattaaattctgaaatgtttattaaatgttgtttatgcaaatgaaaccctactatgccatcctttgttatcctgtgcacttgtatatttgctgcgtggcttgctgagtatgtcatatactcaccttgcaatcattcatcagaggaggagttctacagtgatgctgatggtgtggaggattaggtgtagccctggtcaagctgcctgtggagtgggtcgtctgcgccgtttatcttttttttttccgctgcttagatatttattgattgagaggaactatctacctctgtaatgacattttattcgcttattaattagagtaataattgtactctattatcaatttgttattgtgtgcctcggctgattcctggacgagggttcacacatatgtaagcgtttggaattttggatagaaattccaggcttgacagagtattatattaagttacatctcgtaatagactaatttattttgggctgaaactaggaataactagtgattttcttttttgccgctacaactaattaagtactccatgctggtagtactatactattgtcgggtgcaaaataaactatcaaattaatgttggcccttcttcggacgcacaagaatcacatatagaaagaaatgcgcgatcatgtcgctactaggacagtctcatttggaccagaccagctaattaacctctcctttactcctgctcttctggatttcgttgcgctttaatttcgtaccaatagagagatcaaagagactagcatttgttttgatcatggccatgacatattccttgcgtttaaacaattctccttccattacataatatactccatccattccaaattgatccacatatttcatagatacactaagaacaagaaaagctaataactctcttatactatatttactctagcaacaaactcaatgcatgcaccatccccactattttctagccaatagcaaatcaagatattgcatgtgggttataaatacatgtgtgcatggatgcatgcatcaatgtccatttactccaatgcacaaataacgaatagacctaataaataaacacaaatatgtagatcatttagaaataaacttaaaaaaactatatgcagatcaatttggaatggagggagtaaggcataaccacttttcttatatgttacataatagtactactagtataaggcatgcatgcaagcatccaatttactatgacatcttctctattaaattactacttttttaaatcctctactctcatattatctaattctattggatgcatgcattatatttattaggatgatccaaactacaagataataataattatttcttggtctttgggttaatggaggttgtgctttatattttgaaatggagggagtacactgcactgataaatcttaattaatc

SEQ ID NO: 53970 - DNA, 820 bp, Oryza sativa
caaaatggtagcagggatggaatggatgaggaacgtaccaacgatgacgtctggagttgtcagcacgtcctcggccgtcacgtggttcacacgaccccgaatgacatccttaccaccgttgttggagcagggaggcgcttggccttgctggcgcctcgacttcgggcatttatccgcaaagtgcccgggctcgaagcagttgaagcacagacgctgcggaccttgaacgtccctgcggccttgaccagactgcgcggctggcgtaggaggacggggcgcatgggtcccttgctggctctgctgttgctgcggctgtgggacgcgcaccacgaattgaggtcgaggcgcggagcgaggttgctgctgctgcgaggaagatccccctggatagggattggtgtagcggatcctttggttagcaccctgttggttgcggaaatcgccaagcgacgcttgtgcgactccagttccttgtgcttggcttccaagcggatgcttttgtccaccagacgttggaaatccggatagtcaccggagactagacggacagacagctccgggtccattcctgccaagaacttctcttgcttctcctcatcttcccgcacatcctccggggcgtaccgggccaagttgttaaactcatgcaaatactccatcacggagcggttgccttgcttcaactctcggaactcccttttcttaagggccatgactccggcgggcacatgggtcctccggaaggcggcggtgaagcgggcccaagtaataggctgcccctctggctgcgtagcctggaaatgatcccaccatagagatg

SEQ ID NO: 53971 - DNA, 1457 bp, Oryza sativa
tctttggaaatttgttgacgaatcaatgcttctagttagtagaagcgggttacatacttctctcacgtatgacgaccgggtggaatttattagaaaaaaaattgacagtttcaacttaggttagcaacttttggtgcaacttccttgtcgatcgtacttttgtgatgacgtatactgccgattcttggatgtctcaaacaacttcaacacgagccatttatttttatgcaggaggcacgagccattcttttagttagattcagtactttgagcagagtcggcgagagctctcccagagaaaaagaaagtgctctttctgccgctccaatggcttcggttaccggtaactggaggtggagtatatatcgtctcgtagtagggtttatccaattcttctttagagtgtgtttattttacgctaaaattgaagtttaattgaaattgaaacgatgtgacgaaaatgttggaagtttatgtgtgtcaaaaagtttttatgtgatgaaaaagttaaaagttctaaaaaaaagttagaaactaatccatgccttagttatttgccggttcctgcgtggtgcaagagattgtcggcatcgtgttgtcatgtcccatcatcaagccatggattcctgctatttactttcgtggcttttgggctacagattgctcagattataggtatcccatacccacataacatggttatccgactagttacaggggataacttatatctatggaatatgtaatagatcatgacttgggtaatacgtttccttatatattatggaatggcctttagtcctggtttgataatattgtaaagtagatttaggaaactgataccgtattggttaaggtttctatcttgtaatcctgcccccatcctatataaggtgggcaggatgctctctagggggcagatgacatacaatcagatcgtcagatctataatacactcggcggattcaaatccccaaataggagtagggtattaattctcattgagagggcctgaacctttctaaatcctttgtctttgcatccctccacttttaggtctcgtgcgctaccctctttatattgctgaaatattgtttcgacagttggcgcgccaggtaagggcttcgccgagtttctgtcacggtctcgaattcgtaggagagattcggtcgagtagagaaggaaagagattgagagagatggcttgaggaagaagaagaaggagaagatcataacagaattgaacaggacagagatggaattgaatttgagtttgtttgattacatgatttgatccccttcctctcaatcgtgccggcttatatagcatcgaactacacagtctctctcactcactgacagttgcctagccaattactactgggtccacacacttgcagggaaacgggagttgggctgcttctcccgtctaggccgattcataggctgggtcactg

SEQ ID NO: 53972 - DNA, 2089 bp, Oryza sativa
  unsure (1)..(2089): unsure at all n locations
agtccataatgtgttccatgtgtcgcaattgaaaaagtgtttaagggtacctaccgaagaagctaatcttgaacagatagaagtccaagaggatctgacctatgttgagaaaccaatccgtatcttggaaacagatgagagaagaaccaggaatcgagttatccatttttgtaaagttcaatggagtaatcactcggaagaagaatcaacttgggaacgagaagatgaattgaagttagctcatccgcatctgttcgccagttcttccgaatctcgaggacgagattctgtttaaggggggttggtttgtcacaccctgaaaatcataaatatataaattgttgtttaaatggaattttttttgaaataattttaaaagccttgaagagaagatctaattttaattaataaattccaatataaaatggggccagataaaattttattaaatactttgcttaattctataattcctagatttttctgggattcatttgagctaaggaagtatttttaataaatggaattgcatttaagaaataatttaaattgaaaaaggttttaaaaagtcttcttttggctttgggccgaaagtcggcccaaaacctctcttctctctctcctcggcccagtccggcccagtccgccgccgcgcgcgcgcgccctcgctcgctgacaggtggggttcgtcttccccgagccgccgtcgcccggccgaaaccctagcgcgccgccgccgccgttcacttccaaatccggccgttcctttccttctccggccgaatcaaaagaggggaaatgatctccgggatctcctctaccttttctccgttggaatcatcggctaaaacgttttggaagttcgtggaatcgagttcgattcggatcggcctctttccttcaagccacgaagtttccttctcgtcaccggccgccgtgggccttcgccgccgcctcctagcccctttaaaaggctccccggtgtctcctctacccgccgccaccctcgccttcgcctctcgtcgcccgtagagctctagcgccgtgtgccctagcgccgccgtcgccgccgtgagtccagcagtgcgccgccgccgttccagacgtctccgtcactcgggaaggtcgtcgtcgtggtcgccaagtcgtcgcngtccttgtcngcngcttcgtcaccgtcggaaaccgccggagcatcgtcgcngtcgtcaagccgcagtccgccgccgttccttcgtcgtcgccgtcgccgtctgttggtcttccgccgctcccttggtcgccggtgagttcgccgtgccgtccgctacctgttggtgccctccgttcgtgccgtagtgccgccgttcgccggcgagcttgcgccgtccgagctgggagccgccgagccgccgccgccggtggtgacgtcatcgctgacgtcatcgtccccgtttcccgtgagccgccgtggacccgatcgatctcggccgtccgttttggatcaagtcgatctcggccgtccgttcccgtgaaccgccgccgtgcgcccggtccaccgcgaaaccctagcccgctgacgcaataaatcccttttccttttcaaaaataattcattattgcgtcataattcaattaaaatcaatttaagtgttttaatccgatttaatcttcaaaatttcataactaattcatcttagctccgatttagttggttcaagtctctaaatttttctaaaattgagatatacatattaaaaatatccacatgtactgttcatgcttgttttgtgctgttttggtgattttgctcttttttgcttagattccgtcgtttccgaagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcctttttgttcttgattactttattccttgataccttgggttattataatttgactagttgagctttgtttatattggttcaactagacgtat

SEQ ID NO: 53973 - DNA, 755 bp, Oryza sativa
ttaagcaaataaaataaagacaggctccgacacagttatgccacacaccggcataaccatgccccacaagatcccaacaagaagacaaacgagaaagaacacacgcgcaagcctactaactgctcgtctaccgctgcgacgggccaggacggaaggtgagcaacagcgcatcctccgtgctaccgacgccggaggcttccccctcctgaggaaccacgggcgcgggctcggcacgaggggtctccacgaagcaagtccacgccagggactgacgaacaagctcgggcctggaggtgctctttcaggcggtgatcttctggctgcggcagacgcggcgacgcttggggtgacagacctctccctgggcgatcttgagctgatgcagctgtgcctccactgcgtctaggtccttcttcagctgcagattctcctgacgcagctctaggatcttcaggttgttctcgaccatcccacggcgcaccatctgatggaagtcgatacgagccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcagctcgtccgggtagcgctggtgaagagtgccgatggagaggagagcggcgctctggcaagcggcggagaaagaatctccacccgcggtgactgccaacgaagtccgctcgggtgagcca

SEQ ID NO: 53974 - DNA, 1195 bp, Oryza sativa
gacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaattaatcagcgaagcatctacctaaaatcatactagtggtactatgagtagagtgtccactagttggggttttgtttaatctagggtgaacaaggaaataataacaataacaataataataggtcataacaaaggtaaataggcatggctagataaaacagtgataacgcgggaatttaaataaagcgataatgcaataatttaaagcaacataattttataaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaaagctttattgcgtcagccgaggggagggggcgcgcggactgggtccacgggagtggggcccacgagacagcctcacggtccacggtggaccgggcgcacccgggctcgcaccggccggcgtcgtgggccccacgcgtcagccgcacccgaggacgtgggcggctgacggccgggccccacgcggcggccactcggcgcggccggcgggagacggcgcccgcgcccctatggtcgccggcggcggccataggcacggcggagcggcggccgagagaggggaagggaagggggaaaagaggcggcggtcctcggctcaccctaggtcgacagcgacgacgaaaaag

SEQ ID NO: 53975 - DNA, 836 bp, Oryza sativa
aaacctacccccccttaaacggaatctcgaccccgagattcggaagaactgacgaagagatcgggatgggatgccttcagctcgtcttcacgctcccaagtagcttcttcctcggcgtggttgctccattggaccttgcaaaaacggataacccggttcctggtccttcgctccatggtgtccaggattttcactggcctctccacgtaggtcaagtcttcgcgaacttcaatttgctctgagtcggcctgctgggatggcactcgaagacatttcttgagttgcgacacatggaacacatcatgcacgttgcccaaggaggcgggcagctccaactggtaagcgacttctccgcgccgagcaatcatacggaaaggacccacaaaccgaggtgcgagcttcccctttgtctgaaacctgtgtacacctcgcaagggcgtgacccgaagatacacaaagtcatccactgcgaattccaggtcacggcgtcggttgtctgcataactcttctgccgagactgggccacctttagattatcccgaatggttctgactttagcttcagcttctctcaggatatcggtcccgaacacttggctttccccaacttggtcccacaatagcggtgtccggcatttacgcccatacaacgcttcataaggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatt

SEQ ID NO: 53976 - DNA, 1786 bp, Oryza sativa
atcctaggaatcttttttttctcatccaccggtgcatcatctttgtcgaccacctctccatcggaggctccgttacccgtcttgtaccgactcgtcccacatgttgggcaagagtctaaatccgcgaatttcttgctgtacagtatgcaataattttcacatgaatggatcttctgaacacctaaagaaaatggacatatcaatttctacacttgatatgtgttcgttggcgcaggttcggcttaagaagcataactctcaaaagatccatcaaatcattgaagctagtgtccgacaattcatttctggccttcaatctgagaagttcaagcaccgagcgcagcatcgaatagtccttgtcgcatcctttcgcttcgtcatacagaaggtccttcgctgctttctccaacgcttcccaattgtccaaccctcatcttctaccagttaggacctctggttcaacgtgccacaacatatcttccagatcaaattcaatgccttcattctctatatgtcacgaccggaaataacccaacgggcgttccttatgtgcatgtattattccttgtcccaggaggcaaggaacaccaaaagttgatacatttcagagtttatcaagcggaagcgtaaatagatactttattacatgggcgacgaaggcccagcacacacaaagacaaacgagaaacagcggaagactagggcgacgaccacaggcacttgacggcaggcacgagctagacaccaaagccttcatcatccaggggctcctcttctgtgttgggaaaaaattgagcaagactgagtacaaccaccgtactcaacaagacacacccacatttgcataataaatacaagggagtacaagggagttataatataaagggttagggttgcagtaaacagcatttaaagatgcttagttgctcaaagctattttgtaaacacgattctagaactatgcaatattatttatcaaggccgtgaacccacacaaacctgccttaacccaaggcctacgatgattcagatcgaaccggcaacccgaccctgggtcccagctcgtcccaagccaacccaggccaaccattccacattttcgttgttgagcaaattttaagaattaaaacactaacttgggtacattgcttggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcacagcctaaaaccattttggggattttgaatagagggggcggtgtgaatctaattccacaatactccaacaattccaaagtgtccaggtgatatgaatatcccaaagtctagagttgtaaaaccgcctaatgttaccta

SEQ ID NO: 53977 - DNA, 1074 bp, Oryza sativa
gattcggcccaagagagggaagggggatttttagggtttttctttttataaaaccttttcaactttgtttatttcttaataattactatttgtgctcagataattccactaaaatttatttacacattttaggcttttaggaaatatacaaaaatcctctaagccttatttgacttttaactttgcacattttaattgttggaggcttcgcacggattttaattattctaggcataatttagaggatgtattttagagtcgttttgggacgtgacactataccagagccaccacattccgggatgtttccctgtgacatgtctttgattataaaattttctgcatcatcaaagcagaaatcatccatcacttcgttacgaccaccgacttccccatgaaaagtccatattttgtggccctccttaaatccttgctataagatgtgcgacaatacttcattcggatcttgcagcaaatttcgttcttacacactttgcatgggcaaaaaacgctcctcaaattctccctcacagcatgtgcctttgcgacctcaacaaatttggctgcttccttcaagaacgttggatgagctcttttcttgctgtacatccatgacctacaataaagcttgtcattaatacatccatgcccgatggtaaaaaagaatgtatttaaattggagggaactaatcacatagtaaattaaagttttacggactatttaaacagccacacaacaattttaagcattaataaaatattgtccatttcttacaaatgaaaaaaatcgtccttttatccgaatgaaaataaatttaatagaggcaaacccaacttttcaatttaggtactaaatacttttataaacatgtaatggaatcattatgtatttgctaaaaaataagaaaaaaataaaaaagtaactacaatataccatttataaaagtgcaagtttcttcgtattgcaccgatgaaaactgacaaaaatggctgcaaatgaaggaggagaacaagctctacaccttttatatggaacccaatcaaagatttgagatcgaaaacattctcccataa

SEQ ID NO: 53978 - DNA, 1078 bp, Oryza sativa
cctttcgctagggtttctattggccgacggctctcaacgatgcggtcgacctggtccggcggtgcagggcgtgccagttccacgccaggcaaacccatcagccggcccaggccctgcagaccatacctctttcgtggccgtttgttgtctgggggctcgatatcctgggtccgtttaggcgggccccgggcgggttcgagtatctgtatgtcgctgtcgaaagttcactaagtggcccgaggcttatccggtcgtcaagatcgataagcactccgcgctaaaattcatcaggggcatcactgctcggtttggggtgcctaaccatatcattacggataacggcacccagttcactagtgagctcttcggtgactactgcgaagacatgggcatcaagctctgcttcgcctcccccgcccaccccagaagcaatggccaagtgtagcgcgccaacgcggaaatcctcaaaggcctcaaaaccaagaccttcaacatcctcaagaagcacggcgactcgtggatcgaggagctgccagcagtgctctaggcaaaccgaaccacgccaagccgagcaaccggggaaacgcctttcttcctcgtctacggcgcggaggcggtcctcccatctgagctcaccctgaggtcccctcgggccaccatgtactgcgaggctgatcaagatcagcttcgcagagacgacctcgactacttggaagagcgaaggcggcgcgcggccctccgagccgcgcgctaccagcagagcctgcggcgctaccatcagcgccacgtccgagcccgatcactctgcgtcgacgacctcgtcctacgccgcgtccaaacgcgtgctggactgagcaagctctcaccaatgcgggagggtccgtatcgagtgatcggcgtcccccggccgggctccgttcggctggccacgggcgacggcacagagctgcctaacccatggaacatcgaacaccttcgtcgcttctacccctagtgggggtcgggtgtcaggtctcgggctcaggccaaccccgcacccccccgggcgtgcagggttggccgggggctaccacatgca

SEQ ID NO: 53979 - DNA, 1190 bp, Oryza sativa
  unsure (1)..(1190): unsure at all n locations
ccccctgggcggcgtcgagcttcttccctagctccgcctcccagttcccgtattgaaggcggagggtgtcctgcgcctcgttcatcacggtggtggcaatgagggcagtctcccactcctcctccacctccttggcgatctccgccaggaccttcttacgggcctcaagctcggaagcatgccggcggtgtgccttgcggcccgcctccaccatggcctccaccgagcgccgcccctcctcgacacgcgcccacgccgcgtcgagctccgcccgctccgcctgcaggacctccatctgggcacttaacccgtctaacaccgtagtattcgcggcggccaaggcctgcagaaggggctctgcgctcggtggggcagcggaaggcagaggggagagccgtctcggtgagggtgccgcacggctcggcccgccgatcgacgtgccggacgcggtgtactcccaggtgccccgggcgcgccgttggagcggcgcgatccggcgacgaaggtagtcgccgaacaccatggcccccgtaagcccctgngatcgcagacccgccaggcggtcaagaatggcgtcgtagccgtctcccagatctaccgtcgcccgccagctggaggcctgcgccgggggctggctcggaagtcggaggcgcgcttcgtcggcgaggagggtgtagaaccaatcgctcttccagtcgtcccactttttgcggaggacgcagggaatgtagcggttcagcacctgcccccgcggctggaagtagcagccaccgactaccgacggcggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaaactccagaatatccatgaaaaaagaagagaatggcgggaccagccctgccattgcgaaagagaggaagaagacggaccgccccgggtagtgtggcgccgggcgtccctcacccagcgcgaccacctcccggccggtgacagattccggcatgaatcggcgcggcagcccggcctgcctctcgctcacgatgcgggaaggcggcagcacgctaccgtcgagcggtgcggagccccgtgccatgatgccggcggaggaggagctt

SEQ ID NO: 53980 - DNA, 815 bp, Oryza sativa
actccttctttggcaaccccatctcaagtggatttcagccaacctagcagcagcactcttccttctcatgtcattgtgccatcagacacatacttagtaaacccattttctatggctgaacatgttggtgttgatgaggaaggcatatacttagatgaggaggaggctgttgttggtcatgctgatgaaactagaggtgaaggggctgtcaatgaagtatccgaggatgaatcttgggctacatctgaggatgaatctgaggatgcatctgaggatgatggtgtcaatgaatccgaggatgagtcaatggcatcagatgggatgcctgaacatattcctattgcaacttatgacaaaaatgacccaccaatgatcgtaggcagcgtatatccaaacattaatgaatttagattggcaatagcacaacatgcaataaaaaaggagtttgaatataacatcatccgaagtgaaccagggcaatatactgcaagttgtgctgctaaaggctgcaaatggaggattcatgcatccgtggttgctgatggtgtcactatgatggtatgtttttaatttaaatcagcatgcattctttaagtatattgccatatatatatatatatatatatatatatatatatatattattgtggtattgactgtatttacatttcaggtgaaaactaatgttgtgccacatgaatgctcaagtactagaagaagtgagactatcaaggctgcaagcaagttttggatttgtgagaaggtaaaagattggttgttggaggatgctagtgtgggagcaaaggaattgcaaa

SEQ ID NO: 53981 - DNA, 3188 bp, Oryza sativa
  unsure (1)..(3188): unsure at all n locations
caagatttttgatgataacctttggcctgcggcatatgcatggagcccatacttctatgagaaacatatggcagccatacaagaagttaaaccagaagcagtagcataccttaagaagtatcacaaaaggctatggagtaggagtcagttctctacaattagcaaggttgattatgtgacaaataaccttgcagaaagcttcaacaatttggtgaaagattggaaagcactacatttatatgacttcttggagaggattcggtggtggttgttggtgaaatgggataagaggcaaagaataggtcagaaatttgaaggctgcattctacctcatattgtcaaggaattgaatgaaaaaagtagagatttaaacatggtggtcacaaggaatggagactttgaggcagaaattgaggtcaagggaggtagtgggtttagacatgttgtgaatttggagcacaaaacatgtacatgtagggaattccaaatctcagggaagccttgtatccatgctatagcattcatcacatcaattagaggaaggctttgcagattatgtggatgattgctttagtgtgcatcgattcagggcagcatatgagaaattgatcccttcattacctgacaaggcacaatggccaaaagctgatcatgggtttttcttggcaccacccattctgaagaaatcagctgggagaccaagaactatgaggtacaaaggatgcactgagaaaggaagcaaaaggagtaggaggcacaaatgccccatttgcaagagttatggccatcattggcacaattgcaaagagggtgatccagaggaagtagcagcaatgattgctgaaaggtacatatcattgcaagtcttttattcattgtagttggtggttacaatttaagcaactgtgtaagttgataaatatatgtcatgacattccatccttgtagtactagacattataattaatggataatattagaaagtcatgtggtggttcgatctaattacctaaacacttgtatatatatgtctcacaaatttccattctatttctaacaagccttatgacatatattttctcttgttcatagagggccaccaaagaagagaacgaagaaaactaatgaagcaacctcggagactagtatcatggctgctccaatagttacaccaataatggcataccctcctaggttagcaaatcttctttatttcattctacattggatttagatcaattagctacataatagtttatttttcacagtcaaaactttaatttcaccgaggacaatatagcatggaacaatagctcgggttcaagtatatcaattaggtaagtaattagatcaattatgtcaatttgctggtattatgttgttctatgcaatatatttcacaattctccttttcagatcaacatcacttactggctccaaccaacttgagcaatctaacatgattgtagccttgccatgtctgggggaggaaacacctacagttgcaccaaaaatgaccaagagcaagacaaagggaaagccatcatgttctagtactcctggtagcccagctatgagcacaaggagcaaaaataagagtcctgcaatgggcactaggagcaaaagaaaacttatggattgaatcatatggcttgctaattaggttttattttggtactgtccatttcttttgtggaggctgatggattttgttgttgtgatgccgtacaaagtggtctagtcatagttgacatattttgctattgtaaggattgcttcctcatgatgtattgatgcactgttatggaccttatgccattatgctcatgatatactgcctagctaatttggtttgttggttgcactattttgtttgaaatggaaagttggtttggttcctgcactattgagtatggaaatggaattgtgggtgcacatgatatgaactgttatgtatggatgatggaaagattatgttctgtgcatgatattgtgtgttctgtatggatatctctattgttatgtatgatggtattcatgctcttattttaccataatcaatttcttatgcagaggaaccaatttcttctatagagaaaactgataactgtacagacagtcagcttttcctgatcctattatttttccaaacaaaaagttcattatattgtatttttttcagtgccacaataaatttgttatacgctcattatttagtctcataaaatacacatattgttcagttgacatttttttcaattttttctatctagctgccactcctccatctacaagggtattttagacatttggaaccacacataacgtgaaaatgaaggaaacctaacgggaggggcatggaagggatcaaagtgaaatttcaggggtacacaggggattgggtaaaattcgagggtatagaagggattatgtgagttttcatgggcatacaagggattttctctctaaaatatagcaacatactattggattagacacaatctaaacacctaataccggattagacacaacctagctactaggttatgtctaatgttatattttgtgatgaagaaaatgtttcaatagaattaaatattttcttatttttgatatattaaattgaaaataataatcaaatatatgtttcggagaccatgagtcattgtctaaaacatcgtgaattatgaaaccggcgtgagaaaccactttcactgattgatgatgaagttcacaaagtaacctgcaaaagaacaaaattaaatatagaacagttgtgcacatagatactctagaaagggctatatcatatcatattttctttcacgtgatgtatgctttatggatcgatagccaattgattctttggtgcaagttttgatgccaagcgtgaaacgtgatgattcgttttatgtcaacatgtttagcttgtagtaattaataggggtgtatgtcaacgagtcttttacttttacatacaagagatgcatgctcatgagtcatgacacaggatcaaaactgatgacatctgagatagtgagagcgattatatatataccaagctgctatatattcaaacgtacacaacttggaatatatcttggacaaagagcatnnnnnnnnnnnnnnnnnnnnnnnnnnnnnnnnnnnnnnnnnnnnnnnnnnnnnnnnnnnnnnnnnnnnnnnnn

SEQ ID NO: 53982 - DNA, 2928 bp, Oryza sativa
  unsure (1)..(2928): unsure at all n locations
nnnnnnnnnnnnnnnnnnnnnnnnnnnnnnnnnnnnnnnnnnnnnnnnnnnnnnnnnnnnnnnnnnnnnnnnntaggtgaagttaccttttcttttgccaaatgagcaaacacaaattaaatcacttagttcattaagcacaaaacgttaattgattatatgaatcctgaaggattaatggatcgatgcatagtaaacataacaagtaataagcataccattgaatccacgcagcatgcaattgataaatggtccattctttctcttcaggatctgcgtgcgagatgcaaaaccgccatagtgcaaatagctgcaatttgctgattgatcttaataaactacggttcaaaaagattatatatgcattctttcccatattttgtacagtaagttcagatattaacaggctacaacctacatgcttcaatagttcagtttattcagtattcaccagtattttgtgtgcaacgaatgaattaatgttgcactttctaagtagtatattattcactagcttgtagtggactgagatgtaaaacattatcaaattatacttaacaagagggtgaacttattaattgacatgtgcacataaatgttgtaatcttttccattgagatactccttcacaacatagggatcttttccttcgggcacctttggagcattagcagtggtgtttgatgagatggcgtatgccatttatacggatccacctccaatatcaaccacccctacagttttagagtagtctcctcccaatttatccagcagataatttagagcaacccacatgtatgatccttgctgggatccctcaagaacataagaacattgatctagttcgggttatgctgatactttctcttggtgtggactacatccctaacctgtattaagacccagagtactaaagggattattaagaataaagatttattagaatcaaagcaagaaatggttttgagttaaaattttgtatgatatgatgtatatcattctggaattatacgtacagcttctagaatctggtttgccttttcatctccaataagtctgggtccagtagttgcctacgtatttgattgaattaacaaagaacaaaatttatagagtgcaagaagtcaggccattttgttcgagaggaaacattatcatcattaagtattttaagaaactatttcgtcagataaaacatcatacagaaacattagtacgtatcaaaaatttttggattaagttcctgatgtaggttttgtttgataattagatgaagagtaaatcaatttagtggtgtacgtaccccaagtttaaggggagttttgttcataagcctggcagggacaacggtgttggccttgtcaagcagaggcagtatggagtttgctgcagcctagggacgtctagcctttttgcacaaaatgatattcatactactacctccattttaaaatgtagcaatctaataagtagtagacaagatacaaactagaataatttatagtactaaaatatgtcttatcctgtatgtactagattattatattttgagataaaggtaattgatactagtctagaaccgtagattcaaatcagcaaaatgcagaggcatacatatgcatatatctctcgaacgtcgaacattcacggaggggatcaaattggggccatagcttcgagccatcaatttaataaggattgctagctgcagcggcggaggacgaggttgaacaacaaggttctttctcagcatactacgcctacttggcccacttagattcgtatctgaccaatttattgggccatttttctgtggggaacaatttttctttggggccttgaccttggacctacttttgtcattgcacaatataatattattgggttgccggcctctgctctccatcacccgtcgtcttgttcgatcgatcaatcatccgttcaaggaatgtaaattaagctaagctccattattacttagcaacaaatatacatgcaagttacaataaactggaaacacacgcaacacacaacaatagtacattaattcatatcctagctactccggccaggctcttgatgcttctttttgggcgagataacctcaatggcagtgcccaatggccacgctgcttctatgtaggactctccatgcttcaccttctctaccagagtaatctccttcgttgcttccaaacctgaatatatcatgcagtgcatatattcatgtcatttctcaagaatatatacatccatatatacacatggcacatagtacaagttcttcattgatagtttaatttgtccatatgtacataccgaagccatcgacaagcaaggtgtattgatagatgagatccatgcataagtaggcgtgatcacgagctattgggtatgctgctttcgcttcttcgatgctcagtatacaaaccttctctgatgcagccttgtacgctgctggtgtagactttgcactgggcgcctcactgtcgatgaacccaatctatttttcccattattggagagaacaatatatcattatgttgatcacaatattcataatttacacagaattaaatctgaataggagttattatatatatgctcatgtaaatagccaactttatacgctgcctgataaattgattactccagtataaaccggttagttaatgagacgtacaccggaggctatgtagtagaagctggatgtgacgtagatctcgtcttgcccaacgccgccgccgccgttccacacgccgttgaagctgcaatttttggtttcgcagggcgagtctaggttcagtgccttcaccacatcttgtctgcatttgtggtagtctgcaccttgtggtgctgccattgcttcgtactgctccccgttgtaggtgaatttgccttttatttgtcccatgataaaataaacat

SEQ ID NO: 53983 - DNA, 990 bp, Oryza sativa
ttttacttgataattttatctccaatgcatacattttgatcggaccgggataaaggttgggttcatcgacagcgatgcacccagtgcaaagtcgacccctgcaacgtttaaggctgttgcagaaaaggcttgtaaactgagtgtcaaagaagcaaaagtagaataccccaacgttcgtgatcatgcctacttatgcatggatcttatctacgaatactccttgctcgttgacggcttcggtacgtacactagcttctaataatggagatacaatatatatccatgtataagaaattaactctaaagaaaaagaactcatatataggtgtgcaaattgttgaacaatttatctaacatgcagtttactaatatatatatatatatatatatatatatatataattatatatatataattggatgtcaggtctacatccaagtaaggagataacgctggtagacaaggtgaagcatggggagtactacattgacgcggcttggccattgggtacagctattgaagctgtgtcacccaaaaaacggcttcgagaaatatacaaatgatattgagatcgatgtactagctactttggaagttaggatatcgttttttgtatgatcgatgtttgtgtgctggttattacagtataactgagtatcatgatatataagtagtatgttaataacggatcgagctatcaatagatcgaggtggccatgctctttgtcctagactccaagttgtgtacgtttgaatatatagcagctttctatatataattactatcatagaaatcatcggttgtgttcgtgtgtcatgagcacgcatgtcttgtatgtaaaagactgaacatctggtgcacatttgagtatttgacctgacacaatcgtatcataattatttttttctaagagttcagatagtgtgaaagtaaaataaaagaagcatataaaactacaagctaaatgtattgcgcgttcagagttaag

SEQ ID NO: 53984 - DNA, 1038 bp, Oryza sativa
  unsure (1)..(1038): unsure at all n locations
nnnnnnnnnnnnnnnnnnnnnnnnnnnnnnnnnnnnnnnnnnnnnnnnnnnnnnnnnnnnnnnnnnaatacaattttgaaacaactaaaattcaaaaataaaaaaataagaatatttaaagaacattatacggtattaattaattaaaatttgaaaaaaaaataaattctaaaattagaaaaagaaaaaaagatttcagttatgaatacaatttataaataactaaatttagtgacaaaaaactattgaaagaaaataccatctaaaacacatgacgagataaattaagtaacatgtctacaaaggagtagagtgttggcggttgatacgacatataaaaactgttaataaaacaccaaatagaatcctaatgacgattaaaaggagggacgatgggcaggccatgaagcaaacaggcaaggcggttgccgggacttctagaaaataaaaaaaaaataaaccccaatgataatcatattcgatttttaaaatcttaatgacaataaaaaggagaagcagcagccgccgacggttggcgggacttctagaaaataaaaaaaaatgaattccaacgatagttatgttcgatttttagaatcctaatgataataaagactaggtggcggatgggccgtagaggagtatagtggcatcgtttgatgggacttctaaaaattataaaaaatgaaaccctacaagacagtgaactataaaaactataaggtccaatttttaaaggttcgaaacttctaaaaagtaaaaaaaaaatccaatgataataatattcgattttaaaatcttaatgacaataaagaagggagacagcgggcgagccataaaagagtacaatggtaaagccgctgacggtttggcgggacttctagaaagtaaaaaatgaacccgaatgataattatgttcgatttttaaaatttcaatgacaataaagagaaaagacagtggacgggccgtagaggagtataatggcggcgtttgatgagacttttaggaattataaaaacgaaacccaatgagacaat

SEQ ID NO: 53985 - DNA, 1345 bp, Oryza sativa
  unsure (1)..(1345): unsure at all n locations
ccgcgccattgattgtataacnnnnnnnnnnnnnnnnnnnnnnnnnnnnnnnnnnnnnnnnnaatgcttattaactttagaacataatgtaggcagtacctgacatgctgagaaaagtttttgcaacagtagaaaaaataatgaggatgaagctttaagaatttatcacatggaagattcgatcaagtcacaagtcattatcaatcagatatttatacaacagctagataagtgaggaccgatgatccatacacataatgcaggaaacacatcattttgatacttagaatcattaagaaaaagaccaaacatggaaaggaatgccaagctgccatccaaagaagaaaagaaaactacctcctggacatagtggcttgtcagaatcattgtgctttggtggttcacttgagtagaaggcattactacggggaagctggcaccggaaaaccttcacgctgtaacccacagcagtcaaaatcagcacaacaataggctattagcaaaacagctgtagaacttcaattcaccttctacacggattgccttgtctatgtttccactggtcgtgctggtctcggagtaagcatgccattgacgggcacatgaacatgaacaaagtgcggtgaaatgatgccgcattgtcctcaatcggtgcatatatctgcacaaaattgaatcctatttgtgattgatttcacacccaaacaacaagtagtcagctacaactgcactatccacaaagcaaacacctggaggacgaactgcaggggctcgccgcagaagccgcagcaacgcgagttccccgatggcaagttcacaggatccaaccacgcctgcaatacagcaattcacacaaaccacaacatcaacacctggtcgacgaattgtaccaatttagcgagtgaagttcatcaaaaacgcgtgcaatccgtacgcaccgggatgccttccgccttgctagggaacaggtggcggaagaagaaggcccgggtgcttccgctttttcaaaaaaacaagcgtcacctccgctttttcttcttcttcttaacggcggtcttgtagcccgcgccggccgcttccgccgccgccgttggcgggtggggatcggtggggcagttcgggctcgtcgtcttcctcatccagcgaggtgatggtgagaccacgaagcttctcggcgttggactccatcctcggcggcggcgtgggggcaaaaatgcgtgcgtgttcggcgactcgcacttgagagtcgagacggggaaatggtttgggcgaaaaaccctagctagcctcctctcgggaatctcagccggggtgccgagtaggaattcaaaattcaatgggccat

SEQ ID NO: 53986 - DNA, 4502 bp, Oryza sativa
  unsure (1)..(4502): unsure at all n locations
ctgctcaagagctgcgttgcttttcctcggcatgccttctctgtcctgcaaactctacagcaagtgtgctggacgggcaaccaaatgctcttctccaatgaaaatctggattagatggccatggtagctgcctaaactcatggaccaagggcaccaacacatgcaactggaccggcatcgtctgcagcacaagtgatgatgccccaggtattctcagtatttcgcttaactcgtgtggcatctccggcaatttggacgggttctggtttgcagaattcccccatcttcaaggactcgacctcggaaacaactctatctctgggcctatcccatcaagcataggtcgtcttgtcgacctctttgatttggatttgtccagcaataggttttctggatccatcccaacaccttaggtaatcttacagtgctaacctctcttgatctctcttccaatttgttgtcacaagggctatctgattcaggaattggcacactagacatcttggaggtcctcgatataagcaaaaacaaattaaccggctcaataccttatagcttgggaaacttgtccacgttgtattttctagaccttagcttcaataagttttctggtcatattcctcatgagctagggatgcttcaaagattgatatccttgtatctatttagaaatgaaatcacgggttccattcctaatgagctagggatgcttcaagatttagtatcgttggatctatccaataatagaatcaccggtttcattcctaacttaggaaatctaacaagcttagtgtcattggttctatccgataatagaatcgccggtttcattcctaacttaggaaatctaacaagtttagtgtcattggttctctccagcaaccaaatcacaggttccattccttgaaccttacggaaattgaccaatatatagcaatactgggatttgagctagtccaatgagtcaagtggtgtactctaaagaaaaaaaatctaattaatttaaccacctaaaatagcttttccttttcctttttgggatttatcaccctaaactacaattcataaatcccaacaaggaaaaaaactattttacgtgggtatattagacttttttctttagagtacaccacttaactcattggactagcgtccaagtagcccaagttccatatatagtagaatgtggttttagtaacccctgtgataaacgaaaaaaaaggatgattcaaagtttagtgacgttggatcttgcataaaatgtaatcagcacatttttagggtataattgtttcacagaacaccatgttttgagcccagttgattataaaaagaaaaccgaaatccgatatcctgccgccctgcctttagctgacatacggaccccaccagtcagcttcaagtctctcttccttcctcctcttgttagatgggctgggcattgcagagatcgccgccgatttgcacctgattcagtgcccattcttcagatttaacaatggaaggaaagagcagatctgcgactccgctacaaaattttggtaagggaaggtggtagcggcgatggaggagctcgtcaaaccaaatgcttcatcttcgtcgtgatgccacatcactgtcaaagaggctgtcaagtaaaatgggcaggaatggctggctctggctgcctccaaatccaataaaaaagagtgatgaccttgattgtgatctcaagtctatagatgtaattgatctctcttttccttctctttacctcctgaaaatctgatgtaatcgtgtccatgcattcgtgtgtaatcttatatacttatgttgtaccaaagtactccccccgtttcatattataagtcgtttgacttttttcctcagtaaaaattatttaggattgattaagtttacagaaaatttagcaatgtctatgatatcaaattagttttattaaatttattattgaatatattttgatacaatgtttgttttgtattgaatattactatattttgctacaaatttagttaaatttaaagaagtttgaattaaaaaaaatcaaacgacttgtaatatgaaatggagagagtacaacaatttgaagcaatagttttggttccctagctacatgagcacagcgccgcctgccttagagcaggtacaatagcaggctattagccagctataaacatattataatgagataaacgataagagagaagagcagcgggctataaatctgtagccagctgcagcacggactccaagacacactgtgtgtatgataagtgggaccatatattaataatatagtaagcaactattgtatgaattaactattagattggctatacatgaattgaagctagtagtgggctatactattagacttgctcttatgtcaattgccaagtctcgtctgaattccattgcttggctggtaagagggaaaaggtaaatatatcatatatgtgaggctggctggtggggccgtatgtcagatgatggcgcgcagcctgcaggcagaaaagggtaacggattttggttttcttgagttggtcgattgggctcaaaatatggtgtttcatgcaacaattactaccctaaaatctgttattttgggatagttttgccctcaaatcgtacggtgggacttgagtcccatcagatgatttacgtgcactgtcatcaaagtaggtttatttttcccacataattattctagcaccacaggtagcatttcacctcagagatataggacaatgtcagaatttgatttacctccacctttcaagaattttattttcctaagaatatcaggtaacttagggtgtgtttgagaagaaaggattgggaagattggtaagatacgcaaaacgaggtgagccattagcacatgattaattgagtattagctattttaaacttcaaaaatggattaatatgattttttaaagcaacttttctatagaaatttttttaaaaaaacacactgttcggtagtttgggaaacgtgcgcgcggaaaacgagatgattttctctctcaattccccagattgcctaggaacgaacgaagccttagtaactataacaggtccaaatgtccaatactgcacgagagcttgatcattgtattaacctgtatgaactatgaactcagatcggagatagtatcagagcatcaccaacataatagcaataatctatccgcaaaatttgacttttgggtctcctaaactaaaaataggaaatgaaaaaaacttctcccttcaaaagaaagcctaaattctatttctaaaaactaaaagtgggcatttctattaaactacaaacaaaaatttccattttcttccttccccccacgcagaaagagatcgcacccacacgcgggaatgggaggagagaggcggggagcgcatgattaggagctatgccaccggtcagacaaaatatatatagtgagtgtgggttattttcaaatctagtcaatatttcctattttctatcttagataccaaatttatgtgtcaacattttggtgggctatggcctgggtgagctagtctagctgagcaagatctatccaaaggtccaaacgtaccctaagaatctgtccataccttaaaaatccttgaaaacaaaattttgaggatagattgttgggcattattaatgatgttcttgttaatttgccgccgtggtaaacgttcttgttattttgatacccaaagttagcagtccctctgaacttttgccaatttctcctctctttttttttagaattttttttccaatttctcctcgtcctattttcattttcgttttcaatcttttagtctcaggctctcagcacctgcacagccaagcctaatccttttctctctctctctctctctctaatctctccagggtcgatcgaaggaatgagggaggctgggctggccggccataccaccttcttccccatcttcgtcgtcgcgccggcgccaccgccggcggcccaccatcacctaacacctgtgtcgctactgttgccctacctgaagaatggggatcttctactacaagtacccagattcttgaagggcgggaaggattcgccaactcagagagtcagagtactgaatcttgccatggttcagttatcccaatggtgaatcattttttttttaaaaaaaaagaggtactattcccctctatttgctgctactaagccctgacaggattcttgtgcgattctgctttcgtattcagtttgcctgattggcgtttctctggattttgcttatattccacactgcctagagcttagcattttggtaaaaataataaaaagagcttatcctagttcagtcacatatcagcattggcgttgttttcttcattcccaaaacacaaaagctatacgtacccgagggaggttggatacatacatatatatatatatatatatnnnnnnnnnnnnnnnnnnnnnnnnnnnnnnnnnnnnnnnnnnnnnnnnnnnnnnnnnnn

SEQ ID NO: 53987 - DNA, 1417 bp, Oryza sativa
  unsure (1)..(1417): unsure at all n locations
aggagtttagctgctttctanatacctggacannggatactttggggtatcattacgaaattgttactgacgcagcaacgttgtagggctagccgggcagcggcatttttttcccgattgcagtaaatgcaagtgacgagatcgaggcaaacatgagccggaactcttatcttttcgctatgcttatactccctccgtacttagagaggcgtttagaacaatgtttaagtcaaatcttaagaatataaatcatgaataactcttaagttgttgagtttgaaaatataaaaattatatgtatagatttgtcttgaaaaatactctcataaaagtatacatatatcacttttcaataaatacttttatagaaataagaaatcaaagttgtgttttggagactgtgtcgctgtcctaaacgacttcctttacgagtatggagggagtacttatcaaccaaaatttaaattttcaaccttaaatttaaagatgtttttaaagtttttttattgaagtttattttttcagcctttgcttttagatcgctaagaatacatatataaaagttctatttacaaattactactttcttcatttcacagcatcaatatggatgtgagaaatgttagaatgacttacatcattttacaaatatagcgtttgggggggccgctggattctggaagtaaccgaagaatgatcaagggaaaactcgtcaagttcttggcactggtcagagtgaaattgcgaaatactatccccctgataatgcgattactagatttcctgataattacccggacggggcaagccgtgtcagggaattcggtttgtgcttccaaggcacgaaacggggtgaagtgaacagagcggcacgtcggggcgacaagggcccccccgttcagtttcagtggcacaaaccgacgcgacgcgtgttcgcataacccaccgcattccgcggccgtgcaaaaagtgtgaacggtgaacctctcccctggccccggggccccaccccccaatcatcttctcctggccttcagcctccagctgatgccaactgccatgtcagcaactaacgcgctcgcttccttcccgcctcgcctcaacgcaaagcgagatccccccctatacctattaatacctcatcttgtcgtctcgtatcatctcatctcatcacatcagcacacatcacacgcgccgattccgaagaaatcaatcaaccaactactagggaaagcaagagcggatcgggtgctgcatttcgcggtcgttttcttcctctgaattctggtgtttgcggttacgaaaatggcgttggtggcggcagcggcggcgaatccgaagcagaaacagaagcagcagaaggcgtggggatcctctagagtcggcctgcaggcgagcnagatatgcatcttcagcg

SEQ ID NO: 53988 - DNA, 1525 bp, Oryza sativa
  unsure (1)..(1525): unsure at all n locations
cacacgcgtatgtggtgattaggcgtgtaagggataantcattataacgttaantgtttttatggtatataagggtaaccctaaaaaacaaacaccaaaaagggatgaattcgattcnccttcnnaccacggaaactaaaaagtgcagtctttacttccagacaatataagaatatgaattttcttaaggacacttaaaaaatgtggtaatttaccacagaacacaggtacattataatacaacatccacccaattgaagacagaaaaaccacgaaatatatcgatgttttctttatcttcttcgctctaatcttcctaaaatggataccatcatggtggagctatcgtgggcctctgcgtcatgaatcatgactaagtgcccttagtcggtgatgacgaagcacccaagacatagcagccaggagtcaccactacactgttgtggcccttgggattgcgacaaagtacttcgagcgcaacagttggcggtcatcaccataccatcataggcgatttggcctatccctcggccagatcagccatcatcggatccactgttacccattcttctcctaccaggatctagcatagttcatcctcctcatcgtcctccaatacacgtcatcgtcagcagtcgattgagtgagcttccctaaacccaggcagcttggtaacgactaacaacatatcatcttagctagttggttgtaattattctatttactatgcccttcatcccaaaataagtttatttttcacccataccatacatgccaatataaaaccaagaggactggaataccccaactttatcaaatctcaatgtacttattcctctctttatctattctcaatatatttattcctttactttcacaaactctgatgaagtgattgctaagggccattcgagacgcaggattgagaaaagataggaaaagaaaaacatatgaataggatgtcatactcattggattccaacaggattttgaaacacatgaaacttttaaaatattatttgaagagcacataggaaaacacatagtaattttagacatacgaagaggaaaacatgaggtgagacctcatgcttattttccttcaaacttgttctagaatgatccattccatagtaatttcaaaggaatgggtatgaaacaatcacttgtttcaaaagatttcataggattatttcccataggataaaatcctctagaatttatatgcttttctttgttttaaagagatcctaaaataatttattttcagacaaacaaagatgaaaaaattatcaatcgtttgttccagcttgctatgcttgttgagaaagagtcgcaggaataccaacaaaagaactagatcaatattggcaactccctcatgtcaagaacatcgaccacgactagacaagctaaggtgtcaacaagctttcataccgtgcatccaccagcgagcacacgacctttttgcaccgctggagcaatgctatcacccgcacctactacacgagttntttattctagn

SEQ ID NO: 53989 - DNA, 2732 bp, Oryza sativa
  unsure (1)..(2732): unsure at all n locations
ctcctttttaagagggtaacctcctgttaaatttaggttttccaaggaaacctgaataaatttttctgttaaggtcaaaatttttttcaccacaaaagaaattacatgttttccacttttagtgtaaaaagtccagtatcacaaagattgtcattggctctctgtgtaagacatggccggttaccagttagtgcaacaagttcatccggcatcacaaggagcaaggctttttcccggttgagatgctttcacgcacttacacagagtttggatctaggaccacatttgaagattctgtgatgccaagttatatgnaaaagaaaaggcgcgcaaaagtaggctactcgtgctccatgcatgctcaaaaaagttaagttgagcaagcgtctacagtttctgaacatgaaaacaaagggtaataataatggtgctacattactcaaaggtatgcatagatatgatgcgccaaatatgtccactacttatactagattagagaaacccatatggaaataattactcaagacatgatgcagatatgaaaatagttaaatttttatgtgctaatgacattccatttaatgtattgagaagcccacaatttgctggaatggtcacagccattaacaaagcttctagtggatacaaaggtccatcctctgagaaggcaaggacaacttagctagatgcatgcaaaagaagcgtagaacatgatttggcaatagtcaaaagtacatggtaattttcagttgctaacctttttcatccttgtacaggtgcaaatttgttaaccttttaactgaatattgagttattgactatcacttctcttatttttgcatcaagcaggtgcacacaaggtgtttctgttgtgtctgatggatagactgatataaagaacaagccactgatcaatgtgattgcatctaatacccgaggttcatgctttctatatgcagaagatttctctagagttgaaaaaaacaggggaagctattgcagagttcttattgaaggctattgatgaaattggaccaagaaatgtccttcaagtaataacagacaatgtatctaacaaatataggaacacgatcctctagcatggtatactgtttgttggtatttcttaatgacattactagaaatataattctcagcaatagcgcaaaaatacttctgatatattatggttacagagttcatccgcaagcacacagatataccattgtagcatttcactcgagagtattccaagggtaccgtatttgcttaatcccgtgggaagattatgataaagagaatcgtactaataatttatatattacttgtaataaccaaagtctaggtagtggttaatataattcaaagggtagagtgacactaagcagaagcatttatactcattcataattatctaagctaagtggaaagaaaatagaaaaattatattcctatacttctagtacacataggtggtgtttgaatctcctgaagatgaagattaagtgtttcacgcaaaacgaagtggtaatagcgtgtgattaattgagttttaattattataaacttgaaaaatggattaatctgatattttagaacaattttcatatagaaaatttcgcacgaaacgaaccaattagcagtttgaaaagtgtgccactttaatccaaaatttaatcacactttccaagacattcgaatggggccaaatacaaacatcctagttatatgattacttagctaataccctctttccgatatcctcctggtgcttcgagaagccactcttgattgccgagttccttatgacaatccgtcatgaccattcaactggggctaaatacggaggagtaccctccccaggaaattaactttggactacatatacgcgcggaggaatacccgtactgagctatcaccatcagcggcccacctcgcttacgtagcatataaccccaaataatgatatccagtaatctaaacaccacgcttaaactaccgaatactactttaatatcatcatgatgacatagagtcatcgtaaatacgatcattatacccacaccattgcatctcccagataagctaacattataataaatataacctggatatataataaaggtggtatttgtatacttggaaagtatacatacccaagtngtttaaaggagaatttccaaataaagtcaagtcttacaaaagaaggaaagcttctagagccatacacgatttctccggggacttcgaggactgaagattctattctattttatttcactatactatagagactatactcaacctgggagatgaatgaagtttcttgctgagggtgtcttgaaaggagaatgacctcttttttagactctcataccgtttgaccgttggagggtcggaaaaccctccactggattggggggaatttaccccgccaggcaaagccttattaacgctgtgggggggatcgcccacaccagtttggggggggcgccctttgtgtccaatatccctgtgtgaaaattgccctaagggccggtaatttggaggttggggcttataaggaaaaatatcttccacttcgcccgaggaaggcccctttttgggggcctctctttaattgccctctccccggaggggtctctcgcgggggggtgttttattacaacacccttttctccgccctggtttttttttttttgttggggagggaaaaaccccaaaacacacca

SEQ ID NO: 53990 - DNA, 2608 bp, Oryza sativa
  unsure (1)..(2608): unsure at all n locations
cgatggctttgtttgacttgnnnnnnnnnnnnnnnnnnnnnnnnnnnnnnnnnnnnnnnnnnnnnnnnatagagactatactaaacttgagagatgaatgaagcttcttgcttgaggtgtgtcttgaaatggagaatgaagctccttttatagcctcctaatgacggttgtgacggttggaatggtcggaaataccctccaactgtcattgggagctaatctacaccgcccaggcaaagccctagatcaaacggctgcgagggggattcggccgaaccaggttttggctggtggcctcctctcttgctcccatatgccgacttgtgaattttggcctaattggtcgtgtcatttctgagttcttggcctattcattgataaatctgattctcgacattgtccgattgattgatcgtctattttgatgttgattctccttcattttatgttcattctctgcaagaggttagtaatcctaatgctagtggaatatttattaattaaacacaaatatgcattacaaccatggctagttctcttttatttggatagtattgaccggcaaaactgatcactaacgaccgtcaacaccattttgaacaaccatggaacatattccatctatggttccgtagagttccagattgtcgttccaaaaaattaagctaggaacacgttccacctatagttccgaaattttggaagaggtatactcctctagttccatgcttttggaaaatggcatccaacgttccacgttccagttcctcgttccatcgatccatgaacttttgagacttaggtttagccaaaatttggatgaaacaaacttgtaatgttgattattcaacctagtagtcatgctgcctattgggaccataccttgaccaaatatgctctaccgaatctttcttcaaagcgtagtgcgtacctcgatcttgtacacgttgatcatgttggaggactgatgtcggatggggtcccgatcttctgataggtaatttatcttcccataaccagaaaaaaaaaatcattcatcctttgagtatgttttcagagtgcagagttgtgcattgattcatatctagtccttactgttgtcaggtgcttacttgagctagagttgagtctaggctaggccagcacattgactagtactttgaactattattcaattttgcattttttgattagcacaattgtgttcctctgctactatatattgtgcctcccaagctccacatatatacttctggtgagcaccactttgatccttgcaatcgccacatcacgtccttcaaggtgtcacaaaccagccaccggatgtaccgtccttagcactgctggtaaggcacttgtaagagcttgataaggtgctccatttggctgagttgttgagaggcaccactacaccacatagcagattattagggataaccttcactgtttgttgttgtttttgtgtttgcaatcacatgtatgggtggcgctcaaaatcagcgataccaacaaggtgacaataatcgcgtgcccgatgatccttattctaaggttaagtttaaaataccatccttttcgggttattatgatgctgagaaatactttgattgggatatgacagtagagcaaaagtttagtgcccaccttgtgcctgagcaacatagagttcgacaagccagtagtgagttcaaagagtttgcttatatttggtggtctgggttagctgtagagagagctttacctactacttggaaagaacttaaggtagctatacgtgatagatttgttccaccatcttatcttagagaattaagcaagaaactgatgcgtttagaagaagggaataaatctgtacaggattactatggtgagctacaaaagggattgatgcgatgtagcatagtggatggaactaaggattccatttgtcgcttttacatgggattgaggcgcgagattcaggacatagtagataataaggaatttaacactgtcaaccagttgtttcagtttgctatgcttgcagagaaggaattgcaggggcgtaatcaacaagtcaagaacaaggcgagcatgtacacgctgcgggcgaagccatcttcggggctgcccaagcccatctctttctggacgaccccactagcgagcaagcgaccaattgcacccggagtttctgcagcgccaaaaccacctcacccacgacctgcagattcaggtaaaggttcttcgcaggtatccaataagagtgcctcatctgtcacttcgacgggacgcacgcccaggattcagtgccaccgctgccatggatttggccatgtgtagaaggtttgcctaagtcaacgggcatacgttgctacggaagatggctacaccagcacctccgacgttgaagatgatgaggaggaagagaagaaagacgaagagaaaaaaacctatctatagctccatgcatgcttgaagaatgttcaattggacaagcacctataatttgtgaagatgagaataaatgtaatgataatggtgctacaactaatcaaggtatgcatatttatgatgtaccaactatatccagtncttgtgcggcggtcaagagtaggatgtcagcccc

SEQ ID NO: 53991 - DNA, 3435 bp, Oryza sativa
  unsure (1)..(3435): unsure at all n locations
ccccccgctttattgagactacttttttattcttgtataactcctttacttactatgtttatattgttctttaaacgctcaatcgttcaaaaaccacaaacccccccgcggtttgaattgactggcaccttggcannncncccgcagaatagagttcagcctttttttttttggcaaatatagtagtacgtattttttttccctacttctatgtaaacgtacgggagtgtttttttttttgtaatgtacgggagttaggaggaagggatttgccttcttagatctaatttaatggtctaaaataatgggtcgccgatttaagtaaaaattgacggttagatattttctttgtatttaaaattgtagaactttttagagatatgacatgtggcgatctaggagtgtttgtaggagtgccacatggtgatttaaaaacgtttatagaaagttatagatggtgctgccgccggggagagcaaggccaagaaattcctgaagagggcgttgtcgttcacgggtagctcgtcattggggagtgcgatggtggggatcctgtggcctcggacggagtcgtgcacggcggagcagggatcccgacgtccgacggcggcgcagcgagggcgcttaaattataatgagatggagactgggctcctaccccgcgcgtgcgcgggtgattaaatcgcgcgcgggatccgcagcgcggagtcgcttttcattttttctgttttcctttcgcttttctctaagaaaaaaaaataacctttagcacgaagaaaaaaaaaacctttagcacgttttatttcttttttttttttaaggataggacgcggaaaattaggataggtacggagggttaactgcaacaaacttttaaatttaagatttaaaactcttaactcaagatttgaaacttttaacttaaattttaaaaaaattctaagtcaagatttgaaaacttttaatagaactactattaggagtgcagcgcgctcctaatattccaagcgccaaatattcatcagcccaggctcaccccaccccacgtcccgtcatccaactcctaccgttgtcggagtaaacgatttactcctatcgtgcgcctcaaacatccacctttattcgagtaaacgatttacttcgataataaaaacaactcccctgcttccgatcccaccccacgtcccacatcgtgcacccaccattatcggagtaaatgatttactatgataaaaacaacttccggtatatattctatttttcccgtacccaaccaaccactctcgtccccactctattttttacttttttttcggatctgaatcgatccactatcctagcccacagatcggcgacacaccatggagaaggacgacgacaccgtggcggttgatgacggtggccggcgagcggtggccggcggcggttgaggcaaaggcactacttcgagcctcgctgccagacgctaggcagcaccataaccagcaaggaggtgttcacctgagccaatagcaacaaccagcggctgctccatgtcggcgacattgatagaacaagcaagtaaggaaatggcactctgatttgcatctgcatactctccttcaacttcacgcatgaagccctaattttttttgcaaatcaaattaacatgcaatctccaatatcacctgatctcaattgatgggttgcacaagtcctacatttgcacatcgtgctccatgtggctggccgtagaggatagggtggagtccaccggtgatggagattgtttgctatttttcttttgctcgtcatctgtattgacatgaacgagaatgtttttgcatttttttgtgcttgttagatgatggatggctgctattgcgcaacgtcaagctcatctctatactacaccgctacatccttccatgatggatttttggctgaatcattttttttcttttctagtttgattcacctgtgagtaattttatcgcttgtgtgtgattgagcctataattttttcattcatacgactattttgtgatacagatcaacaatactcttagtatcagtttttacactaatactatatattgaatacatcagtaaacatattactacacagtggctatgagatcatggctatatcgagaggaagatggtaattgttttactcgcagaccacgaaatctaaataatattggtaaaagaagtactagagttgtaagctggtagtaattcttttacgaccatttacgtatggcatcatacgatgtagagacattcatgcgaataaatttgttactttagaataagcagatgtgggaggctgggagtaaatgaaaaactccatgagtaaattcgttacttttgaaacgtgcggagatattagaaaaacggaaaacttggaaagaaaaattagacagtaaatattttactaaaacgcgaaaacagaaaaactttagagaaggaatgaataacagaaaaatctggatagttaatattttaccgggcccattgatgaagcacagataagacggtaaagagaaaaaagaaacccggaaggtggggtggtaaaaaccgaaaaaaacaacccgagaaaaagtgggatgcgaaggacaggtggggtggtaaaaaaggggaaacccgaaagaagaagccggtgtgcggcgctcgaattattattccgcgctgtagcgcgtggaatagcgctaccaaacttttaactcaaatttaaaaactctcacatcaaaattcaaaacattcgatttaaatttgaaaactttcataccaaatttaaaacatgcaacttaaatttaaaaactttcaactcaaattcaaatctctcaactgatattgaaggtgaaagattcaatttacaaaatatcgcaaagaaaattgcatgtgtgtgtggagaaaaaagggagtgatttccaagaaaaaaaagagaaactagtgcctatttcccaaaaaaaaaaggggggaggactagcgccgtgactgttgacagtgtccgtgctgccaatgcgtacgcgctaattagcaaattcactaggattgagggctgagaggtgggatttaggtgtcttcctattttgagggtttagtgctggttttgttggatcttgattttttcctcttcacccaaaaattatttggggtttaatttatgtgccctgcaggacatgcaaaagttagattttgtttgcgtagctttttcttttttttagataatagaagctttattgatcttagtcatccaaggatactcccggcctctgcaccacgacagtgcacacagccaacaaactccaacacactcaaaataaaagagaataaaaacagcgtgcaagatcaaggccctacaacccgaagactaggtcgccacccataggggatcctctagagtcgncctgcnggaatgcggactacagtntgttcatccaaggccat

SEQ ID NO: 53992 - DNA, 5375 bp, Oryza sativa
  unsure (1)..(5375): unsure at all n locations
agacagtgcacttcgnnctcgaacagaggcagcaacattaatgaagcaagtggttaatcatgcattttcttacccgcataaacactcgtttaattgttcattttctttatggcagcacaaattaaatcttaaaaaaatatagatttgggaaaggcggaaaaaaaaacccacttccctgtcctatttgcatccttaattaagaggacagctataccttctatcaaagtcaatagatagtgtttggttgtttgctactctctccgttttatagtgtaagtcattcagcattgtccacatttatatagttgttaatgaatctatatatatacatatgtctaaattcattaatatctaaatgaatatggataaggctagaatgccttatattatgaaacggagggagtactatagatgatgacttgcaagtctcttaagtttcgaaagaaataatcacgcaattctgtgtttgactgtttgctactccctccatttcacaatgtaagtcattctagcattttccacatttatattgatgttaatgaatctagacatatatatctatctaaatttattaacattaatataaatatgggaaatgctacaatgacttatattgtgaaacggaggaagtactatagatgacgactagcaagtctcttaagtttcgaaagaaataatagcgcaattccgcgtttcaaaaaataggacacatgcatttgtacagtttttttccttaattcctaaggctatgtctttgtacagtttttcctcttacttaatgcaagtacaccttgccggatttaaaaaaaactccgcgtttcaacaacttgatatattgactcatgcaagcacacgtctttgatcatattgtacgactgcagtttataattaaaaattcaccatgaaactgacaactttaccccttttttagctttttcctggaataaaacagagaaccactttaaaatcattaggtacttatatcctatccataatctatcactggtggagaaaccctttgtagtcccggttcgtaaccccctttagtcccggtttccaaaccgggagtaccaatccgggactaaagatcgctatctttagtcccgggtgaaataaccgggagtaaagatcgatctttagtcccggttggtagatggctcagccacgtggccggttgagccatctttagtcccggttggtgttaccaaccgggactaaagatagagctgaccttttttttttgcatgcccctcttgctgcatggtttatatatatatatatatataacccatgcatatatatgtttcaatacatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccaccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacatgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaaacacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggatgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttatgtgggcaagcggtggagctgggggggcccttgactttgaaggtgccggaagaggagcttgcgggggagtaggtgtaggagcacgaggaggagtcggtgcaggatcctgaggagtagatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcatctcaccgtctcctccagggtaatccagctcgaggtcctcgtacgcgccctcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatataccttctggtacagatctcccttgaagctctgaaactgttctgccattttcttcagagtccaccttttcactttgtcctctgtacccccaggaagggtgaatgtctcgagcattgtggtccacagcatctctttctccgaatttgggacaaagctctcatgatctccgcgtgcccttaatatttgccagtacaccgtactgacaggcacattatcccgcacaacccaaccgctgtgacgtacatagttcttggcggcttaggacggggcactagacgtccatatttttacctttccgtattgatgggcgaccctcaagcttggatgcctggcaggtcgactcttagagaatcccggggccccgagctgaaattcgcctctagcgagagcgtatatacaaattttataaacatgtggcccccccgtcagtattttttattatccaaaaaaaccgctctcgtcttatggtaaaaacactttgtgtgggggtggggggtaaaaaataaaaaaaaaatctccccctcccgcccctggggaaccaattaatggctgtgggaaattcctcttttacagctggtgtaataacaaaaaaggcccccaccataccgccctgtgatccctgaccccaaatttccccccctatagggggggttttaaaaaaannnccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 53993 - DNA, 1456 bp, Oryza sativa
  unsure (1)..(1456): unsure at all n locations
cttgaatgtattataagatttggggtgaatttgtatngtgtgcatgnattagggtggttgatgccatactgcagccgcgcgctaatgatttaaatttttgttaagttgatttttgtgatgctcatgcttgggtgaatggaccgttgacgaagncgaaggcgaaggcgaacgaagcgttcgctccgtccgtcgtttttttttaaacttggttagtattttctctggcggctggtatagtgtaaccgccagcgaaaaaacattttcgctgccggccatcttaaaccagccgccagtgaaaatggatctttgctggcggctggcttaagacaaccaccaacgaaaatgttttttcgctagcggtcgataaccgctagtgaagatcttgattttcactggcctttgctttgtggcggctccaaattccgccagtgaaaacccaaaatggccgccacgaaagatggtttttgtagtagtggaggtgtggttataaggatggtgtcggtggggtcttcttcctcctctttgaagtccatggaggttgcggtgacgatgacatgcaagcagcgatggtggccgtagaggcggagctagcatggatactgtacctcaacagcaaccgctgcggctaggttgggtggaggtgcagtgatggcggcttctattgctccggcggtttcagggacgactagatgtggcattggctagatccaacatgatcctcctgcctagatctgctgtcactctgacgagggattagattggggggtcgcggtggcttgttgaacccttgggcagcggactatggcagtgacaatgtggcaatcatcgttgttggtggcaagtgggctatgccagcctggtgttggatgcacgaccataggcgtgggttgctcgatggcaagcgggtcgacaacgggcttggctggcctggcattcgatgacgctggtaggtgtgatcgcaacagcttgggtcgtagtggaggacacacaatggtgcgtcgccctatgctggagtagacaaagatggggttgacggtggcgccctggtaagggggtcgtggctttggccgacgggctgactcctgagatgacgacgatgatgatggtgtgcaaaggtgggcgttaggtggcatgaagcaaactcttctccagacacatgccctcttgaggcagcggctagccactacaagatggccacgttggcaggcttatactggagagagcggatccactcttctctctcaccctctacttctgcaactcaaagacgtggatgaagtggagcatatcggaatgtcgagctcctacctattggccgaccgataatgagcactggtgtggtggctacgcgttgaaggtgtttagatggtggtagctactagtgacatgcacaccttgataganaagataggagggtaccaagctcgaatatcaanttgtaattcaaggccacaca

SEQ ID NO: 53994 - DNA, 1273 bp, Oryza sativa
  unsure (1)..(1273): unsure at all n locations
actgagtgctnatcgccctgtaccctatcagnannaaccaaatataaaagaaccaaaagttaatgggattaatatttaatagatatgtacttccagtacacatttttcatactaattaaatttcagagaattagcaactctgtgactagccttagcagaccacaatcttgaaattcacagcaatcactattatgcatgaggtgaactatatctttaaataacaacataaagataattttccatccatgcactattagtcataacccacaattcacaattagtgtagtcccaagtaatacgctaatatccaagtccatatgactgtttattcaagttcagttcatcatagttaaattatttatatctgctttataccatgagtattgtgggtgctaaaacagtgtaggatgtttttacttcaacaaaaacgggacaagggagttattagccctgttattcttaaaaaataatgtttgttgtaaaaaaaagttgttaatgtaaaaaaaatggttacctggtatctgagctctctcttagcttcgtttgtggtttcttgatctttgaaccattctcgctaattgaactattgatgctttggacattgaactgccatagtgcatctgattctgaggaatcacttgttgcaatgtcaatgtcatcagaatcatcagtatttgtggaataaaatcttggtctttgctgctcaaactcatttccgtccttttttcttgagttatttctcaggtattgcttatctcttgtacctgaatgcgtacctttggtaaaagaagtaggtaangctggacttgtccctttcaattcacctactgagtaatgggtgtcactacaaccttatggggattcttagagtcaactgaggcatgcaacttgggtatttataaggcaccctaaaaggttggcgaataatgcataactgtttctgggggaaatggataccgtacaaatcacacaaattacaaccggagcaaaaagtaagaccgggggcctaaggggggactaatacaataatgggtggctcatggcggtttcaacggaaaacggtggccatgattaagaatcccacgcgcgggaagccgttggtatgccctttccttctctaacaaccctgccggngtgggggggggggttttctctctagagggatggtttccaaattggttaccgaaaaatttttcaagccccagggcccaccaaggggctgtttttttttattctccccccacaaaaaaaactcttgggggggaacccaaaa

SEQ ID NO: 53995 - DNA, 6700 bp, Oryza sativa
  unsure (1)..(6700): unsure at all n locations
cagagtggctttgcaccctgctctgnacccatatatatatatatatatatatatatatatatatatatatatatatatatatatatatatatatatatatagccattgctggctgctagcctattgctgcaccctcctagtctaaaattcgaaatttgaatggggtgctgtcctagagggcatccaaactgaataaagcataaaggaggcataaaggagatgctaactgctgctgtcctactaaccgcagctgtcctagcaactgaaaaatatgctaaagggtagatgctgtcctgaaaaaggtgaaactacccaaaagcaaaaagaagaatcacgaccaaggaccacaaagacttatccaacattctccccctaagtcttgtgcgtcgtcttgtgggcaagttgggccatcccgatcctggagcagagctcgaggaacttgatcctcccaagaggcttggtgagcaagtccgcaagctggtccttggtattgatgtagctcgccttgatgctcccttcctccaagtagcttcggatgaagtggtacctcacccggatgtgcttgctccgttcgtgaaaaacggggttctttgccagggccagagcggacttgctatccaccctgagctccaccgttccagtgtctctgccggggagatcactaagcagtcgagcaagccagagcgcctgggtcgaagcggcggaggccgctatgtactcggccttgtagctggacagggccaccacttgctgcttgtccgactgccagctaacgaggcacttgccgaggaagaagagaatcctgctcgtgctcttgttggtgtcgatgtcgccggcgtggtcgttgtcgctgtacccgacgaagtgtgccttgccaggacaccttgggtagtagagaccgtggtcgagagtccccgcaatgtagcggatgatcctcttcacagcctgctggtgctccatcgtcggtcgctgcatgaaccgactgacgtagccgacggagaaggccaagtccggccgtgtgtgggtgaggtagcgaaggctccccacaagacaccggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatctcggagtcgtcctggtgcacttcgatccccaggtagaaggagagaggccccagatcactcatctggaaggtggccttcatctcctccttgaacgccgcgacctctgcatccttggtgccggcgatcaccaagtcgtcgacgtagacacccaccagcaaggcatttcctccattgccccgctagtagatggccgcctcgtgcgggctttgctcgaagcccatccctttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagttgtcgttcagaaacgccgacttgacgtccatgtgatggacgccccagccttcctgatcagccagcgcaagaaggagtcacacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgttgcacgcaaggtgcaactgcgcctctaggtcgcgaggcaccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgcttggaggagtggctgttggtgctggagcatgtggagtcactggctggggtggtgtcaacgaagagctcgtcgtagtcgaagtcgtggcccgagggtgtgttggtgtcggagtcggtggggattcgggggctggggtagacacgctcggtgaagaagagctacctactcccccagctccctcgaagtagacgtactcgacggtgaagtcgtcgtacgtcggagtcgaaccatcgtccaccgccttgtcccatacccaccctcgcccttcgtcgaacacaacatcgcgcgcagtgcgcacacgctgtgtctccgggtcgaggatgcggaaggccttcgagcccttcgcgtagccgatgaacacccttggggtgctcctgtcgtcgagcttgccgatgtggccaagctccttggcgaacgcgaggcagctgaagacccgtaggtgggagaccgccggcttgcgcccatgccaaacctcgtacggtgtcctaccatcgagggccttggtaggcgagcggttgaggatgtaggcagccgtcaccaccgtctccccccagaagatggccggcatccccctctgcttgaggagggcccgagccatccccacaaccgtctggttgcgccgctcgacgacgccgttctgctgcgggctatacggcatggtgtagtggcgctgaatgccctcatcagcgcagtacgacgtgaattcagccgctgtgaattcgccgccgttgtcggtgcgcagcacgcgcagcttgcggccgcactccacctctgcagcagcctgcgcatgcctgatggcgtccgcagcctctcccttgctgccgaggaccatcacccacatgtagcgggagaggtcgtcaacgagcagcaggaagtaacatcgtcctcctggtgtggccggtgtcactgggccacacaagtccccgtgcatgagctcgagccgttccttggctcggaagctcgtctgctggggaaaggggagccgccgctgcttcgtcaccacgcagacgtcgcagagctgctccacatggtcaaggcacggcatgcctcgcaccatctccttggcactgagctgcttcagggcctcgaagtggaggtgcccgaagcgctcgtgccactgccacgcctcgtcgtcccgacgagcggcgaggcaaactggttgtgcgacctgcgcgctgaggatgtagagtcgattagtgcctccggttaccttggcaagaaggcgacgacggcgatcccaaatcctcatgagtccgtcctcaaccaacacgcgtgagccgttctcattcagctgtcccacgctgatgatagaattcctcaacgtggggatgtagtagactccggtgagcagcctatgctcaccggacttggcggtgaaggtgacggagccaacacccttgatctccacgccggaggcgttcccgaacttgacggagcctcggacgctggagtcgaactcggtgaagaactcccgtcggccggtcatgtgatgggtggcgccggtgtcgaggtaccacccatcagccttgtcgttgctggagccgttgcagagggagacgagtaccttcggctcatcaaggtggaggaaagccgctgcggccggtgccgctggaggtagttcgatgcttgcgtgagccaagagcagagccggctttttctcctccacccgtgcgacgtgggcctggccgcgtcgtggctgtcgacagtctttggcccaatggccaagcttgccacagttgcggcaggcgtcgtcttgtgccggcttgtggttgccggtggcaacgccctgggcgcctctgcgggcgccaccctcggcacgttttcgcgcccaccgtagctggacaccttcccgcaccttgcgcggcttacggccgcctgtcgaggaagatgactcccccttcctcccgtcaccctgagaggcctcccactgctcccgagtgagatggagcttcccgccaatggtgatgggccccgagagaggctgtggctcattaccatcgacgaccttgaggcgacctaacgcctcctcgagcgacatcgtggagaggtccagcagagattcgatcgagcgagcgatctgcctgtacttctcagggacgcagcggaagagcttctcgacagctctctcctcgtagtaggtgtcgtcgccgtactgcaccattttctgcaagagagtcttgagacggagagcaaagtcatcaatatcctcacctggcttgaaggccaggttctcccactccttgcggagtgcctgcagtgtggacttgcgggcgcggtcgttgctgatgcgtgccgcagcgatggcgtcctaggcctccttggcagtccgcttctgggaaagcgagaactgcatctcgggcgggactgcagcgatgagggcatccagtgcccgccgatcctcgtcgtagtcgacgtcgccgtaccggactgcctcccacatgtgccgcacctggagcctcaccctcatcaccgcggcccactcgatgtagttggttttggtgagggtaggccacccaccgccgggaccaaagtccctgaccaccgtctggacgccgtggtgaccatggcgcaggtcaagggagagagagccgcgctgcctgcgaggggcgcgtgcgggctccgggctgccgctggcacgcccgcgcccgtctgggttcccgtcggcgggcgcgcggtcccttgggccgccgccgccgccgtggaggtgggctgctgcccaccgctctgcccgctcccgtgcccttcctcttgccagctcctcaagctccctgtcggcggtgatgtcaccggcgatggagccgttgatgctgctacgcaaggtctcaacctctacctccgccgcacgtgccgcatcttccgccgcctccgcctccgccctggctgctgccaactccgctgccgccagtctggccgccctcgctactgctacagcggtctgagccgttgctcgcctgcgctcttctgctgcagcgagctcggcgtcctgctgacgccgagtgctcgaggcgaccgaactccgagaccgagcgtcggacatggcgcacctccggggggctgctgcgtggaggggggaaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgaaaagaggatggcactcgagatggggcaattttctggttttcttcattcacaaaacacaaaagccatacctacccgagagaggttggatacatatatatatagccatagctggctgctagcctattgctgcaccctcctagtctaaaattcgaaatttgaatggggtgctgtcctagagggcatccaaactgaataaagcataaaggaggcataaagaagatgctaactgctgctgtcctactaaccgcagctgtcctagcaactgaaaaatatgctaaagggtagatgctgtcctgaaaaaggtgaaactacccaaaagcaaaaagaaaaatcacgaccaaggaccacaaagacttatccaacacaccagcagtgctgtcaggaggccgacggctaggtgagctagcacaacctggtgcggccggccacatggctttccgggtgtgaatcaagatctggatctggaaaaaggagacacttgccttgcggcgaaaggtggttttcacaacctgaaaggagagcagagatgatgggcgatgggaaggggttggggcagtggaagtatggggtggtaggatggatgtggaggcctnntttctctccccttccttgccgttatcgccgccccctgggtttggtctttgttgtcaggctttggtgtccgtgccatcctctcgaagctaaattccctccttgacataataaaagtccctatctgatgggggttaatgcttattattatagagcgcgcttgatcccattttcatataaagaatgctgtctgcatacctccaaattctctattcgccacttctcacctacttcaaactacttggtaatctttcgcatgccaagaaaaacaatacatcgacccttgtcatcttttcttaaacaaattataactacctttcgcgtcaaaaacagataaacgctaccactgtttcacttatccaatctcaatgcccacgtctcaatcctcccttattaaaaatatcactaaccctccgtgctttcctctttcaataatatggacttcgctagctccctctatcacttctatcaatatctcaaaatatgccgctgctagttagctctctcaccatagcctccaataccgtctcgtctgcttcttttcatcaacaattattactaanccgcggctgtttcttctgctatatatcttacataaatcgctcaattttcgcggacgcctctgttaacctaccgaaaatagactacctactatcgttcgcgctgactataatgttcaatacatgacatcaacacactatgtaccatcgtttaactacatagcttttatatcttgcgtcgactccacggccc

SEQ ID NO: 53996 - DNA, 2628 bp, Oryza sativa
  unsure (1)..(2628): unsure at all n locations
ngacgaagagggatagaaaaacatagtgaaaaggtagggtccgatgtccgtgaggaaaagtaacggtaggatggggcgaggcgagcagggtggatatgggcacgttcccagatagtggaacgcataagagattagatcgcaaaggcaaacacggttaagtagaggtcaccgggcgaaaatttagggtcaggtggggccgacggcagaataaggatggacctggaagcgtcgcatgggaaggtatcgataccaggcgctgtcacccagcagtaccgttgggcacaatgcggcacgggcagggcccttgatcagggaggggcctcctcctccccctccccctccacggcggtggcggcgcccgtctacgcccccacgccgcgggaccgggccctgcggacgccgcacagcgggtaagccgtcgcccggagactgatcatcataccctcgattctgattcagaaatgtaggattcagtttggattcctgctttagctcggattcttcggcaatccttttaacatcatgcatgtttgagattcagtatgcctaattgaaatgatgtgatgggatgatgctgtcaggtatcactatgacggcacggcgaggcccttttttgagggatggaacttcaaggtgtccattcccgagtgcaggcagagcttctgcttcatgtacttttgcttaaaaccctttgtttcgagatgggatgagtgatctggaatcggttcatacatggatcgcgcttcactggcgtcggggcacacattcttggcgcctttgataagtacatatgccagttcaccgagaaattcaataacttttggggaagtaagctacttttttagatccagtctttttcacattcaccctcaaagacatttcatttaggatatttttatttccattcaatggtgaaaggaatacatatttgcgctaacaatcagctttttgttctgcgcaaaatcctaaccggctgactgtaagatatttaataaagcaagaatagaagaaaggttattaccaactagttcaaaacaataccaccaaccgccctgaaatcatagccgctctttcatggttacctgaactcaacgaacttgttgcatttcccttccatccttcttgtctggtgcagattgatgaaaagaagcttgtcacagagctttattctgaaccatcacctgaatttgcaacggaaaaggttgcttagtacgatgcaagtatgcaacatgtcctctttcacgcacctttagaatttctaatcagcctttttgagatgagacctaatcaactattttgtaaaagcaagctttcttcatattagagattgatttgaggaaataaatttgtgaaaaaaatatgtttataacaacagggaattatattgtgaaaaatatgttgataacaacaggggcttatattagaaagaccttgtggtctagttctcgaaaaagatatagatgtgtacctgtgtagctcatcacaaacctgttctgaccaataagttggttccagtcttgataatagtgttgtgctgccgaatctagttaatgtgcttaacaagtggttattagttagggatacctaacaattactactttacagccttctgtcattatcaaagttaactaagatgtcaatttgacaacaattcctattggtttatattcgcaaaacctaataagatcagaactaatttgaaatcatgttgttcttttgacggacatacttgtactttcatactcatcctacatcttcccaaacagttcaagtgcatatattcttaggagtcttatttgttttggatgtagtgtgcattccatgcatctataaaggtaaaaagtagtaaacaaaactgcagatcaaaagtcagaacaatgcaaactaagatgcagtgcagatattgattacttcatgcttctgttatttgtagttggtattgtttttcctgttcatatggaactttagtagtgcatcacagtatgttgatttccaaattaataagctgcatttcgataggtaggcatgaactaatgctcggaaacactttcattcccaataatggttcaacacccccagaaggggaggttccccctaggtagattctttatggattcttatgaattgcaaaaactcatataatgatcttgaactattcttcgacttaacattttttcctattaacatatttttaaatgccattcccttgagctactccacatttatttgttattcagtaatttattaaaaaatcttagttttcttggttaaattgtgggtataacggactaactcttatatctagcaatggtgggtccttatgcattaaaatttttttgattatttcacaactacctaatggggatgaattttctttcaataacagaataatttccccttccatttaattaaaaatataaggtggcctaaaatgttaacttacactttcttttgttaggggtctgtatttgacactccttggctaattgtgaggcttttgtttaagaatcagataaaaaatgtttttatcacgcgggtgctgaagggaattaagatataatttggagtttgttctttacaggngagtttttatacaaaagagggtttatttatgtggcaccctatttt

SEQ ID NO: 53997 - DNA, 7169 bp, Oryza sativa
  unsure (1)..(7169): unsure at all n locations
ntatatttatgatgtggtgctcaccaccgtatagaggagaagatattgaacgtcatagtaagatcaaaatcccaataaaagccgacaggattttctcctctctcttgtataatatagaagtattgttttcccatataaaagcttatagagtcgccacattattttttatcatatataaacatcttttcaatgagatggatagaaatacgtggagaacttcactttcataaattgtttcactcccgacagagaaggtgtctccacacatggaatattgtaagtgatttctagaatgtcaaaaatcatatttaatatttttgcattatattgacgaataaattttttttcctattaaaattttttaagagccaattcctataagttccccccaatttttataatccaagtatttacttaaaaaatttaaattttcctgtttaaattggggtaaaaaataacaacccttaaaaatcaagcaaggttggttctttatgacataaaattaattatgattttttcccaactactaattgtgcatattttttttttcattaaccaaatttatttttcaccaacaatattaataataaatattaatgtatgtactaaaatgcatatacttaacatcatctagttgtttaggggtgctgcttattgtgaacgttccttgtccatactgtgcagtgcttctgtattaaagaattcaagtaaaaaaatgtttatttagtaactggtgtgcctgtaagggagattcgcagtatacattcttgtaagctttgatcctttctcagcgtgcaagttttttactaaataatgagatgtcttatctattattctgtttaccctgatatttcctctgatttgtaacttatcactctctacattgctttacatgccaatggctttcttcaagtaatcaacggttattatgtttcattaggaattttctagtcgagttttggaaggcttccaagtgacaccgatttggcatcaaggctttatacgtgatgatggaaggcatgtgcatcttgatgtttatctaagatctattcttgtaactattattatgtttctatgttttattgaaaagtcattacagtttacttactgagcttttttttttgccaatttagtgcgaaatgcttctttccatagctgaactataaagaatagttggatctgcatgttgagaatttatttatttttagctcatcaacacaatgctaaatgaaataacctgagaattgtattctggtcaatcaaaatataatattgtagaatcatgtacaaaatttgaaatatctgcttagtacgaaactatttggagaggaaggtttgcttgtttgtacaaaaggataatagatattagtatccttcgaataccatgatggcaggattttctgccaatctgaattttgaaatcaggcagatggatttcctaatctgtaaaatggaattatgcatttatgcaattgaaaatatgacaagacaaaatgatgagtaaattttagaaaactaaaactatttgtcaaaactattaatttgctacaactttagctaggcatttcagagaactgcaactacattttatgattttatcataaaactacaactttatttgcttgacaagtttggaccaacatgctatacacatataccatactcatgctcctgcaagttgggcccacatgtcataaacacatagggggataaagtcgtagctttcttataaattcgtttgcaattgttgcaattttgtgaaatatgttgttaaagttgcagcaaagtgatagttttaaccatataattgctgttttgttaaatttaccgtaaaatgataaaatgaacatagctctttcgctgtcacttttgaagttcatgaaagcaaacacacttgatacgcttattgccttgtcagaaagggatataaaagtttctatcctttaggtgctccaaatttcttgaactatatattgtgcccaaacacatttttaatagcaaattcaactgtagagaggaaaggtgatgcgacaccatctttgctcatacattgcacttaacttaatataaattttttttaggaaaaaacagtagttcgtgtgtaaccacgattgcaggtaattaagaaaattgctctggatggtttgattgtatcgaatgttacatattataagaaaaaaaaagaccttgacaatgcttttagatttatttagtaatgttatgcaatgtgtttattactactatgatgatgcttatattacatgcaaatcctagagaacaactcctagcagtttatgtcaggactggatacaataccgtaattaatgtttcccttcaaaatgtaaatggggattgagtagaaaagagagtttacactttattgctattaaatgaacaattaaaatttaaattacctgttgctcccctgtcaggtcaaagtatgtgccaaatgtccaaacagctaggtgggagtacagcactcgaccagtatatggctggggtgatgtcacgtcaaagcagaaatcaactgctggttggcttgctgcttttcctttctttgaacctcattggcaaatatgcatggctggtggcttatccacaggtttgtatttctttgtatttgataaactgaacagagagatatttaatttttctttttacctactggttttcattctaggtagatggcacatgtgccactgagtaatttactgaatgatacattcatctctcatgtgtaaaactatcatgtacgatggagttgtatttcttagcctaaaatgtgaaaattggttttccattgatgaagctttatttcaaattttttctttaatatttctgtaggaatccaaattgcactaaaaaataccaggaaatgtggctagtcctatctatatgtccaatccttttattccattcagtatgatttctccagttcagtcctgtagtagcgcacgattgattgaggtgatatgatatagtgttaggaaggttataataatattaagttaatagttcaatactaacttctgcaacttaactactcaggatggattgaatgggacggagagcggtttgaatttgaaaatgctccttcttattcagaaaagaactggggtgcaggttttccgaggaagtggtattgggtgcgtttttctatcttctttctgaccattaatcctgatgtaatggatacactggaatactgaataagttttgcttcatttacagatagaaaatatgctgtttcttgctgtaattctgtgttttgtgttgccagtaatgttcacccgtagtagcttttgggctgtttagatcccttgcctcacctggatttaagagtttaggcctccagtaacaacaaaaatgcttgctttgcctggcaatctcacctcattgagcaaggatattgttagttccttgctcacagggcaatgtttggcttgcatctcatcctgcatctctttatcaaaggaagctgggtgaaggttctgaacaaacccaatatgcatgaaggtttcaagaatggcatgcaatatgatggttgtagtggtcatgataaaaaataccttctttaaacatagtgtggtcggttgaaagtagtcaattttactggtacatttagtcatagttatagaggttatgcacttttaaatattcatgatatagctaggttacaaatacttgtcgcttcacggttcgtaatgcacattttccaattttatccatattaattatctagttagttgtggagggtaatatggtcatttaacatgaaaacaaatgattacacaaatttatgtgccatggttaaaagtgacaagtaaacgtgaatggagagagtatgttttagtttgactcaaaacttcacatgaatgaccaaacttactgattgaacacctttgctcatacaggtccagtgcaatgtcttctcaggcgcatttggtgaagttgcattaacggctgctggcggattaagaaaaattggattgggcgaaacctatgaaagtccttcactggtagagtcctgatactttcagcttttaatctgatgcatacttctaatttgttctgcaacttagctcatcatgcaagcttgattgctggatgtctgccagactgccagtaaggcaaaagggaatattattgatcaaccagttggcctaaaaattttgactgacaaaatcttatccatttccgaagtatgggtttattttcatttcaggactggtcattgatacaacattttatggatttagtggataaatgtattgctggtgatggttatgccacaaattagaatcccctttaccgcagtggttttaagtttagatcttttttgtgtatgtatcatgaaagttacactaattgtatgtatctaggcgacttttcatcccacagaacatttacatctagacctttgacagtcgaaacaaccaacgtacagaaaagccaccagggtgagtaaaaagcattggcagcataagcttgtgtgcagcctgagacagggttggaataatctcttgttccaaaaagaagtgcagcatgctttgtttcctttaaatgtcctgtggtgtttctgtgatgttattatggattcttcctcttttatagaaggtccaacgtcattcttatccactttcttgctttgcttttgtactcacatccacatcaacaaaaccatgtatttattgagaccaggtaatagatatattttctttagccagtaatttcaatacgatgcttgtttgctttgtgccctgcatattaactttcataagaggaagcatacaatgatcagacagaagatttacgaatttaactatgcacatacataacagttctgtttgttccctgcagattggaattcattatgagggaaaattctatgaatttgtgccttggaccgggacagtgagctgggacattgccccttggggtcactggaagttgtccggcgagaacaaaaatcatctggtaattatcatccagcgtgctgaaaatgtaatgcagtgcctgtgctagttggctactgttcacattcgagcaagattcccacttagctttcttacttgtattatagattctcttaggttgtaaggttacttatgtggttctatgttccttgattagcattcaatgttctaaaagcagattatctaggtgctaggcagcctgctggcctagtatccaattaagtgccaggagctgatctatcaccggactagtgcctagcacctggtgaatgcgacccttaacatgcattgctacttttctacaggttgaaatagaagcaaccacaaaagaaccaggcactgctttgcgagctccaaccatggaggctggactagtgccagcatgcaaagacacctgctatggtgatctgaggctgcaaatgtgggaaaagagaaatgatggtggcaagggaaaggtatgcatgcatgataataaggccatcagaatttttcagatagctgatgtattattgcactattactcttgttgcaaaatctaaggtgccagttgggttagctgcctcgaaaattgaactttattatgcaattcacaaggagggccagatgtagcatataatatgcaaatcagtatgcggcccaaaagtccactactaccttcgttccaaaaagagtttatacatgaatttggacaagcacttgtctagataggtgtagagaaaacgaactcttttgggacggaagtagtaatactatttttttctagattagcttggggctgtttggatgggactaaaatttttagtctctgtcatatcggatgtttggacactaattagaagtattaaacgtagactaatgacaaaacccatttcataaccctggactaattcgtgagacgaatctattagccctaattaatccatgattagcctatgtgatgctacagtaaacatgtgctaattatggattaattaggcttaaaaaaattgtctcacgaattagctctcatttatgtaattagttttgtaagtagtctatgtttaatactctaaattagtgtccaaacatccgatgtgacagggactcaagtttagtccctggatccaaacaacctaatgccactattttgccttaggaaatattgaaagttaaggacacaatgaactctgatggattgatggcctctatagttatctgcccccggagcaactgaaaatttattaattcatatatgataatatatgcatgatactatctgtcctgtcaggctctccatattcaaatactagaaaatattttaataacactctttagcctttacctaagcacattgtgggatcaatttctgattctgcacatacatggtcactgttcagtatagacacttttattgaacagaatatagtgaccgacttcattgatagtcatcaaggcatgtaaccatgatccaaatcaaaaaaactctgcttatttactctaaaaaactgtaacaagattatatggtgcattaccaacaaggctacaatgtataaaaattcctagttgttttcagatgatactcgacgcaacaagcaacatggcggcactagaagttggtggaggcccttggttcaatggttggaaaggcacgactgtttcaaacgagattgtgaacaacgttgttggtacccaggtcgatgtggagagcctcttccctatcccatttctcaagccccctggtctgtagcattgttcaggtcgagccatcgataggtagagatgaataggccctccaatcttgtcacaccttgagtcttgatctgttcctcacttagcatcatgttttcagccagagaactacagaaacagtaaaccaatcagcatggagtttattctcgttgggttagagaaaggcgcctttcgggtgaaatcatgttgcacaaatttttacagatcaggaatggatgctgtaattcaagaaaataagtataattcatcttaggcagttccatccttttgtgctcatctgaacttctgaagtatcataaagaagtgatagctggatgcccgggcctgcatctgcaattgtggaggtctttctggtcagaattggctggaaacaattgttgttagcacacttcatatggtaaatctttggggatcctctagagtcgncctgcnggctgcgggatgcagttgtacaaacaaagccag

SEQ ID NO: 53998 - DNA, 2230 bp, Oryza sativa
  unsure (1)..(2230): unsure at all n locations
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaccagcgaccccaaaaaattcatgacaaatccatctatcatataatgctatgccttttcttgcaacgccataatcccctaatatacattcctttccaaccattgggccaattctgcccctcccaatgcattcagtcaatacttccaagcattccaggaaatccctcgacctcatgcaagccaattctgccacctccaatgcattcagtcaatacttccaagcattccaggaaatccctcgccttcatgcatctgaaaaagctgccagaaaatccctcggcctcatgcatctgaagaagccgctcagtgttcccccctgtatgtcttcacttccaagcattccaggaaatccctcaccctcatgcatctggagaagccactcagtgttctccactgtatgtcttttcaagtatcagtcaccaaatatttaataacccctcatagaattttttgagatacactagtgaagttgaagctggaattcttacatactcatcttgttggtcagcacaaaaagcatatgctaacatacgcataactgcagtacatttttataagggtgaatgtcctggccggccaagtacattaagacgatgtgtgaagtatgaagtggctcaacaatacgaaagaacaatgggtttcttatgcgaaaatgatgacgaaagtttctcttcattgtacactggattatcctgttggtattttttatgaccacaaataaattcgcaagcacacgaaataccactgttgcactttaccttcgggtgaccccaaaaggattttgaactcagggaacatgtataatctacctaaggctaagacaatccaaggacaacaactattggtaggctagctaggctaaagaggactttctatgtgttttaattatttaagctaagtaaaggtaatttcctatctgctgcttcgggcaccgacccttgctagtctgccagcatggttccggctatagctctatgatgcatccgaacgtggaggattactaggataggattcagggctgtcaccaactgtcgtttacctctgacaaatccatgggatacacaataaacaaaggtaatctctaacctagacaccatgcctaagttattaattactaatctaatacttgtgcagaaacttccttctttatccagagtctagtattggagcactcagtacgaatactaaacaatgaacccgcaaatatgaaaatctatcttagactaaataattaaataacataagaaaagatcccgagcagagtgtaccgacagctccggtactcctccagaattcctcctagaaagctacacccattgaggtagaagtcggagatagcgccaaactttcgggcactccttcagagcttccccttcaccctctacctattttttaatgtacaaaagatacaatagagcctcttataattcagctcaaagttgtgtgtgttgtgaagtgaagtgagcttcttcttttatagcctccatatgatggttacaactatgggaattgtccaaaacaccctccaaccgtcattgggaataaatcaagagcgtaaacgtggaagatggcgatcaacggccttagaacaggtttggccgaacccaaaaacccacattttggccactcctttggctgggaggttgttaatgggcccccaacatcatgtactatgatttggcccaattataagtggttttgattgacatatgggccctccaatccatgtaaatgtgtcctgattgtccggaggtgtattttgtcgtatgacggacgtgttttctccttaatatacctgcattcaaatatttcaccaacactagtggaaatgattaggaataatccctaccactaagttggataccatattttatttcattatatacaagtattgatggtcagatattatgatttaagaatcgtcaacagtatgatatttccttccattgccctcaatgggatcagtggaattgttgagccaagcactaaccaacaattcaatgtagtggggtaaacatactagtttcactcaccttaatatcatcttcatttaaataaaatggaacaaatgnnnnnnnnnnnnnnnnnnnnnnnnnnnnnnnngacgatatagcactcaatcgtg

SEQ ID NO: 53999 - DNA, 1354 bp, Oryza sativa
  unsure (1)..(1354): unsure at all n locations
gcgcgnctttgattgtagaacnnnnnnnnnnnnnnnnnnnnnnnnnnnnnnnnnnnnnnnnntacatttttactgcaagaattgctacttcagtagttttaggaaaatgtaaaagattgggcttcgtgcagtcagttctcactttctggaacatcctatcaccaaagtctatcatcatggtgcattagatgaaactaatcgcatttctgatacaatattttacagttcacagcgaacaaacagtaaacagaggaaacgcacaaacatgcaaatttgtccttgttcatgaattgctaagcctacattaagacttgaggaaaatacacagagtgattattagcgttcaacggagaaaacaaatggagatgttccgcacctgtaggccattacaaagcttactctgtgggggcaaataaaccataaacattatcatgaccttgtggttggtgtagggtataactgaacccatgcaaattcctccttgtagctgacattttgatcgcatgatcctttacatgtgtacacaacaattgtttgccaatcaagagagtcttgctcatttttcacaccaaaagtataaagcagctgtggcattatctgcagtacaaataagtgtgatatgtaagcatgtctgtgtgaaaaaaggggtgggtgcctgtttgccccttactgtcgtacaccttaggaatggtaggtctcactgattaagtagaagaaataatttgaactgatgggatttgaaagaaaataccaaactcaacataaaggctgcagaagtatttgataatctcatttacagtactattttgagcagggtatgaattcccactaagccatggtttattggataccagcacaagccagtaataacaaagagccaccgtcgggtatatcttggctcagtctggcctggtatcacaactggttaacaggcagttgagctagcagccattaacttttgggtcttgactctaaaattgatgcattggtgtctgacaatatgcacagtatgtacccagcgaataattcatacagcaaagatataagggcaagatatttggcatgagggagtagggtttgcaaatttattacttgtgttgcaatgtgcaactggatataagtgtatacccactatatttcagtgacggaatttgccccagaaaaaaaaagaccaacctgaaattcatagcatagtggacctctacagtagctacatgatgggatatcggcatttgatggacaaccagccgataacgcccatagaggtttggcattctcttctcgacagtatctgcataatgtaagcaagtttattcgaatggggccaagcaggattccatnntcaaggcccgcg

SEQ ID NO: 54000 - DNA, 2003 bp, Oryza sativa
  unsure (1)..(2003): unsure at all n locations
tcccaacaattagaattgtgtttggtgttttaataaaacattaacggctacccgtgttcttttttattaattgtaanaaatacacccnncaccccccccnnagtgtgatgattgcaacatngactcgnacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagaaaaataaactatatgtaggctattatctgagaatagcagctagcttcccacgagattctaaggaaggacctgttaaattttttgagtggtacggaataatcacccaccatatgctacatgctagactcaatcccaagttagagggactaacccagacgatgaagataccacgctgtctctcgacggcgactgatgcggtgacagtgggtagaatggcctcaccggccaatagcgcggtgctgtttgttgccggatccaccaaatccttctgcattaaaccaccaatgcaactcgagcagaaaaaccattagatttcaaccgcatagcatatgacatatctctctactattattatcaaagtgcagccatcctagcttctctccgtgtctctattaggaaaaaagaaccattctaccaaaaacggtacacccccaaaactggcaaaccgagaaaaaaatggacagaaaaattgaaccccacttaaaactattaacccgtcttttcacacaccatgttgtaattccacaatagtaatatcagctaattgacatgtatacccttgatcgcgtgagtaggtgtatatatacctgcatatcgatgacgagcatggccgtctcactccactcgtcgccggagccggccaccggcgccatggatatcaccaagattcgcacggccggacagctcgatctactcgatcgggattatattaatcctcttgcgatgtagtgtgtgactgtgtgtactagctagcatatatagcactgcctgatcatggagagaagaaaatggcagcactggctgggtcctttttatggttggagaggagcatttctataggtatagcagcagcagacatgacatggacggtgatcggcagcgaccctagaggtgcgtgatcgacggtaggtacgtctaatcctcgtacgctggaggactagtctcatggtggcgacacgtacgtacgcccctcctctaattacttttccacactccatcgcgtcgatcgtctcatctatcgatccccggtagtcaatcaggggcagggcgcattgccaacc

SEQ ID NO: 54001 - DNA, 1381 bp, Oryza sativa
  unsure (1)..(1381): unsure at all n locations
gtgggatgaatgctatacagcttcgnacccnagaggcccggtccatccaaacttgcggccgcatcgcggcatccaccaacgaggccgtcatctcggcccgcgcgcgggcattgggccacgggggcatctcgggcattccggcccacgtatcggtgtaacggcgaaatcactagccgcacacgcgagcggagccggaggaggagacggagccggcaggatccaccactgctccagctttctccactctcactccccgattcgccggcgagcaggcggcggcggcggagctcaaggcttcctctccgctccgcaggtaaacaccaggcaccatcccctcggctgtggctcccccgttcctcttgtcccactctctcttggccccgaccctcgggagtccggcgctaccgaatccgtcttccccccggagctgtcgaaggagcgccgcgtgcggccgtgctactcccaccgacgccgcgtcacctcgaaggcgaaggggctcttctcccctcccctccaatggactgaggcgtatcccgtctaggccgatttcttctgttgagacggaagccctaacatagctagattgctttttccaatgatttgtcgcttgctaccagcaatcaaatccttgtgttattttttgcttgtctggggccactccaatccacacatatagtcgcatatttgatttgattttattactcgaatggcagcttgctttgcaaaattttcagaagcgcaactgaaccctcgcgcctgatatctaaatagctgctcacgaatccacctcccttattgtgtaccaggtaccaagatgaaggtcaagattcttcagtggcattcggtggcttcttggacatgggacgcccaggatgaaacctgtggtatatgcaggatggcattcgacggctgctgccctgattgtaagttccccggcgacgattgcccgctcatctggggctcctgcaaccacgctttccatctccactgcatactcaagtgggtcaattctcaaacatccacaccactttgcccaatgtgccgtagggagtggcaattcaagggctaatggcatctgaaattatatcactagtatctagtttgcatgtttccttgtagacccctgcaggaaatcttttctgaaacataaaaatgttgtcttcaagtactatgtactaatattttctgcaaatgctgatggtcacaatctgctaagttntnctgtnancccgtttgttnnntgtcaaggtcgacatgcattcaacatgnnngggggnnnggaagagaagaaattaaattttatatatatagacaaaattcgnaattattattatgannaaagacgcggaaatttttagataatacgaacacctaatttgtg

SEQ ID NO: 54002 - DNA, 1381 bp, Oryza sativa
  unsure (1)..(1381): unsure at all n locations
cgacgcgccttgaattgcgacccngcttcgnacccgccgnaacttgatgatccatcctcgcaggacctcgtttgccttcgagcgcccctagcttcggatcagtgcgacctacagcaccggtttctcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcgggaactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtaccagacggagagcaaagtcatcaatatcctcacctggcttgaaagccaggttctcccactccttgcggagtgcctgcagtgtggacttgcgggcgccttcgttgctgatgcgtgcccgcacgatggcgtcctaagcctccttgcagtccgttttgggaaaggagaacttgatttgggcgggactgcacgatgaggcattcagtggccgcgatcttgttgtaatcgacgtgccgtaccgacttgcttcacatgtgccgaacctgagcctcaccccatataccgcggccactttatgttgttggtttggtgagggtggccacccaccgccgggacaaaaatccttgccacgcgttgtacccgcggggaccctgcgcaagtcaaggaaagagaaccctctttcttgaagggccgntgcggtcctgtttcccttgtacccccccccccctttggttttcgtcggggggcgccgtgctcttaggcgccccgccctcccggaggaggtttatgtccaccatttgcccgtctcggtgcctctcttgtgcanttctcagaacctgttgtggagagttcacgccgtgtgactcttgtcttctcatcaaggtatacattcatctctggcacggggcgtatttatcgccctccctcgctcgggtgtgaacatccgcggcgagatgagcccttcttttctacgaggtgtggacggtttctctctctttttggtaaagatctatctctactcctcactctctgaggacct

SEQ ID NO: 54003 - DNA, 873 bp, Oryza sativa
  unsure (1)..(873): unsure at all n locations
gactggctttgaatgctattcagctccnacccgacctactgatccaacatcaccgccttctgcaacggctaggacggctacatgggagccgtcccacttgatcccatcacccccaacctcgtcaatcccaacttcttcgacctcgtcatggccaagaagatgccgctcaccgtcgaccacctcatggggatggaccgaggacgtcatccggatcagctcgctaaacctcgaggagatgatgggctcctttgagccggccaacgaaaggccccttccatcgtctcgaagtccaggaaggtggcagcaggcggcgccatggaggaaagaatggcggccggtgaggcgaagacggttgctacggacactgagaggaagccaaccaggacggcgccgactgtgaggaggacaacgtcggctgaggagaagacccctcctagcgtctacaggtcggcaagctctgccctttttcctcgccggccactactcgtcctcccacccttccagccgccgccgcatggatcccggaggaggaggagatggggaggccaccgctgggtcgccgcattggggaggagacagcgagattggggaggaggactggaggagacgtgggtcccaccgtaaataatttatttttaatcgaacaatcacttgcatgggattgagtgagcttccctaaacccaggcagcttggtaacgactaacaacatatcatcttagctagttggttgtaattattctatttactatgcccttcatcccaaaataagtttatttttcacccataccatacatgccaatataaaaccaagagnnnnnnnnnnnnnnnnnnnnnnnnnnnnnnnngagactcagtttgtcatcaaagcccag

SEQ ID NO: 54004 - DNA, 3316 bp, Oryza sativa
  unsure (1)..(3316): unsure at all n locations
gctcactcgcttttattatcatctagtaataaaatttaaagggttgcgcgcgctttttttttaacaacataaaagatgtgctggctgctcttttttatnnncataacccccccccccgtggcatgatttgcttttgacnatccacttggnacccgnatataaggggattatggcgttgcaagataaggcataccatcatatgatagatggatttgtcatgcattctttggtgtcgctggttctaacaatgatataaacatgctcaattagtcacccatcttcaccaaaatgatatttgggacagctcctagggtgaggtacacagttaatgggtatcaatttgagtatggttactacttagctaatggaatttatcccaaatgggtgacgctaattataacaataagttaccgcaaagtcacaaagaccagttgtttgcagctcaccaagagtcaacaagaaaatacattgagtgtgccttcgacatcctgaaggcgtgttttagggtggttgttgtgccttgtcgattgtgggaaataggtggcattggattgatcatgatggcttgtatcatattgcacaacatgattcttgaagatgagagagatctcccaccctttgatcataatgacaacaatggagagttcgaggttgacgaacccgagtataattaaggtgcactggatgaatttgaggctgtccttgatgaggacacaactagctcagatataagcatgactaccttatgtattaatcaaccaaaaggtgcatatgttctatattagatttacttgttatatatttaaacaaatgttgctacacaatgagttttgggtgttttcatttccagaggtacttgcttgggcgaaagaaaagagaccgaacgtaagaaatgcatggatgattgaagaagttgattggggaccaaaccaagatcttcttcaagtcttctttcattttaccacgttacttttggtccatagaacacaagagacaagagacaagaggaatgcgtggtcccgatcttccgataggtatagataaacaatcgatttgggcggagtcgcggcacaactcgattcgggttctgaacgaacacgctactgagccctgcaattgtagcaccacgtctcctttggttatcaaccgtgccgaaacccggttgacctcgccgagaaggttaatccctgcatgcgaatcgaagaacacaagtatgaacaagataaattgcaacacaattgcatatgaatgattaagcactcgaatttggggttccacaaaccgatctagcatcaaaaaagttcttgacagtttaatctaagcaaaacccgacactaaacgatgacggctactgattaagtatgattagggacgtcctagggttgctctagggcgcacacccccttgggctaagcccacggcacaattacaaggcccaaaacctaaatcagattcggactggatgagatacgtggctttttttgcagattcccggcagctcggtaggaattttgacgtgagaccaaaaccatctgaaagtagattccataagatttccaacaagtactcatgggccctgaaattccttctagataagcgactatgtccgtttgaagttgatgctgtcaggaggcccgaatccaaattcaaaacctgtacgactttatctcttgtcttctatggaccaaaagtgacgtggtgagatgaaagaaaacttagagaaggtcttggtttggtccccaatcaacttcttcaatcatccatgcattccttacgctcggtctcttttcttttgcccaagcaagtaactttgcaaacgaaaacacacaaaactcattgtgtagcaacatttgttcaaatatatgacaagtaaatctaatataaaacatatgcacctttggttgattaatacataagttagtcatggttatatccgagcttgttgtgtcctcatcatcctccctttcttgattggaaaccgtcctcggtttcaccttgtcatggagcgtattgaacttatctttatctatcacaacatccggtgaggaacatttcttgatggccatatggttggattctaaaatctttgtagtcgaaaaaccccaacactccctttcttgcaaattaacttgtaactcatttaaacaactagaggaactagaaagagaattacttatacgcatgcggtcctctagaaaatacattttatcatgaaaaggaggtatagtcaaattcgaacaaatatatactcgatgcacattttattctcctttactatcataattgctaataatatgtaaaatcacataagaaggacatggcaattcaaatctagcaaataatttcttctctaaacagttgagtggacaaagatcatcaaattgaatataaccccaagtattcaaagaagatagcagtttaagctcttcattctcgctagcaatatgaataacatgtttaaactcaacacatggtggctttactatagaaccaacatgttcattcactagttgtggcatggatataagtgaagcatcgcacaactcttttttatcacaagaaacatcaagcaaattgttttgtgacaaaggtatttcaacaatcgtttccctatgggttgctctaatgtagcacaagtactggatatagttggtacatcataaatatgcataccttgattagttgtagcaccattatcattacatttattctcatcttcacaaattataggtgcttgtccaattgaacattcttcaagcatgcatgaagctatagataggtttttttctcttcgtctttcttctcttcctcctcatcatcttcaacgtcggaaggtgcttggttgtagcccatccttcacgtagcaaacgttatgccccgttgacattagagcaaaccctctctcacacgatgtgccaaaattccaatgagccagacgggtgggacaacttgaaatccctgaggcggtgcggtccacgtcggaaggttgacaagatgagagcacctcttattgaatacctgcgaagaacctttacctgaatctgcaggtcgtggaaaaaataattttggcgctgcgggtnctccgggtccncttggtcgcttgctcgctcgtggggtcgtccgggnggtttgaaatgggcggccccgtggttggtttcgcccgcggcgtggctgcctcgcctgtttgtnttttnttngccggnggtgcacagttgtcacatgaccggggggggggggggggagaatttatcctgcaacaacacacgaaatttataaatagagngttaaacagatataataaacgttttacatctta

SEQ ID NO: 54005 - DNA, 6500 bp, Oryza sativa
  unsure (1)..(6500): unsure at all n locations
ccggatgaaatcaantctgtttgccagcacgctgactctagaggatccccttaataagttctttaacagcggggacctcccttgcggtatttctttcaaaaaaacacacaatatgatagccgcattcacattcatccaaatacacatccaattcacatccattcatcaactaacacacaatatgatagtcacattcatcacattcatagccacatccaaattgacatcaatttcacatccacatccatatccctccccccctcccccccccccacacacatattggctgagttctttcccccaactttcccaactcacctgcctcgtggttccgtgcgcacgcttttcaaactactaaatggcccgttctttttgcaaaaagtttctatacaaaagctgcttaaaaaatcatattgatccaattttgaaaaaaaatagctaatacagtacttaattaatcatgcgctaatagactgctctgttttttccatgcgcaaatgggtttccaacacacacaaacgaacccaactatacaggagttggaattttacacctaggtgcatatgcaccagcaatctgcaccattcatttgcatgtgcggatctcaaagtaatgtacgcttagccccggtaaaatgtaccaatctagctttgtccccttatagtaaaagtagaggatgatacataatgcatttttttatgactgaaatgtccttcaagtagtactacagtgcaattcaatatgtagtttttgaatttcttttttgttgctgcatgattaattcatttcacatggatgctcagatcctgcaagcagtatgtcaatacacaatgatagatgtatcttcccttgttaaaaaatgatggtatatatcttcttgctaaaaaaatgacaggagtattattattttgagggaaggtcagaatttacagcaatatatggttacctttctaaacacgaaattcacacttttctgccatgtggagattatgatctgagtatagtgtgatgtatcttttgtataacgacacctgtgatataaactattactgtagtttgggatatgtatggtgtggaattgatcgatgaagaaaaaattgtgtacctttgttggcatcaaaattcggaatgtcatgagttaacgggttttagagatatataaaacttttagtgtttagttccatattatgttcttaatgatgtttagtgatacatcatttacaaacctatcattaagatttataacttttgttcattttaagataaaaaaacttgctaggagatatataatttgcaaatgtcattgtatatcttgaaaatgtagagaaattttgctattccaattgcaagggaattcttatttttgttttgggtcataccacagggtctttcttgtgtgtaccttcagagcgctttgtaatttatagcacgataaagtcccaacgcaattgtgtttctttttcctctaatcttcatctctggtttattccagtgaactgtgaattgggaccgtataaaccacagtccacattattctctatagattttaataaaattaaattttagcatgttggcaattagaaaggatgtcctatatgtacgtatgagttttacctatatattttatcgctagtgttttttgcaagttacatagacaagccacacctgcaaaattagatttttagcatgtaggagcagtgaagaaaatctaaatagcatatgaagtgaaaaaatcaggtaagaggggctagctgaggggcaaacctggaaggctatggtgaggctgagtgagaggttgaaaagattaaatatcacttcaagaataccagtagcattattagcacttgatctctctgtatgtatgcactatgcacgcatcttatgatgaaatgaacaaaaaaacaaattcctatgaaatgcacgcatcttatcattttaatggcccatggtacgtttgactaatcctcatgcatacacgtgattttggacaaggctaatggagtaggcgagcaactgttttcacattgggccatgctaacgacatctcaacaatataatttgtcctagctctatgtacttcatttatttactcttttggaacacatgatttgcacccaaaaaaaaagtaggattcaagtggcttagcacttcaaatactaaggtggggaaaaaaaaactttggaaaattgcatgaatgatcatttagggttcctttgaaaaaaaaatagaggatttttggagaattaaaatccgttggaaagttttcctacatgggactttggaaaaaaaggaatgtccctccccccaaatgctttaaaatccgtatggaatagttcatttcataggaattttggaggaaaactaacatgaggaaagacggtcccaaaactacaattcactcttttatttatttcaacaagctaaggcacagctgcatgaatacactatgcgtggtaaacggcaggcaactttactggaaactgttaggtcctcatcgtttggcttattaggaaataaaaataaatttgtagataaaacttttataaatgtgttcttcgtgacttaaaagccaatgttgaaaaagaaactacgttgaaaatatctcaaaattaagtttgaaaattcaaaatttggctttttctttggctgattaggccatccgatgagggccttagattttcatcttacaatttcaaaaatcaatcgtcaaagtagatatcaaaatccaccaggagatttactttttctccaaaaaataaaaggtgtcccaaaaaagaaaaaaaagggcttttcatcacacaactttcatctagatatcaagaactttctatcaggacagtttcaaaagacttgtaaaaagaaggtttttctgtctcacaactttcttctatctagaacaaatcatctgcaattctgtgtgctccatgactctaaaacacataaaactgatagcagtaatcccaatatgatcaattttatataggaatggttaggagttgtacagttgaatatatatatatatataaacagtatctgctgttggtctacctgacataaggttaatataattacacccactgagatggaaaggaacagggatgtctccaatactttggagttgagcatgtagtatatcactagaaacagcaattttatcgtcgccattcttccaaggttggtgtttccactccgatattcttcatatctcttatatttgctggttaacataaaatagtaaccttcagtcaccagtaatctcagagaacagaataaagacaggaaacaaactccagattcttttcgtcagctgacaaagcaggaagaattatagttgccaacaagagctgtggctgattattaacttattgtaacctaatacttgcaacttcgatgctaaattattgcacattgtgaatatatcacatattgaaactatatatttattcgtattgaataggattttacaagtttccctaccctttgattcctacatttgtaacgcattcaaactgtactaatatttatagaaataaaaggctaaatcacctgttgtccaacatagcatgcgatctgacaagcagctctagagaacgaatcaagtcactatgcaataagaatttgatggaaccataacatataaagagtctatcattaaatgagcttagctctctaggcctacgtgctattccagaatttcagtgtttacccagtaacatttacatcaccgaagacaaaatcgggtcgtgaacaaaatctggtatcttaaaatagagcacttaattggcatggaaagttgtcttttagtttgaaaaggtgcatctaccattaatctaaagtctaaacatgtcatgtccatgtcaaatcaccaagatcaagaagaggaagtgagaaaaatgattactcacacagatggatctctggcctagcagcagctgttgcatcaataatgactgtcactttctcatagtccaatgctacagcatcaaagactgtctgccggatgcaatttggtgtttgaacccctaaaaaaccataaacacttaagtaatgtgattctgagcaatgcggtagagatcctcaggcacaaaagaaaagtatcaatatttgtctgtaatgtactagactacaaaacagtactgtgcaagcattcaatttcgggacttttcaccacttcatatgatagtttttactgccattatatgtccacttagaacataaggatgttgaaaattgcaaagtgaataaagcgaaaaagaattgctacccttaaagaacaaacacaaaacaacaagaatttattgtcaagctaagaaaacaatgttcacctctgtctcgatagatggatatcagtgcttaccaacgataaccaatttctttattcctgaggttttgaggacagaatcaaggggtgtcgcaaagaaagcactgaaccttgtcttcaccaacttgtattccccttctttgataacaagcccatcagctagatcagcacctttcaaacctttcactgttgggcccttcccaccagaataatagcgtctccgaaaaatttcaacatctgctccagaagggtcatgctctctgaccacctacatgcagtcatcatcaaccaaggtctcagaactcaaaactatgaccacatgtaaatctattggcattaaaatccctacctggtgaagcaaaatgctttgcataggaagggggaaatgtagatcacattaatacaggttagctgctagttttgcaacacgtccaatgattatcataatagcatgtttagtaaaattcaaaattacatttaatgaaccatgaacatgtataagttgcagaagccaattcaaaagaaccaaattttagtttcatagtggaaaccgcacctagcaaattattcgctttgtagattttagaataatgtcgtgcagcgccaaacattaaacaacacacctaccttctgctatttagagatgaaatagagggagtcagtcacctaatccagcaaagcagcgaccctccaatatgaaaattggttttcatcagataaaaacaaatgtgtgtctactataccacataaactctgttctttgcatacactcatgcagaaaataatgcataatatctggtttgttgcctagaatatggttctaaatgacctgacagaacaagaaatcaaaagataacttctattcgtcaatcagtctacagagtgaggaaatgtgagcaaccattgcaattccacgccattaaacgttgaaatgctggcagatgctgcacctgcaaaccgaaacgacgagcaggatggtcaaaaaccaaaggaaatccacccacgaattttgatcccacactgctgcacatacattgcactgaaccaagaaatctgtggcacttgcttagagcaccacaggctacacaagattcctcctgaatccgaccacgaaattcgcagtcctcgtcgcattcaaccaaaccaagcaaccgagactaaacaaattattacacgaggacgaaatggagcttcactaatcaacaagaaccgagccaccccgcgagaggagagagagagaggggaaggaagcaagaagtgtacccagacgacgtagatgccgcgctccctcgcgacggcgaccgcctcggcgacggtggggaccaccgcctggccgccatccaccagcatcgggctccgcatcgccgggtcaacgaaatccttctgcaaatcccacatcaaccatcaccaacccaacatctccaaaagaaaccaagaaatttccccacacacacacacatacctgcatgtcgatgacgagcatggccgtctcgctccacttggcgccaccgccgcccgccgccgccgccgccatggatcgccgcgatttggacggggaagtcgagatcctcggggagagccagcgcttcttgaggtagtggaggaggaacttgtcgagggagaggagcagcaccagcaggcacgacatcaacgccagatgtgatgtcataaatcaatcccaacaacaaaaaaagaaaaagaaaaatatgatgccgatgcgatgctgcagataatatgactttgttttcatcccaaagctcactgtttgaaaaagaaaaggaacgaatttgtcaaaaaaatggattttcggaatgctgtggtggctcctgcagaattgtgaatctgggattctggatgggtttgaagtgagtgagattcagaggattgtggtggtttggttggaaggagttggtgagtggtagtccttggaggttggaccttgacgacttgaggagtaaggttttgacgtttgtagtgaaaaaaggatattcttttggcttttgttgtctgacggctgctggtttgttgntatgtntgngtggggncaagcgactgcatcaactnnnnnnnggggnggtgagattattttaaaatcagcacaaagtttttgtnttaaattaacaacagcgannttattataatattataaacaaacctacgccgcttgtggtgttagtga

SEQ ID NO: 54006 - DNA, 1264 bp, Oryza sativa
  unsure (1)..(1264): unsure at all n locations
ccggattgcatgcaaatcnnnnnnnnnnnnnnnnnnnnnnnnnnnnnnnnnagtgggtatgctaggatgaccttccatgccctgatcaactctagaatcaataactccacacttccgcatcatgtcttcgatgcatacactgtcatcttcaattctttgcataggagctagacaagcaaaagggtttttgagcaaatagtgaagatcaatttaacagaaatacatgttaaatataacaaaatttgtgtttaatgttaaaactatagtaaaacctataacaactgagagactagaattattgctcatagcagttgttacattcttgccatgaaaaccacaagggtataggcccctgcaataaattgctcccacagagttaaaagtctctagagaaagatcatatggacacataacgtcacttatcttcctttgagatggagttggaggcaaatgggtgtgctctacacccatttccccactcccgaaaacatgtttgttgtttgaaggatcttttgtaaaagaccaaggtattttgcatgcgtattcgtaggctacgtagattgatctcatgcactcatgtatataattattagaatggattataataataattttcatttggaacttataagatggtatagtatatttatttgaaagttgccaaacatgcggnagcacacatatatgtactatacaaacctattggggttcacactttcactaactaaattgtgcagttatgtaccagttcgtatttacacttgcatgagaacaaaagaattatgactacttgagatgcttccaaccgatgaattaacctttttttctaatcaatttggagaaattgggtcaatttgaagggcaaactgatgtcacccctggattcggtgcattaggttcttttcttttctgccattgaacttggaaaagaagattgcttttcgatttacacggttaaaccgtttatatcctacaaaaacaattggaattaccccagagtaccctggcaatattggccctctgcattggggcagggaccaccgaagggcggattattggtttcttagaacccaccattccctgttttataaataggcttttaggctttgggtgaacctggtaaaaacccctcttgttacccccattattctctcctctaaaaccatttgttaataggtttcccaactctacctcaaaattcgataggcccttttttgtttggggaatttcaaccttttattgaaagaaaacaacattttgggtt

SEQ ID NO: 54007 - DNA, 1676 bp, Oryza sativa
  unsure (1)..(1676): unsure at all n locations
gcgtatgaatctcatccgtggcctcacgtcgactctagaggatcccctagttggatgatcaagatagtgaagcattccatataaagtaagatataaacaagaaactgaaaccacacgtgaaactaccttcacgacaagctttgcagccagctctgcaggcaatcctcggcatgcctgagcagcagcttctgaggacagtgcatcccaaattccatctgatgcaattattagcctccctccagcatttgatagctacaatttcccagaatgaaaagcatacacagttaagttcattgcgataagctactccttgcatttgatcaaactcttaaaatttcaccttcacttgcttgacatgtggaattggcacaatgaactccccaacgtcagtatccccaatcgatcttgaaaggcacaatccacctggccagcatctgagaggtcccacctaaaacaacagcaagatttcacatcaaaacccataatgagaaatgctttgacagcattgaatgtatccttgaagttctttccaagaatatttactagcagcttacctcctgtccaccacacaggttgagccggctgacctcccttcactcgcggtgacgcgctcccgctctctacatttttctcgagacgatggtccacggttagcagcgagatcacaccgccctgcgtggccaatatgcacctggagtccccaacagacgccaccgtgaccgtgaacccatcgacgacgaccagcgtcgctgtcgtccctgatgccttccctgcaatcacactcacacaacatcccccaaaagtaacatcttcacagcggcgatggtccaggctttcaagtttcaacggcattgcgaggatcttctctcacccttgcgttggaagtcgatgtccgtttttacgaaagcccgcgaccagcgcgcgcggcagcgcctgcagccagtcgttgcggccgatgccctgcggacggcgctcatcacgtgctccagcaggtgctccttgctgaaaaccgccgccgacacgccattgtgtccgtcgaacacctgccttaccgcagttccaagaccaagatcaaaaccggacgcgccatcagcatctgggaatcccgagactagtccaaaaacgccacacggaggtagggcacgtccggcgaagtcgaagaaggcggaggaaggttcgcccagtacgcgaagccagtcgggcttgacgagaaagtagtcctctccgcgcttggcgaagctaaagtggccgtaccgttcgatcggccgctcggatcccccgccacggagctcgcgtccgatcagggtcgccaggggaagcgacggggcagccttcccctcctccccggcggcgctctccatcacagcctctcccgagccgccgcactcctagtcctcctacccaccaagcatcatcccaacctgccaagaactcacggaaacggcgccatttcttccccggaaaaaagctccggcttgctgccaagggcgggaggaacccgagatggatctgatttntcncngnnngtgccggttggaggtgagtgcaaatcatcggggngagngggaaagagacccttacacttatttaattaatacacccgtcccctacataagtattatntaagataatatctacccttcatatatatataatattagaagtgaggtggtggt

SEQ ID NO: 54008 - DNA, 3589 bp, Oryza sativa
  unsure (1)..(3589): unsure at all n locations
cgcggattgaaattcnnnnnnnnnnnnnnnnnnnnnnnnnnnnnnnnnnnnnnnnnnnnnnnaaaccaatgttggatgctcaacacttgtttgggcaatggctaaatgttattgacaaatctaccaggaatttggtggtaattgggtttgcagctgtcatatgggctatttggaagactcgaaatagagcttgttttgacaaaaaaactcccagatgaccctactgatttgatttttttggcatgtcactgggttgaaacctgggcaattctggagaaacagaaggcaaatcgaagaaacttgctgttgggtgccaagctcataaggcgggtgacaagtgaagtctaccaatcaagatttggatggaggatcaacaacaggaggcttgagaactgatctgcgaagactctgatggcgcgtctggatgtagtgttctgttctttcctctgtgtgttgatacatgcttaatccttttggaggacgcggtgcctctacttttgtaataacaatctggatggtcgttttttcttttttctggacctgtactctggtaatctcatttctggtaatggaaatggggggaaaccccttgctcaaaaaaaaaaagatgcaaaaacatcttggttgttctaggtattgttcaaataatcaagtgttcaaataatacacctcagaaaaaaatcctgatgaaacttgaaaccaaagtttcagtaatttgaagcgtgcaaactaatatcttcttggttgttctaggtatatccgttatatttgtgtcattatctaaaaaaaataaaatccgtatatgtgtgttgagtgcaaatcaatctgcactaattaatcatgtgcctgctctgtttggttgagggtctaatctgcaaaccaatctgaaccaaatcaatatgtaccacctctcgctcggtggacgtgttcgctgcaacagcaacatctcaacagcaattaaattaactagaaagatagtccgcacaaatgcacgggcttgtatcttagggtcggcttggaaggcttgtataccatcaaccagattattaatacaatatttcaaaattatgatatgtttgaaaaaccttcttaatcggtattgcttgggtaactttttctaagctattcgttgccgttagactatacaattcattcgtaagcaattatctatgagctggtttatcatccaaaagaaaagaaggtagacttagtttgatttggaaaataggtaagtgtaaattaaaagtaaagtgcttgtttattcaaacggaatgtttagaggctcactcttttttaacatcttttctaaaactgttattgctaataattatgttttagttgttccatgaagttaaccatccctcttactggttcatattgacataatttagatacttatctagaccctgcttcgttacaatgtgtgagacctatagattttttttcaaaaaaaacatagtcaacatcaagttcaataaaacttttaaaccaattatatatttctaccttagaaggttatatgtgcatgatgtagagaaactaataacaccaccatatgtgattgagtgaagggtattagaatctaagcactaaaaagtgtcgcaatgatacaatggttatggtaacaggtgttccagttttggtgaaaagaaagaaccaaatttttctaaaactttataataatttctctaattggtttgctttactccttattggcattttctatttctttttttattttatgcaagtattatttttaagttcaaatgtcgtgagatgataaataatgacagtgttacaccttaggtgtcaacttaaaaaaaaaatcaatcatcttttatgtaagcagccaagattgatatattttatcgttgtttattaatgaatagattgggcgtgggacgtaaggctacgctaaattcatggtctcttacagtgtgggaaacacccatttgggacccatttgggatcgattgaagcagcaaagcgagagcacaaatggctaaatataattaaagatgcatcattacttttgggatgtgatttttataacgcctccctaattcattcttcttgtttttattatttgatcatattttctgaggaaaatcacgaaccaattggattgtttggtctacctaaagaatcggatttttttttatgttatgctttgtgctattcatatttgagttaattctttattttccacatagtgagccccgcaccttggtgtaagaaaaacacaaaacctatgtgcacctgtcttgtaaccaatggtgaaactatatatgcatgtttgaagaatgatgtataataacataatatatgttgttaataagtatttaatttatttagatggcatacaaacttgcaaaatgcatcgtctataccacaataacatattgcttatatatagcaaaacattggatctaaaattgtcaattaattataaatagagcaacgttttagatagaatataaattagctgtgtacatttaaaattatggtcaacttaatactaaaattttagttttctctttttaatttgataacataaaataattaggaagagaaagagatggagatataaaagaattggaagaggaagagacagggagagcgtactgttcttatgtttttttctttttccggcccacggctgtacgaagtcacacgtatacgtatgttctttttttttctttttctggcccacagcagaggaagggattattttcttaaataatagatctaatccaatggtctaaaatatcggtctaccaatttaagtgaaaatcgacggtgagattatatagtgccatgtggcagtttaggagtgtttgtaggagtgacatgtggtggattgagagcgtttgtaggaagtttaatggacttaattatataactaggaaggtagctcgtgcgttgcgtaggcatctctatctttctgaatgttaaaattatgtatgatggttctttgtatgtattttggatatgaatactacttgctctactcttgaatagtatgataatacttcagaatcagtaacccgctatatctcattcttttaaaaaaatatttagcttgctttggataatattcaataactgtttgaaccattcactctatctccccctttccaacgattaaaattaaatatcaaaattaatgatataaatttgttatctgcttgagttcttgctaagtattattatttctaagatgggttaattgaatattctaacatgtagccttctagatataccaagttatgtatgcttcaagccaacgcgacttaaataaaattacatagatacttgatttaagagaagatttagtcataaaaaaatatttgtactggggttcccttgttgccttctcttaatggtggctcgatcaacaaaacacaaaaaatctcctatgggctctttttgtgatgcattggatggctggcaacctagtaaaactcaacgatagtcatccatacaacaaccctctaaaccatgcaacaggtcactacaacctcacctgacatggggatcctctagagtcgacctgcgggcntgcgacatgcngatnatcatttcaccg

SEQ ID NO: 54009 - DNA, 1882 bp, Oryza sativa
  unsure (1)..(1882): unsure at all n locations
gttataaagaacccccacttaaacaatagtttttataattaaaaaattgggtcaaaatttttggtggtagggccaaaagcggcctctttaaaatttaccgtaccattaagacccccaaacctttaaaagaagtggcccagagattctttaaaaggtatttggaggaaaaaccaatttttttttccctcccccccccttatttttctcccaagccagggggagtaaggtatcnccctttttaaaaaaccttgtcatgttgttcgggaaccaattgggcaagtttaaggaagtgggcaatgtttcctaaaaaacacacaaaaaagaccccggcggaaggttaagccttcacttgccccctggaggaaaaaccctccccaacggtgctcactcctcntcccctcaagagttgttaacccgccccccaaataagctcattgtttcaatcagatctgtccaccgcagtgaagcttgccaaccccatgttgccttttgccgcgtcaaccagcacgttacataacccgccatctttaccacctttcccctttggtgacaagctcgccacttccacaagaagtgatctcgtgcaccggttcatccccaaaagaaggaaggtagatggggtggagcatcaagcgccgctagatccagccccccctctcctccatcatggttagattcttgtcgccttccacttatttggaccagttggattcgccatgcccaactgccatcgccgttcgatttgtcgaaaaccgccacctgtaagaggagcacttccaaagctctggagcaacgcttgacactggtgagagggacactgagctctaccacagaaagagcccctcctcgtcgagagtaagaaaaagagagtgtgctcttgttgatcaaccgaggaagacaagaatgttaaggatcggatgaggatatttcataaaatatatgtaaaatatatatttgagttaatgaatacaatgacattgtttcaattaagcaaattgtagtggtatttttcaaagcaggcaaatccatttaaccattttctaatggtgtcatttattttttttgcgggatatgtaccagtacataagtacgtatgtacttaatctacgtatagttacgtgctttcttgtcactcctcttgtcgtctgcgagctaaacctcaagcttttgcttagaaaaataactgaaagcttaaattattgtacactggtggacaaaccttttttagtcccagttcacaaccccctatagtcccggttatgcaaccgagactacgaatccgggactaaaaatacccatttttagtcccggttgaaataaccgggactaaaaatggatctttagtcccggttgaagttactaaccgggactaaggatctagtcccggttagagttaccaaccgggactaatgttctttttttctttttctttaactgctgcttgcatgatttcgagctccacaaatcattcatattatccacaaatcattcgaacaccacagatcattcacaaaatccacaaatacatcaagctgcattttctttcttccaatccttccaaattatttcacaaattccaaattcttcccacaagggttccgagcctgcatattgcctataaggaggcggattacaataactgccggcgtttacacggcgggactgtgaaaacctgcgttacccacttaatcgctgtgagcaatctctctttgcagatgggtaatacgaaaagcccgaccgatgccctttcaacagtggcaacttgatgggataggaccgcctttacgggcttaaaccgggggtgtggggttaccccatggaccgttaattgtagcgctttagcccgtctttgtttttcttcttttttccagtggggtttccg

SEQ ID NO: 54010 - DNA, 3696 bp, Oryza sativa
  unsure (1)..(3696): unsure at all n locations
gtggattgaatttcgnnnntcttttgaanaacnnnnnnnnnnnnnnnnnnnnnnnnnnnnnnnnnnnnnnnnnttggtccataaaagcatcctggaaagttaatcatggggccagtactttgtctctagctttacacctttaataactatcactgcaaacttagctttgattaatcacttaataactaatacaacaccctctttatgtgtggttccattgtacgagcagctcctacatgacaatgccgtgaaaaagagaggacagcctgatcaagtgagtcctcatcccttagaacgatacatgtactctcatcgatttaaatttcatgtaaattacaagtatacataatttagcaaaataattgtaaaatactaaatggtgcctacgataattttgtgtgacaataattaactcgattaattaattaattaatcaggatgaaagctgtgaggaagcgaagacgatggatctgaggagcaggggcctgtgcctggttccggtgagctgcacggtggacgtcggcgtcgacgccggcccggcggactactgggcggcgccgccggctttcggcatagggttcggccgctagatcgatgcatggtccggtgatctttgtgggcgccatggccaatgaaatggctggctcggctggctaattaagctagctgaagaatcaatggaaatatagagatcatatcttacatattacatcacatgcatgcatgcttgcatttgggttaattagctgcataacatcaggagcagccatcctgctgaaaaggctggttcctcttgatgctatgcacgtgtatgctcatggtttgatgggtgcaacaacagagtatataactggtagtgtgtgtgtgtgtgtgtgtggctcttgtctagctagagattgatctctttgggtggattaatggattattatgcactggaagaatgaaaaagggttaagttgtagacagctgccatagcgcacctatgcttgctatagcttggtgttgatcatcaaacatcagtaacacccttgtaatttaagtcttttatcttggagaatgcatgcatgtcaccttgcttgttcaccaaaataatggtcatgaatgtgtaatgcatgcatgtgtatctacgttttaatttattgcttgctgtaataaagtctaaatggtttcattttgcgagactggcccgttcctttttaaggaaaaaaatttgataaaattccaatttattaaactctgctctcatctttttttagaaatacactactggaaatttgttgtgtagttgccgaaaaatcgccactccggtatgtgcttttcctgtactatacagtgatgctcctcaattcatagatacatatacccttttctcctccctccccatttgaggaactaggtcccgatttttcgataggtattgataacttttaatttagcggaaacttgacagacacgatcctgccctgcaatcacaacaccatgtctcctttggttatcaaccgtgctgaaacattgaccttaccgaaaagactaatccttgcacgcgaattgaagaacataagtaagaacaaggtagattgtaactcaatctgaagatgaatagttaagatctcaaagttggcattacacaaatcaaactagcaacgaaactgcaatgatagaaataatctaagcaaaatcttattctaaactatgatggctactgaataaatattcttagggtcgccctaaggtgcacaactctttgggcttagctcatgacataattataaggcacaagacccaaatcagactcgaattggatgatgtacatggcttgttttgtagattttcgacagcaaagaaggaattttgtcgtgagacaaaaaccatgtgaaagtagattccataaaatttctaacaagtactcatgtaccttgagaatccttctggatcagctgctatgtccgtttgaagttgatgctgccgggagacccgaatccgaatctaagatatgcatgaacttcatctcttgacttctatggagcaaaagtgatctgataatattggagtagacttgtggaaggtcttggtttggttcccaatcaacctctatgatcgttcatttcttccttgcgctcggtctctttccctttacccaagcaagtacctttgcaaacgagaacacacaaaactcatagtgcaatatgtaacgcgtaaatctcacatagaaagcaggcacctttgcttgatgaatacataaggtagctatggtcatatccgagctagtgttgtccttatcatcctccctttcttgattagaaaccgtcatcggtttcatcttgtcattgagcctgttagggcatggccgacacggggacgtggaccgcacccccagccctccacattagaccatccgccaaaaagcgtcgaggagcacgcgcccgtagggaggcgtggaccttctgcacgtgcgcgcacctctgcgcggggagttgatgcgaggcaaagctttgggtctgggcaccgcgttgtgtaggtcgattcctcgcgttgttggagcggtcccccctctctcaatccacaggggtacaagcttgtcgctcttgcccctctcgccattcgctcggccggtttgcccctctctttctgcctgggttcacctcgccgtgcgacgcaccgtcggtcatcgtcggccatcattcgcaggcattcccgtaggtcgcggcgagcctcgtcgagccccatcagagaaaacccccaaaaaggttagttctttttatcctgaaccctaggtctgtacaccctagtcgccacccccatttttgtttgttgatttggttttcctttgcggttctaagaacaatctgtttgcaggtcgacatggatccgaatcctcccactggcttccccaacatgttcaatgacccagatctggtcaccaatcttggcaaatcttcgagccaacctgcctttgtccatccccagttcatgttcccctatgctcattcacagtttcgtgcattctgcactcaaccccctcccctctagtagtgaattcacgggcagcagcacaaggggctcaagatcttgccagcaccatagggtttcagcaaattcccacccccaagtgccaaatccctagctgccaattccagatcccccaccccaagctggtgatgacgggagggtcaaactctactacacacatgatgaggacctaaggctggtgagaatttttgtttcatcctatttattttggtttatgtattgatgatgctactgctgtgatgggtgaataattggttggttaagtcaattatttgtgaatgttgtacatgtggtggatgagtatcattggtttatttgttatttgttagtgagttagtttgattacttcaatgatgatgatttttggagtttgtagatgatagatatgatgatggtactgagatggattagtttgatatgatgatgttagtgagttgggatatttttatagaattgttaactgtgagtattgattggttttaaatttagttacttatttagggtgccggactttctgtnaaagggtttatgcntgtaggtgccagtgatatgcaaatcaaanccccttggnggggggnngttnnnnnaggaggaatacgcgncccgggtaagcgcggccgcgtttaggcannntttatatcacaaaccacacttatatacggccca

SEQ ID NO: 54011 - DNA, 4698 bp, Oryza sativa
  unsure (1)..(4698): unsure at all n locations
attttatcatgaaccctaggtctgtacaccctagtcgccacccccatttttgtttgtctgctagttaagaaaaaaaacttttctatactagtatttctttttatgaattaagtgtccctttgaactgtaaaaattctacaagatttttgtaccgatcagttcagttccagccggaatctaaaaacttgccaagttacaaagatattttgcttgataaatcatgtcacattgtcatcttagctaaggattaaaaagtatatgtacctggggctatgtagccacatgtccctgcaaagatagtgctccagctagatgaattgtccttcaacttctttgccatgccgaagtcggataaataagccttaaaatcatggtctagcaagatgttgctacttttaatatcgcggtgcacgatcggatcatcacaatcatggtgcaagtaagagagagcttgagctatgtccatcacaatagtgactcttttacaccaatcaagttcctttgccaattcttggtcattccaaatggacgctaaacttcctctttcgatgagatcgtatacaagaaatttgcactgtgaatgagagcagtaaccgtgcaacttgacaatgcgacggtgcctgatttttgtcaacacttcaatctcagcaagaaatgctccaatgtcaaagtaatcttccattctgtgaagcagcttgatggcaaatacaccttttccttggatctcagctctaagacagatccataacttccaacaccgatgcagtatttttcatcaaaattttctgttgcgtaaagtgcatcttgaaacgcaacctttgcatcaaagttccatatggaaacgaagtctccagggatgatttctttgcccttttttgcaagttttcttctccaacaaaccactgtgatgcttccacccacgagccagatgcaagaaaacattgcaaaggcaagaagtagcctcggaacaagatgtttactgtcggaattttcatttgtatgtaaacctgcaggatttggatttgaaggttgacatggtgtcaagccatataatggatcaccacagatacctgtattatggtctagtgaaactacaaaaaacgcttcagttgtgtagaaaccaaaaatctgccgcccaaactggtgtatgataaattcagctcaagtaaacggtaaagcatcatgaaagtcattggtatggcaccacttaaattatttctgctcaaatccaactcagttaggtcggtacaatacccaagctcttctggtattggtcctgtcagtaagttgtttcgcaggcgcaacaaggacaaatggtgaaactgtcctatctgaggtggaatgcttcccgtaaactgattgctgcttagatctagaacaaaaagattacgtagaaatcctagttctggtggcagtatagcatttagcacattggactcaagtttcagtgttattaaagatataagtttcgaaaaggttgaagggatggggccaatgattcggttgttggaaagatccatgttttgtaagctcgttagatttcctatactttcaggaatggaacccgtgatttcatttgtggagagatacaattttattaaactccttaaatttcctatactttcaggaatgaaacccgtgatttcatttatggagagatacaattctattaaactcaaatttcctatactttcaggaataaaacccgtgatttcatttgtggagagatccaaggactttaaacttgttagattccctatggttgtaggtatggagccattgatattattatgatccagatctagcgcaactaaactatgaagcatccctatctcacgtggaatatgaccaaaaagattgtaaatccaagaactagaaaatacaatctagccaggtttcccaaactggaaggtattgggccagttaagctgttgtggcttaaatcaaggtactgcaagttatgtaatgtgtcaggcaagcaactgagtatcccttgtgacaaaaaattgttagaaagctcaaggaatcctaggttcgtaagaaacctatcgatggcgggatggatccagtgagcttattgtagagagatccaagtacgagagctcagcaagacgaccaatatcagacggaattggtccatagagagagttaatgctaaggtcgagaaagacaagatgaggcaattgtgcaaatcggagcttgctcaaaccaccggagatgttacatgagaaaagtgtaatgtttgtcacaactaggatggcatcacgctcatggccacggcgcaccttgtagctgcagtatatgcctgaccagttgcatgggctggttgcgttgctccattcctctagcccgcagtaggagagatcgccccttagaccagatttccattggagaagtgcttcagcttggcgatccaacgcaggatttgcaattgcaaggcaggaaagacactgcagcgaaatcagcagaaccagcaatagctcctgtgaggcaactagtcgtctcatcttgtgttttgagtggcagtgtaggtgaagctctaaaacacacatagtacatattgatgggtcgacagaaagcgagagccactttaaccaaggagaccttgactctgactgacttcaggtaaatggatcaataatgcacgctcttgacaggactagtggagtcagtcaatgccccaaggaatgaggtccacctccatcactccatgtgcaagacaatgaaatccctggctcatacaagaacacatcgttggcacgtttagaaaggaaatccgcatgtagcagttccataagttcatgtttagttgggaggttatttctctgtatggatatctttaacaatattccaagacattggttagagggcaatcgcatgcttttcgcccaccctaataagctttaattttttcttttggctgctcctcttaaagtttttatagcatctcagcaatagaccttattttgaagcccctaaaagttaaatgtgggctgcccccatttcccaaggacaaaaaaaaaaaaacctccaactccaccagtagcccctatttcttagcctctattcatgtttctcttgtattttaaaatacaatctatgtttacactatgtttaacaccacaataattcaaacttaaatatttctgacacgtataatttaaccatacttaaattcacaatttcaaagtacacaattcaaattcaaaatcaaaattttcaaacatgtaaatatggtgtggtggcaataccatatactcatttttcaaacatgtaaaatttttggagcaagagatgcaataaaattaaaatagactagtagcaaatgccaaaggcccatatactgtacactgctgctgcttcttttatgcatcaggtcaggaaaaagaccttgttttccaagtttttagaatattgagttattgatccaacctgtcactaattgatgcaattatcgatgagtaatgcacattagcaatagaaggttgatttctgcagattaatgattaaattacaagattcataaccatggaaataaaatgcaaaggggaaaaggggcagaaggaagtggagcagcgatgtgcaaagtatagatctagacgagcggcagcgtgggatgttgatcgccggagttgatgagtgcgaggttgacgacggcttacgcaaaaaaaaaggagaatggcagcgacggcgccatccaaggcgcgagagagacgagagaagtgcgcgcttgggattttccaccgcgccaacaaaaaagaggagagataggggctgggcctagagtccccaggattaagggctaggaggcgaaatttgggagctttccctattttggggccttttataggagccctggtggacctttatttttctttcccttcacctcaaaaactctttgggggctttaatttaggtgctctgcttgaagatgctcttcactctttgtggctttcatttgatttgtaatctgcaaacctttttctgttttggccatgtggtcaaacttttccatctctcaataccgtcgcagttttttttttaaaaaaaaactttaacaatataaaccagaagctcattgttttgatggagtttcttgatttttcttttatttccccaacaaaaaaagtacctgtcctatattgagctttgcataataaaaatgcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacccccgaacgaatggctcttttcaaaagatttgccaccccttaatgtgcaaatggaaccccccttttacggcggctttaaagccggcgggttggggggtaatcgcaaggtggcaccttaatattgcaaagggccttaagcccgggctctttggttttttcctttcttttttgggacctttggcggggttttcccngaaaagctataaaaggggggtctcttatggggttcacataagggtttatgggcctctcgccccaaaaaaattttatggggggagttcccatgggggcctccccctaaagagagtttttcctttggtggggacaccttttaaatggagtttttgccaaagggaaatctatcctctttttt

SEQ ID NO: 54012 - DNA, 751 bp, Oryza sativa
  unsure (1)..(751): unsure at all n locations
cggtgaaattctcattcgcnnnnnnnnnnnnnnnnnnnnnnnnnnnnnnnnaaatatgaatcgtagaaaggtttatagaagaaataatgcaaggcattagtacctctatgttttcaacgtcctccattggttgtctgaagttagtttggctagacaccaactcacaactaccctgtcgcctatttgaaaagccaggtgaaggcatcttcatgttaaatgcctcagggtcacggttaatgttttgctctgatcctgaatctttcattgctaatgatgatttgagtcgagcaatctggatagagatagaatatatgcataccttaaacaacaaatgcagtgagaaaatatgatacaaagcatagtagcagaaacaaacctgctccttaagttctttaacttctccagactctttgttcaaccgagcagcgccaagttcaacagtggatacacgctcggcaaacttcaatgtgcttatgctttctcctaaagcatcactttctgggcttatatgaacaaacatcaaggttttgccctgacctcctgtagacgcattgttaaaattcgaggaaatataaattatactcagcagtcagtgacagcacatttaagaaattgcaagaaggttaaatcttaccaagagaatcttgcagaagttgtgttaatttactattcctgtaaggtacatgcgcactcttttgggcaagtgaagcaatcacatcccctaaagccgacatggattgttatatgttgg

SEQ ID NO: 54013 - DNA, 743 bp, Oryza sativa
  unsure (1)..(743): unsure at all n locations
agctgaattgttatcngcttgccngcaggccgactttagaggatccccttcataagaggcctgcgagaagagatcagagataggatgtggcagcaaactcctgcttccgtggatgctgctgcccaatcggctctggtgcaagaggcgttgtataacttggaaatgcagagagctcagagggacccgtataaagaatgagatgccggcctctgtcgatttgctccggtgaactgtgggagtagtgctactgtgttgtttttatcatgtcgatggtctttggttcgattatgctgattagtttgaggaaggtccttgggaattttgggattcagttatttctagcatgtcgatggtctttggttcgattgtggtgctcagtctgaagaaggtccttaggatttttgggattcagttatgcgttgcttctgaagatcttggttagttggttagatgcgaattttcatttatctctttgaatggcaattctggggttgaagtattgctttttgcttaatgcccaactttaattaggtgaactttatgtttagctctcctggttctataggttttatatcgcaattatcttaggcaggtcggaacattatatattctatatttattttcatgcatggttctttgagctgtgcacattccttgggtgtagatgccggtattttaaaaaaaaaaagttcctttgagcggggcaggcctacttcccggaaacggtaaagatcatctgtttt

SEQ ID NO: 54014 - DNA, 1840 bp, Oryza sativa
  unsure (1)..(1840): unsure at all n locations
cgcannnnnnnnnnnnnnnnnnnnnnnnnnnnnnnnnnnnnnnnnnnnnnnnnnnnnnnnnnnnnnnnnnnnnnnnnnnnnnnnnattgaatacgccctcctccttgacaaccacctcggcaagcgcttgaccgccgaccgccggcgcgcggatgctcactcgtcgcctgcgcccgctcgtgtgccgctcctcccccgccgcctccgcttcgccggttgccgcgctctcgcctgcctgccgccaccgccactccactttgcttcaccgaccgccgcgctcgcacgccgcctccgtcggccgccgtggcggcgccgccctccgcctctcccgcttcgccccggccgccgcgttcgcacgctgcctccgtcctccggcttgtagagacagtgagagagagatgaggaagggagagaaaaggggaagggaggagaggaggctgacatgtggggcccacgtgggtcccacactgactcagctgccacgtgggataaaaccgggatcaaggtgaccggttttgtatagttaagggacctcgtatatctggttttgcggttcgaggacgttttttaatcacgctgacaagttgagggaccttcggtgtactttttccaatccacatttgcaacaatcacggtcacatgatgcgcgtgtgttacgagcatggcccatgtatgtgacaaagcccaagttcatcagtctcccactctctttgcacccagcccagtccgagcaatttcttttacgttgggccgagcccaccatctcctgctagctcagcccacttagctccgcccccaacccccctccacctcgtagacgtgctcagttccggccgttcaccgccgcctccatctccctcctagaagcgcctccgccgccgccgccgccgcaaagaagaggtgtgtgtcggcgagcccctcacctgactccaaccgccgccttcgatggggcgcgtgaggcctctccaccacgcggcgagaaggctgctgctgctgttcccgcggcagagggccttctcctccgccgccgctgccgcgccctcgcgcgagccgctccacgtttgcgtcgtcggcagcgggcccgccgggttctacacggccgacaaggtacgggctgctacctctcttcctatagggtcctttctccaatttccccactgtaatgtagttgtcagatgacctgaaatccacttctagtttgcttctgaagatacttgcttgtgaaattattttagtctgagagcgtgtagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaaggttaatagggggcttccttagggtccgaataggcttacggaccctgacccaaaaaactggtaaggggattggtacgatntgccaatgccctgaagacgttttcgcccctgaagtgggatcacagttttataagggccttgttcaaagtggaaaacaccaactctatggggtttatttgataataaggatttccatttggccttggaaaaaaaggcggtaaacaaattagcgccattaaacaaattaacctccca

SEQ ID NO: 54015 - DNA, 744 bp, Oryza sativa
  unsure (1)..(744): unsure at all n locations
ccgtgaaatgaaatctgaatgtcgatgcccgcagttcgactctagaggatcccccaccctcatcgtcgattgctttaggcacactctcttgtggagcctgtgattttgacgcgcgccttttttttgcctttctgggcgcagggagggaagagcgccagggtggtgaactgcgtactggcattgaagtcgtacggtgactggaaacaatgtggtggcaccgggccatggaaatacggggggaatttgaagccgtcggcttccggcaagtcgttcgtgaggaagaactccgagccattccggaggtgccaatcgatgaacgagggcgaggtgccttacgaggaggctggattcagcggtgattatcatcttgattccggtgacatggttagctccgtgcttcaattttgaagctgctttgtatttgtcttgttttgctagacgatatgcggctaaacggttaatgcttcgtgcagtcgacgtcacgccctttgaaaatgttggttagtgcagttttgtccgacaagaggcccgacgaagttccacaggtaggccaatcaggttccccattttttagtaagctgtttactggttcaatgggatacatgcaagcagctttccctttcatgtgatgctttaccggttccttggagtttttatgctattgtttgcctgcagctcttggagtccatgctgagtaaactcgtcgaggaattcgagattcgattgactagccaacatgaatng

SEQ ID NO: 54016 - DNA, 4993 bp, Oryza sativa
  unsure (1)..(4993): unsure at all n locations
taatggtaatgctgtcgtatcgctttatntttaaancctttaatgtttaccnttttatattatttnnncgtttnncgtttgntctattgctttnnccccnnccccnnnnnncctggtgaaatgaanatcncatcntcgcagcccgcaggncgactctagaggatcccccaaaataaaaataaatttacaaataaaaaaatattatttttttaaagtatcctatcttactgtaaatttacaattcattaaattctaaagtgcagcatgtaaagataccatatcattatccaataacaattattacatcttaaacatcatacaaagtatgctataattctataatttattaaattttagagctctagaaatacaaaaatattaaatcatcatccacataattcacataatatgtcaacatatctctccatcattttttattcctcacttaattaatgttatttttctcttctctcataagtcgtatcaaattaattggttttagcctttagatgaataatctttaatccaaattatctccttcatttttttctctcattaagccatatcacctcaactgtttttagctcttaaatgattaattcatagtccaaattatcttcctatagttcatcctcgcttagttaatgttatttctctcttttcttattaagctgtatcacattgattgtttttatctcttagatgattaatctatgatccaaattatttgcctcttttcttctctcattaagccatatcatctcaattgtttttagcccttagataattaatctatggtgtaaattatatccctatagttaatcatcacttagttaatattctttctctctttgcgcattaagccatatcatatcaattgtgtttagcccttagaattaatctacggttcaaattatcttcctcattttcttctctcattaagctatatcatatcaactgttttttagaccttagatgattaattagtggtcaaaattaattatctctctcattttcttctctcgttaagccatatcatctcaactattttagcccttagtgattaatctagggttcaaattatttccctccttttcttatcccataaagccacatcaccttacttttacatttgaatcatcattattccatatactatttaaattatcataaatcatatcaacttatataagctgattccacctagttatccattatttactaaaggctcacagcaacgcgtgggtttcacctagtattaggagaaagagaaaagggaaaaaaccaaaaaaatggacaggatggacacccaagggcttataactgaagaatttaaccaccacactattgcggttctgatcaaagaatatgcctgtgctactatttaatccggggagacctcaacgccaagtcatttcacactaagctatgatgacttggcaaagtcacaacacctcggacgagagctcagcaccaatattgatggcactaagacattatagcttgatcagcgttatctaggttagcactaagccaacggttcatttttcaataagatttttttcacgggtcattcttcgaataagttttctaaaattatcatttttgtcaaaattttgggtacaacgtggccggtagcccccactgctacggaaaccatttctagataaacagctaaaatgcgtttggaaaggtggtgcagatgatggcctctaataaaaagcatgtgaaaaatgatgcaaaggacaacgtgccgccacagacggcaggcaaccttatagcggccgttgttggaagtcgatttttagagatgatcagctaagatcaccagctaggaaaatagggataggcggtcgactttaactgaccgtttctagcctctagaaatatgtttccacatacagccggtgacacaggccccagagctagcatatactgcacgggtaaattcccttatgagccgtgcacctgtgcattgtaggggaacatcatcaaaagtcgtctttattagtgcccaaactccatgccgttggagcaagatagctgctcttaacaaatcaaaagtactctagctaaagcagggagaagaggacagcacccaaaaaagatactttggtgccggttggaaactggtcataggtgtcggatttttcaactgacccagcagacgacactaacgacttcgattatcgtcgctgtagacatacatgtgtcggtttttatcaccgaaacctatatgttattcgatattataggtgctagttctaaactaaagtgtcatgtgactgtttatataggtgccggttctttaaaactataaatagcatatatgtgtcggttgttgaccagtctagacacgtggcaaagactataggtgtcggtttttaataaaaccagaactttatagttggcaagaaaaaaaaaggcagaacctaccaatttcacatacaaatcatacaatcacaaaaattccaataaattcacatccattcatcaacatacacacaatatagcactccgggatttagatggcgagctcttcggctctaggaggcgaccccccatggtgatctctcgtagccggcgatggtcacacctgcgcctttgagaggatgggatttctccctgggggattccatccgtgatgaggcgtggcggtgttttggttctccggtgcatttctcttctcacttcagttcttctccgtttcgtttggtggtggatgttccaagatctacttttcggttgacaccgtcttcggtggcgctttacctgagggccactattcatggttctccatcgggttttcaagttcaatctctaactgattggagtttctcgtttgtggtgatgggatggaggagagtggtagaagctcggggagaagggagtgggaggcggggcccgttcagccgccgcacattcctccccacctcatgtcaactccatcctccccgagcagacaccagcgaggacaaccccacgctttcccccgccgaggacatgctcgagcgcaccaagctcgcccaggttccactcacttcttcaggcttcggctaagtagagcagtaatggtgaggatgtgtgatgtgatgtgcccttgtgcttgctggtggtctgtattgtgatgtcaataagtgatgatgaagttgattcatttcatttatactaaaatttgcttttttttgttttgatagaactgatgaagatgacaatgatgaaatataaacaccggcgacgaaagtaatatgtgtagctgcagtgagtagcaactgtggggttgatgagaaaggtatttactttcatctataacattcatctgttttgtgggaaaatcttgccacaattaattatgatgaacgttgccttcacttatttttctccctggtagagttagaagtttcaatctgaatggtatctgtggaagattgtgggttatttttctaagttattatttgtgttgtaatgcttcaatgcggtgaataaaatacaggcatctccacattttattaactgaaaaactgctcaagttacagtgttgagttagatattgacagtctaacagatctagttatagtttatccattgagcaactagtcttagtttccattgctatgttttgcttcaattgtacaaccttttcatgtctttgcctatttgtttcttataactttatcataattgcaagtatattcaagtatcaactctaggctctgtaccatcaatcaactaaataagttgtcgctagttcttgtctcagtgctttgagtattgctttaattgacatgaaccatgaactgcttgtatgctaattaatcttaacctatgtttactgaaatatacacttgttctttttattgtgttgtatggtttgtattgcattagagataaatgtatgggacatgatgtagggcttgctgatgatttgtatatattgtgatggaaaaaggggtaaaggaattacaggtagtaaaaaaaagatataaccagtgtatacttactgggtaaaaaaaaatataaccatcctatatgcgcttttcacgtgaactcaagggaagtccacacagtaaactggtgaagctcctatgtcaccgttaccgtgagctggcacttggtaacgccgttatcgtgcattttttacctgttcccgtgtgaccctggggcacacaggagccttccggtctctagtagtgccttagtaatggttgatgggataagtagcattctagaaatcattatatttgtggataaattttactgttaaggatgctaatgtctgtgggcatccaccactccatatttggttggcacggtcagcactagatgtgatgccatggacttgtgacttaagttgtgtgctttgttcagttaactctatcgaggacctgctttatctcttctttcaatgttcttttgcacagagctattggaatgctcttgtttttctgggatacttctctgagcatggatagtatgatgattcatgcaaaatctcactatcagggatagtgttttatggaaaagtttgtgtatggtgcatggaatatttggaagcagaggaatggcttcattttttaacaaaaaattttttgctttgctttcctaaaagcaaacttttaaaaaggaaaccctcccccttttgttggtttagaaataagtggaaagaaataagggatgtaactcttaaaattggatataatttgggttgaaaacttttctaataataccctttaaataaataaaaatttctttaacaagcggggaacctttctcttgggggtttttttttttcaaaaaaacccccacattattgtttgccccgattgtcaatttaatccacaaacaacacaccaatttaaaaatcctgttgtttacattaaacacacaatatttagtgtgtgccaattctttcacaatttttaacccccttccacaaaggaccgtaattgttacaataccacatccttattcttcgccccgatatgcgctaaaa

SEQ ID NO: 54017 - DNA, 984 bp, Oryza sativa
  unsure (1)..(984): unsure at all n locations
nttatgatgggaccctccgtagcagtagctggcggaggcgcttggtggtgatgccctcgacgatggcgatgtcggatgcggggagggacgctgtgcggctcgacacgctcccctacggccacgccaatgcaaccttgctgctgctatacggctctcacctttacctcatccgcatccaggtggcacacgtcatggcaaggtggggagcgccgagctgaagtcagtgcgtgggctacttggtgtaatgccattcttcatacaggcaacactgcagcaggcgatgagaaggccaactacgggggtggccgggcagcttttgaccaccatccaccagccccgctatctcgctcctaccgccccgaaccatcagctctgctatcgtttggtgggaatcgattcctggccagctagttgatcgagaacaccgttccatacacaggtagagaaaccctttttactctcggttggggaaccctttagtcccaggtttccaaccgggagtagcaatccggaactaaagatgggcatctttattcccggttgaaataactgggactaaagatttagtcccaattgttgttaccgaccgggactaaagaggatagccaggtttttttttccttttttattttctcctgaatctgggtgtattttcttctaaatatgggtggtttgcatatcccaaatcgaagtaagatcccaaatccacatcacaaattttaaagttctaaaaaattacatcacaaattttaaagttctaaaaaattacatcacaaaatcctaaaaaaaattacacacaaatcaaattncntcncnggtttctncnnnttcnttcncntatccttcncngttcnctcgcngggtggnagtagagtcttaataacacgggggggggggagaggnaggggagagacggacgccacaacatattatgtataaaacagataggggagaaaaattattgaatctagttacacggatcgg

SEQ ID NO: 54018 - DNA, 755 bp, Oryza sativa
  unsure (1)..(755): unsure at all n locations
cgcgtgaagggtgagcnccctgtcacangcccgcacgtcgactctagaggatcccctggaatttatagtaggaaaaaaagaataacgaattaaaaaaggaaaacaattttagtttcctctttttctaattaccaattgaggtggcgaagatttcactcggaatttcaccaaagccgaccgattttcataagtttatcggtaaactctagggattttgactcaaatatttgtttacgaaatttggccgaaatctaccggcttttcatgggatttcacgaaaaacgctattccggcatagcccgaaacggaaggccatttcggaaccgtaaacatgcgtagtacattatatttgagagaaacctggtccaatggatgttacatggttgaaaaataaaactactactgtttggcgctacttaccaacccaaactaaacaaaaggaaaaggcataataactgggcttctagaggagtaatttggcttacataccctgatgttcactttaatctttaaaaaaaacatcgttatggccatcgncatcacacaccagtgattagctcctcaaccgacaactccacctccggcagctacatcgncgaaactagtaccacgccactgacaggtgggtcagtgtcgacgcaatggcccacccgtcagcgacgcggaggaacaagcccgtttcgtttgagcgaagtggtgccacngccgttgatggggacgcgtgtttaaacgttggagaaaagtcaccgcgtaat

SEQ ID NO: 54019 - DNA, 2479 bp, Oryza sativa
  unsure (1)..(2479): unsure at all n locations
agcttttaatcagatggataactttcttgaagaaaggtggacatttatttcttttttcctagttaagcttgaatatatatccttcgattagactgaaattgaaaatttaccctcataactcacatgcatgtaacaagaccccgccatattatgtcattggtacaagaggttaaatccactcctaatttttatctgagagctataaatgtgtgtacgacgacgtaattaacattccttttgaatatataatgacatgaatccaattaaccttatagagtagtattctattgggtatatatctggtccagattgtataatatgccaagcgcgcgcgtatagtgggaaggtataaagttgctggctgtctgtctgtctccgttgggtatgcatactcctacttaaaacatcattaacaaattatctataattttcgtctaaaaatttgtttttgtttcctaaactgaaaatagaaagtgaaaaactccttccttcaacagatagcctaaattcaatccccaaaacttaaaagtgggcccttctattaaactatcaatagaaaatttcgttttttttttctttcacgcgcgcagaaagatcgctatctcccacgcgcgggaacgaaggagagaggcgggaatgcgtgattgggagcgcctttcgcactactacattcaagatttttccaaacgggcattttgatttttccgtgcggttgtccggcccgcctggagccaatcgtctgggaaaatcggcattttcgcgtgcggacggtccaaccgcacgggataatcgatttatcccgtgcggttgtgttataccgaccgcacggaaccaaaaaaaataaaaaaaagtgaatcggtcgctcgctgccgccgcgtcgtcgacgtcgtcatctggcccgccgacgcgcccagctcgccgcatggcctggtcgcggccacgcccagcgcctggctcgcccagccggcgccttgcccgctcgctgtcacggccggctcgccacctggcctgttcatcgtcgtcggcccactcccggccgccgccttgcagtcatcgtcgtcatcgcgcacacgccacttccggccgccgcctcgtcgtcgttatcggccgggcgcacgctgctcccggccgccgcctcgccgtcgtcgtcatcgtcggccgtgcgcacgctgctcccggccgccgcctccccacgtccgcccgccgccgttgagcccactgctgctgcgcctgccagccgccgtcgaccctgccgccgagagccgcctggaggagaggaggtgtcggcgccatgcacaggaggaagagacgaggcgttggcccggccccctcgcctagccgccgctggccggggaggaggcctgtgggaagtcggagagaagaggagaagagataaggtagagagagaggtggaggtgggagtggttgagggagaacacataccgtcttggctggccgccgcccaagttctcctttcatctgcctatgcctcctgctccctctccactttggcttctctcatcctccccctcgcacacgcctcggcccctcctcccccccgcactcccccttcttcattcttctctcatccttcactccgccctccttccctcttctccctccgcgaccctcactcatcccccaccccccctcctacgctcgacctcagccctccaccccctcacccctcctctccacacccatactacctaccttctatcctttcactgcgcttcccacctccttactgcgattatggactctacgctccgtcaactacctttacggctcatatctgctcaatccttcccctaacctcttccctttccctcctgtcttatgtatactactcagtcccacgttcactagcgttggtacgctctagtaccggagttcccttccaactggtacttagcccgccctctccttcctgattagtcttacgcactcttatctgtgacgctcttcctgttccctctgtctcttctgccactgtgtccctaacgctgaatcgcgtcgcctgttctacctcgtcccagctttcttcattactcacttngtttaccgtacctcgacttcctcaccggttagcgtctactcgactcgttctcctctacattgtctctgtgtttccttactcgtacttagctcaagccgactagtgtcacctcgatacctcttcgacgtcctctcctanctcctctcactacttgcctccggccatctaaagcactctcgctctagcctagacgctaccagtcctacaagtcatacgctgccctctctcttgccttaacaccggtaaccgtgtantgctacactggccncaagcgtatgcgcggatactctcgtacctcgtatctggccgttctgctctttattggtcttcgggacaaccggtgcaagcgcgatacgctctcatacgacatctcggcggtatatctctcttatgtcgcatgtttctcttacatagctctcc

SEQ ID NO: 54020 - DNA, 2093 bp, Oryza sativa
  unsure (1)..(2093): unsure at all n locations
ctcctcacgtagatgaaaaaatttaacttctttcttcggtccgtcaaaataatatatattggctatgggttagacacattccccccccccccccagggccttgatgactacgctcgnacccacaatgggcccgggggtatgctaagcgagggagagttcccttcatttcctcacacgtggctctacagcctggtcctacccccgcacctcgtgagtcgcggccacggctagggggcctcggggtgccacgtcatgcccctcggggtgccatgtcaggcccctcgggccctcgagttgccacgacccaaggccctccccagctgccacgtggcgggcagagcgtgagggagggggggaaccctaggctgagcagccatcaatgcgcggtgccccaaccgtccctcaccgcgtttaatgcagtaagggcggacgtgcggtaccgcgccactggcccgtgtcaaatcgggtgtgaccggcctgtcgtcggtcatgtccggttgacgcgcggtcacgcccccacgtcgcctgtctccggtggagtgaaggtaggtacgtcccattacatcggagcgtcatccggagtcctctccacatgaggaggacggccactagtcttcgcccatttaagggcgaatgacatagttgtcccccgtgtcagatgaggtgcggcgctgggtcccattgaagggccaatcgcggcgtagcttccgggcgaaggcatagaccacggtctggtcaaggtagaatgggcccattctcataaaaaagtaggtagaggcgatgcatgtgatatccccttggactataaaaggaggaccgtgcctgccgtaaaaggagaggacactgagtagacttaaactctagaaagaaaaggcaggcgagctctcaggagtttaggagcctttgtaatacggatccataattccatacacatgagtagggtgttatgctcgccaccggcaagaacttgtataaccccggtgcccgagagtgctttagcaggattcagggcggctacacaatctctccaagcgagcctcttcccccggccgaactcacaaaaagggggtctcacgatctcccgctaaagagggtaacccctcgacacacgggaaaaaaggaaaaaggaggagagagataggaaaattttaaagtggttgggaggaggagataggaatatcccgtgtggttgggttagaacgcctgcacgggaaaatcgatttttccgtgcgggcgacaccccagcgtcggttctttatttttccgtgcggtttcactaacggaccgcatggaaacaaaaaggaggacgtccaggataatcaatgttgtagtagtgtcgcgcccgcatataaacggagcgaggaagcaggagaagggaactccaaaactcgggtaggagagtagggatctgttagagctgatttttggactaaaatccctcaaaatcaattttgggaatcatataggtagactgttggtaatgcttggcgccaattctcagaaaaaaggaaaaataaaaaaataaaacgtacgtggtggcgccgatcgaccaatgaccttactatctgtgttgtacacttgtacgtcgatctccggtcttcaccgctcatcatcgatcgaccgatagcgccatgatgggcgtgcgcacgcggtgtcgggcgcgcctacctcgctcgctcgttgaccatccatgtccatcaacggagacgcatatgatttgttgtcccgtaccggccgagctaaaagctagaaggagaagagcccaacaaaatgcaagattattcagatttccgatcctggctaatcgacgctggacaaaactataaaagggccccgacgcgtgcgtgcgtgcgtgcgtgctgcaataaagcgctgaaaacgaggcggggagatggatggatgggggatcctctagagtcgncctgcnggcntgcgagnatgacgatntggcatttcaaagccgcgggggggggggggtgagnnagnanaagatcatgagantcaatgtacgttagcgtgaacgagtaacaatcanggaagcgagggaagcgagaatgtaagaggtatatacatagcgagagcgaagatggcgg

SEQ ID NO: 54021 - DNA, 1627 bp, Oryza sativa
  unsure (1)..(1627): unsure at all n locations
ggtgtatgataacctcctcgnnnnnnnnnnnnnnnnnnnnnnnnnnnnnnnnntaaaatcccaatataattatgtctctctttatttattctctatccatttatcttctgctttcacaaaatttgatgcaataattacttaaaacaaatttagtttagaacaaaggacttaattaagctgcatggcgtggcgggcccttgcgggccagcaactaacatatccatctccatccaacactgccgcgcgggggggccctcgcgagcgtcatgatgggcccggcccgctccggcctgtccagtggcccacgcacggctcgacgggcgactctgaattactctgatgattcatcagatttcagagcgagcgagagagagagagatgcagtgcaggcttttttggtatggagccagtagcagctctctctctttgatttctttctgtgccgctttcatttcttaaccgcatgccttttgacgttttcccaccgactatctagcgacccgcccgcagccacactcctctagtcggtctctacctgcatattttcagtgctggccctgccacgcagcaccacatgctactcctgtgtgtgtgtccaggtcggtctggtcaacgcagctactcattgctacgagtactgaccttcgattcatcgtacataccctgaatattatacatattttgtggaatgatagtatgtgaaaatcgatttgtcttatataactagagccctccaacttactatatacaattaagcggatctctttatacatgttgaaagaaaatgtgggttgctaaaactattttctaatgggttaattggatccatatatactgtcgtaaccgttttaaaagatgttattacagttcacctaattgaaatagtaccactataacactcttaaaatcgaatgtgtgccatgatgtacgtctttttatctaatgtattttcgtatggatcaaaataccatatcttctttattcatccttcctctccctccttcatctcttcttccctcgatgcaacaggtggagctaaggtcatcacgccttcttcactaacaccactgctcatgctggttccacggcgacccaactcgtgcacagtttcatggcgagatcggacgataggctcctataagaaaggcagcaagagaggagcgacggcggtagggttgaggcttgcacctgtaccgctgtagggacgaagccatccccaacgctgctcactcctcctcctcctcctagttgttgatgccgccgccgcgatgagctcattgtttctatcagatctgtccaccgcagtgcagcttgccaccaccacgttgccctctgccgcgtcaaacagcacgctacatgacccgccatctttgacacctttccaccttcgtgacaagctcgccacttccaccaggagtgatctcgtgcaccggttcatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntac

SEQ ID NO: 54022 - DNA, 1602 bp, Oryza sativa
  unsure (1)..(1602): unsure at all n locations
agtggtganttagnagactcactcgngcaagccngcaggtcgactctagaggatcccctgagggacacaactaattttagaatcgacgataaattgaaggacctcaagtgaactaacttcgtggataaatccacatggaaaaagttcacccaaggtccctcaacttgttattgggataaaaaacgtcctcaaaccgtaaaaccagataccgcgagttccttaactatacaaaaccggtcacaataggttccttggtggtttgatcccgggttactcctaccgttgctgagtcagcgtggaacccacgtgggtcccacatatcaggaggtcaacgtatatctctttcctctcttctcttttccttcctcccctttttgctctctctctctcaggttgggccgacggtgagcggggctgagtggcgagaccatgacggtgctcgtgcacaccactcccacctcaccgatgccgcatgaggcccgatgccccgagcgcgttgtcccccaacaccaggctcgccgtctcattgcccgcgacgacctcgccgaggccacgcgcctcgtcgaccgctcacgcggggaggcacccggcgccgccgtcgctgccttgaagacaaacgccaacgtgccccctgtgctgcgccgacgtgccggttccggcgaggccgacgagctcgacgatggcgaaggggaagcagcagcaaaccgcggacagcgccttcctcctcatacagccttgccgccggcctctccgcctttttttttcttagtgccctccgccgctggcctattccggcgccggttgcagccggtcccatacactgtcaccgccaaccggtgggagagtgcatcccctcacccgtcaacgtccgactgactagtgcccggaaccttatttctctttgtacctgtagccgttgacgaacgaccatgggcttatcggatacggatgatctgtggcggccggatttttccctattccgaaggcccgtgctctgcccggccgtcccgcaacgggttttttatttcacgcgcgcaacgtccgtctcgttgtatcggggacctatatgggccgtgataaagctgtttctctcaccccacacgcgggtatggcgcgtttgttatatttctatctcatattgactatctgtatgtctgatgcatgatcttcgtccgtcgcgttctcgttctttcagatcttcgctttattcatacttctgcgattaactcacatacgtgtctcttcttcctcctctgattcatcttcttaatcttttaatctctctcttactcttatactactgttctttactatatattagtctctacactctctacacgttctcccggtatatgtctcttatctcttcgtatacgacctgaacacgatgtcatccaatactactgctcgtcatgatctcatactactcatcgatgacgtgtccatgtctcctcgatctctatgttatcctccttccttctcacctttacttgctgatgcgttaatcattactcatcatatctatacatattctcgtacctgtcttcactatgcttcgactacactcgtggcaacatctgattactacttcctcttcctccg

SEQ ID NO: 54023 - DNA, 761 bp, Oryza sativa
  unsure (1)..(761): unsure at all n locations
ccggtgattttgaattgganatcnnnnnnnnnnnnnnnnnnnnnnnnnnnnnnnnnnnnnnnnncaaaaaaaatcgttcgtggcagctttgcaaccctagagcgacaggttatggcgttgtctaagccagctgtagtgcagattgcagaagcctactgtctttgaattctccatcctttttttctcttcttctatgattctatccgtagcacaattcaatgcccccgtagatacaagtatacaacacggaaagacaatctagcacgtcgcagcagagagagagaggaatcaatcaatgaacaaaaagctcaccctgtggacacgtgtcgggctctggaggcccccaagcgtccgcgtcaccaatctcgaggcggccaccgcggagcccatgcttacagcctggcaccggtagtgacgccagccaccagcgcagcgcgcgccgctcgctcgctctgcggcgcaatctgtgaccccacctggcagtgacacggcgcctccgcgaaacgcaacggctaaaacgtggaaggccgcggcggcgtcgcgcgcgcgcgcacgttgggacgtcggggagggaagcggccaaagccatagacgtcgtcgtgggcagcaagctgtgaaaaaaaaaatggccttcaaaattcgaagcggcgacgttatcgctctctcgtcgtgagcggngcgtcgtcggctccggtggatagtcaacggtcgacgcgaggatagttcaagagcggataatgttaaagaaatcgttgagattn

SEQ ID NO: 54024 - DNA, 3739 bp, Oryza sativa
  unsure (1)..(3739): unsure at all n locations
ngtctgtcttcactacatctgtgtctacgcgcccccttcgttgtgtttacgtgcgtttgttgttaaagcatcgtgtagcgtcataagcatctgtttttatctagtcacgccccttcttgtatttgtttgtgaggtgtccgaccctactcaccaaagagaggtgttcgccacttttttttagcccaccccgccatttgttccaatatgaggcatgacagatctcccattgtatttagtgagaatcatctctcttttaagggtggtacatctttttattttttcgtggggcgcccttttgtaaaaggttctcgtcgcatatgtcccctatcttgcccatatggtttttttgtttcttatcaccaaacttgtttcgtatagacgtatgtataaatccctctccaccggtttatacgtatcgttcaataaatggcctgatcgggtccccacaccctgtacgaggaatctcttgtatcaaaatcttgttctgcgatttatctttattaagcccgttcttattgtccgatcagagcccctatccgttccttttaaacccaatgtttgaggtttagcccatgttaatatttgcttataattgtactattgtctggttgctttatactccctccgtcccaaattataaggcctatatttttttacatgatcttcaatgatatactttgaccaataatttattccatgttatgttcccaatgaatatgaaattagcatcacatgaaaataatacaaaatatgaatctagtgatataacatgcataatacttagcatagatatggttaatatgattattagtcaaaagctattgagtttgatttcctaaaaaagagagcgtcctataatttgggacggagggagtactttgattgctttatactagggcaagtaagtgtccatcttaccatcaattattagtactttgattgctgtatactatgcactataggttctggtatacatggtaccgatcaggtcgattaatcgaggttgatcgacgattaatcatcctggtcggtcccttggcgatcaggatcgatcagcgatcagataacattgcttctcacatcatggttttatccaccttctctatatgcatttttgtaacactaaatgcatttcttagaagattaagttcaccttaaactttccaacagattgtggtaaatcaattttctcgtgtagctgcaaatgaccgctgtcaattctatgggaatgtaacactaggaagggatgtatctctatcagagcttcggaagacatatgatgttgtaagttttagactatagccaagtggctacctttttgtggcaaactgatatatatcttttaccatcatttctgactgtgttacactgatgtatttactgctggacaggttgttcttgcttatggtgcagaaagtgataggtcacttggtattcctggggaggtatacctaacttggattcccttggtctctatgtcaaatattgtttatgggcaactgtagtattttgttatttgtgaacaattgttcggaatttgtttatgtatctttatgagatggttgtgtctaggtatcgcttaataaagagagtgcatataacgtttacaaccatactaacacaaagtgaaagagacaagataagttgtgtaatcaccaaataattgcatgcagggaataaaacactgaagaaacaaaattcatgtatttatgctgaaacaggatgtcacaagccattgaaataacaacttttttatttcggatattggcaagattgtgtagtgctatcaatttatcttatgattttcgttttgttttttcatcatgcgtgtgagttgtttattctcagtgtcatctttgttataggatctgaggggaatacattcggctcgagagtttgtgtggtggtataatggacatccagacatgtgcaacttggcacctgacttgcaaagcacagattctgctgttgttctaggccaggtgtgttgattttatgattgccaacaatctaacatgctgccaagataattgtttcatatattctatttctattcaaagtacagtctgtctatggtttcatttgaattgaagaactcttctggttcattaaaattggcagatttatttgtagatatatcctgtagaagtattcccagaattttaatggagaaaatcttcctttcatatatgatttctggctccttccatttgaggtttatgttgtctgcactctgcagtgcttacacttcagcattatatagctgtgttagacacataagttcaagtgttcattatcctgaagaaaatttgttttgtttctgctaacttactgcaaaagaaaatatccttttatgggaaatgtgtcatgtgcccagttaaatattcttttttttggcccatcctttaataccagttttcttctgtgcttctgatgatatgcagggaaatgttgctcttgatgttgcccgtattcttcttcgttgtacatctgagttggctgctacagatattgctgattatgctttggatgctctccgtggcagcacaataaagtgtgtccaatcttttgaatttgaaacaacatgttccattttttcaatcccttccatcagttcagttttaatggatgataatatttgtattgcattttttttgtatgtaaaggaaggtatacttggttgggagaaggggcccagtacaggcagcatgcacagctaaagaactacgtgaaattttaggtagtttgttttactgtttcattagctgtagcttaatgttgtctgtattagttttctgtcattttaaataatgaatgtttgatgcatatatgcaggtttgaaaaacgtccatgtcttcatcaaggaggctgatcttgtgaccttgcctgcagatgaggtttgtacaatgacatgaggtgtttcatgttgctactggacctgtaactgttcttttcgatatttattctggactagagacctcatttcctaatatttaaattcataacgaaataaaacttactcatccatgttggtagctactacagtaccttgctgtcaacatgatgccaatttggttttcggaatgttccatccaccttctctcttaggttatcttgcttgtgattgtgatagagcaaagcaatctgattgcaggaggagattaggaatagtagaattaaaagaagggtgtacgagctactatctaaagctgcaattgcgcataaaggaaagaataataatggccaaaaggagcttcactttgtgttttttaggagacctaccagatttctcccatcagaagatggtgtgacagttggtgccgtgcaacttgaaaagacttgtttaaaaggtcagatgtcagaaacgaaataccatatctttgcagactttttttaaacattattctgttggttatatagatgatggtgtggctggaaagcaggtcgtagttggaactggtgagtttgaagatctaaaatgtgggtaagtgctttggttcatactttcctgagtttttttgaccaggcagctctatggggtttcctagattcatttaatgtattttgtgtcttctgggnctgttcttnnnnngtttgngttgggttggaccnacagnctaataaacatggggggggggggngggnggaatataaataaccaaaaaacagcaaacangtaggaaagatgaaggatagnaaaaaaatacatagcaaaaaacaagttagtaatgagtgaaga

SEQ ID NO: 54025 - DNA, 9528 bp, Oryza sativa
  unsure (1)..(9528): unsure at all n locations
cgggagatgataagagataatcgttgagagaagttacagacataagtcatcgatagagtatatagatagagtgataaaagaatgagactatagtatatagtaatttaatatatataaagtgagagatagatagtgtactatcatgcgagaatatacaaatgtaatacgattntgttatacnccgcgcgcgcagactaacaaagaagaattgtgtgtggcgcggcggcgtatatattttatatagaaagaaaaatatttctcttcgtgcgggagagaaaataatcatattattgtggacgagagagaatataataatttttgtgtcgccgcgttcctaattagaagaggggtgtatgttttgttttaggccccaacacaaatatgtgctctcttccgcgggtgtaggaggcagggaaaaatttatgaggcgcgggtttgtttaatatatccggtttgtacccagggattatcctttaaattaaagcaaaaaatataaaattttgtgaaaaataacacttaacaaaaactgttgttgttaaaacaaaggaattaaaagtttttttttaaaaaaaaactttttttcgaagtgtatagcaaataacccggtgaataaaatacagtatatctgatatatactccgttttgtcttaacatttatcatcaggacaaacaactcaaaagcaaaaaggcaaactatatattccatttgtttgttcaaaacagcgactagaggtagtatatatattgtgaatatcattcgatcgatcaaagtgtacgttagtttcttcgggttgttgtcattcaattacatcccgatcgatgaatcgatctcgctcatcggttcatgacctgggacgaacatatgcatgcacgggggacaggccagctgaggaggactagtttgaatctcaaagagaagaaccagactttggccttcattttccctatttctgtcttgcaagcaacgctcttagttgcaaggagtaccactgtcgatctgccagtgtgcgcaaatacaggcagtagcagcttgctattaatataataatctggtctggtttggtctggtcaacttactaatgattaactccaattgattgtgcccgtactccaattcagcttactatgacagtaaggccttgtttacttccaaaagaaaaacttttcacccatcacatggaatgtttagatacatgtatggagtattaaatgtgaaaaaaaaaattaattacacagtttgcgtttaaattgcaagacgaatcttttaagcctaattgtgccatgatttgacaatgtggtgctacagtaaacatttgctaatgacagattaattagacttaataaattcgtctcgcagtttcctggcggaatctataatttggtttgttattagattaccgttaatacttcaaataggtgtccgtatatccgatttgactaccaaacctaattttttttctcaactaaacaaggcctaagtactgacatatatagtagtaaatatgtaggcccgttttgagttggagtacaaaacataccctaccataatttaggtaatttgaatagcaaatgtgctagtttagattgaaaccaaatactaattagtagtgcccatgcttaatattcatgaagacactactataaaaaaggcgggccaaatccatctttttaggtggaccggcgttccgcctataagcaaacgactgtgaaaatagataattttcgcaggcacctacgaaaatcaatttttgcaggcggacggcatcttcgcaggcggcagattcacctgcctgcaaagcaaatttcagcgaataaaaaaaagacgccccaccgcctccgccggcctctccctccggccgacgattgctctcctcctccgtccgctgccgtccccacaggggttgccgccgtcgtcgcatcatcgtcgtcgtcgtcgtcgtcgtcatctcaacgtcgttggcgccgccgtcgtcgtcgtcgaggaggaggaagccggcgatggaggcggagccgacggcgaggaggggaaccggcggcggaaccagggaggaggggagccggtggatccgccgcttcacggtgccgcgaaggtcgtcgtcgtcgcggccgaggggagccgacggctcgcggaggcggcgtcgtggtcatcatcgtaatcgaggagggctaccagcggcggaggcggggaggagttgagccggtagatccgccgcttcacggcgccgcgaaggttgttgtcgtcacggccgaggggagccgacggctcgtagagacggcgtcgcggtcgtcgtcgttcatcgaggagggagctggcggcaaaggcggggaggagggcagccgatgacggaggcggaaagaaggggagccggtggatccgccgcttcacggtgccgcgaaggttatcgtctcgcggccgaggggagccgacggcgaacgaaggcggcgtcccggtcgtcgtcgtcgaggagggcagccgccggcgtaggcggggagaagggcacccgccgccgaaggtggggaggaggtgagccaatgggggatattttttttgctaagtgtgtgagggagaaggagagagagagagaaggggagggaaattagtggtggagaggagaagataaggatggtggaggagaggataacgatgactgatttttttttggaggcatgatttttataggcggaccacataaggttccgcctgcaaaaatcatatttttccaggcggaccacttaagaggtccgcctgcgaaaataaaggtatttttgcagaggtccgcctggaaaaaatgattttcgcaggtggatggtgagctccaccccgatttacatttttctaggcggccatttagctctgagggtcatacccgcctggaaaaataaaaggccaacgttgctaaaaaccatttttcctagtagtgagatgaagctagatatgaatttttttaggtaaatctgtatatgaatcttgatagaactgaatacactttcttaatgttcttcccagttaaatgcagaaaatatatggatacatacacacgtttgttgacgttttgataatagagataaactgaccggtgtgaaaaccagtatcattctatagattaccataggactttggggaacataatattgtcagatgtacatgtccccttctccttttccacaacggcttcatgcatgcatatggtccctagctatctacctgcagtgcaatgttctgcgtgttgctgcatatttggatgcgtacgtggaccaatatatgcagacagtgtgcacacatatattgtacgttcagcacttcagctagctatatagacaccaattcgattgatcactgtgatctgatgagccaatttgccactgtgcatgcagctcaaggcgcagaagatcccattaatctctgatgacttaagcttgacgattgcatgacgtggttacagccattcccgctaataataagcaccaaggtttggagctaaaatttgactttgttagagtgttcgtcatcataagcgccgacgaccagtgattagtagattcttgggaacaaaatgataaggcttgcagctagctatgcattactagctgttaagctacaacaacgcaagtagtagggtacaatctctagcttaattcgataataaattaggcattcactattcataagctagctatccatgtactcctacaccttttacaaattatgtctagtttagttttgtccataacggaagccatgtagcatgtcaactgcagaagggccagcatatgatctaggggttgcagtgacctgagtagcatcccaaggttcttaattcaaatctttataggaacgaattttagactaggttatttgagggagtaagttctcaatttaaaaggctgcatatatccgtatggtaacatggaaaatattatctccatcttaaaatgtagctatttctaatacaatatcttgtcccaaaataaaattatttctctacctacctccttctctcaactaatcacaatcattctccttcacctactttctttttaaccaatcacacactttctctaatcattcttacatattttcttaatacccgtaccaacctagcttgaaaatgtttatattttgggacgacgtaagtatattgaaagtttctaagttcacattttgcagtatttttcctaaaaaaacttatggaataactaacattttttctctaattttgagatagctatcccaaaattaagcaggggccttagaacctgggcatgcttaactaagtactatataattaattagttaacagccggattattatatacagtctacatactgtaatattcaaattagataattatttgtttggtgaatagcccacatgaatcacatggactacagctaatttctccttgaacaattatttttgtactttaggtgggtactatatctttgtgcggtcactctccggccctaacgcaacatcacataggacagaaaataatttggtgatctccgaaaaccccatcagagacaaaactataaatgcatcctcctgtatgtctgacagactaacaggacaaaataactgcattgcgatgtgttcatgaacacaatataatcatagaaaacgaaagttaggaagtatatattgagaggtttgacaaattaactcacaaacatgaggagctagtagctataagcctataaatatgtatgcattgtccgtagctgttttttttccttaataacctttacatagacttttaataatctcctacatttatctgatgtgagacacacacctatacatatgccatctttaatttgattgatgactcatgcacactagtagcactttacacatatgattctttccatgctagggcaaggacagtactggtagtactatactactatgctacacctatccagaagagtttgtaatatgaaggacaaggcaggctagacaaagatttggtactgtctcgatctcattcatcatcatcatcaacaacaaagatatgtgttaattccatccctaaaatccgcaagaaattggctcggtgtttgaggcctttagtttatgcatccctaagctgcagaaaagagaggaatgctaggaagaaagcacaaagccatataaagaacagttgtgcatgaaagacgagaaaagatgataagttcaggccgtctgaactctgtagagctagctagttagctaggaatggacatgtcagccaggttaaacttagccttaaagaaacttcggagtaatttaatcacaaggggaacttcagagtactacaatttagacatgggttaaacgggtgccgatcgaactgccgatttcagagtaatacatatagaatatagtagtagtacgtatatcgagtgtgattctagctaggatttaggtcaattttgttcccatgcatggacatatatactgcccagattaattttaaaaaccatacaaaaatgctggaattcttaaagcttcattattagatgtgttgtaaagcttgagtaatatatttatttttatgagcagaaaaatctgaggcatatattaaggtgtgttaggtatagtccacatcaatagctaattttttagagcacaacttaaaaggtaagaatgtccctccctagctagtctttttttttttgaatcgttggtccgtggactaaacatgaggctttttagatacactaacataatttcacaagaagatatatcataagaacaagatgaggaccgaactttgtgtgtcaaaagaaattgatatcaaattttatgtttttctctactatcttaaaaacacattcgttctcctctttccatcctaatcccacatataaaaaacccgctccaaaaaatggtgtaaaaaaactgaccaaccaaggcctgtgtctagttttaagaaatcacaaactttatgttagatgcagtactcatacagtaaggccctgtttagatcctccaaaatggtaaaagttttgctattttgtagcactttttgccattttggatctaaacactagtagcaaaagctggcaatttggcatttggcatttgctagtccatagtagcaaattgtgtcaaaaagtgttttgggaccactccctctcactttagtgctagaatggcaaaattttaacatgcatctaaataccaactagtacttttgcaatgccaaaacttttgccatttgccatttaccattccaaatggatctaaacaggccctaacttatgagcaagaattcctctatcaatcagaccttgttggcccatccatgtatatatattgcttattagtgcagcctttgttatagtactctctccaatcaaaaaccaaaagcttaaaccctccatatcttcctttagttaaggctattctttaaagcctggatgcaattccacacctttcactgacccatttcttcacaaaagcaaaagtaggcccaaaaaaacaaaagggatgccagggagagcagcagaaaaaaaaagggcagccaaggaaaagataactagtaaaggtggagatggagagggagggaggcaaaataaaacacatgacttctttcaagcttcttccactcctccactaataagttcttatgcccatgagagattcccttccctccaaaggctcatatgctttctccctcccccccctctctctctctctctctaaaggttgacctcaaggtgtaaaaggagatcactagctagctgagagagagagcctgtggagagagtgagcaaaagctatagagagagagtgagtgagagaaagagagatcaagtgagtgctaccttgttgcttggttgctagtatagctagcttgcttgggtggaagatcatatcagcatatcaagggagagggaatatggataggggagtcctccacaaatcatcagctctagtgggggagatgggggaaggccatggatggtggagtgtgaataatttgaggcccccctttgttgagcagcttcacaatccggcttctcttttcttgccatcctccaccaccacctccactactccctcttcttcctcctctcccctccattccttctcctccctgctgctctcgaatcactatcctcttccttctactgcgacgacaagcaccgccgccgcgccttggcacgacaccggcagccgccacggccaacatctccaggactcatggaaccatatcttactgtaattcacacacacacattctctctttttttatttatatgtttgtaattgattaacttgatattattcttggaaatggtctgtttctagaattcttctgaacagctacatgaaataatattgtgctaaaaacctcatctctccctctttacatggtcatatatattgtgatcatccagtggtggattggctagtggtgaagaggggtacaacaagaactgggaaggccaggtgctgttcccaactacaccagctgcagctgctgcagaagctgatcatgggagcaacagctacaacaacatttacagaccaccacgactagccatgggagcagcacgagtgatgatgcttcccaattggcagtggctgcaaggccgtcgtcttctccatggggtggcatccatggccatcacccccaccacaacgccttgcagcagcaagcttcctcccctaggtcttcttgcatcacctctaccacctcccttggaagcaacggcgtgctggagttctcaaacaacactttaccacgtgaggtagggacaatcatcattcaagataatcagtctggtaatttttgtttgtgtgtagattattttaggtgcttatcatttactgaggagtgagggtgggtgaaaaagtctttctttgaggaagctcatcatcaccttttggatggttagaaagagagattcaatactaatagctttgtgtgggtagataaccatgcatgaaagtttcactcctcctggaagcagttaagatagggagccatgttgataattaattagttatgtatgaaagttttgtaactttgctctccatccttttgtgtttctcctagtgcatcagcacagcatctggagcagctttcaagaaggccaggacccaagaaccctctccggctcaagctacagttaaggaactctctctctctctctctctctctctctctctctctctctctctctctctagatctctcaatgagcatggcccaatcaatcagagcaatctaagctagcactgaagcaatagtttgcttgctgaaacggacaggcatggaatcattgtaggttaagagataaggtgagatggggttggagatggaaatgatggcgttcttaattagtatgttttgcttgtgctttttcttcaggtgaggaaggagaagctaggtgatagaataactgcccttcaccagcttgtctccccatttgggaaggtacatatatatcactacatgcatgttattagtctttagcttttagatttcaacaatgggaagagaataattgtcactaggctagtagaatataacaactgagttcgttgatctggtaaagtttcttaattatacaaatgctaagtgttcaacgaacagatggttatttctgtaaggaatatatacaagaaaaaccagttggaaagacaatggataagacaatattataaggtgctatgaccacatatatacaatgtcaagtagttcctcatttagcctcttctgagatgagctgtaattttccggagaatgattagaccttgtacctaatggatatgaaaacggaaagagtacgtatgtgcccatgagtatggcacaccggcttaattattactatagtccaatacatcaatgtatatataaatttagattaatgtaaattattcttatttctaagtagtaagatctgttcctacatatataattaagtctcatttattttgttcataaaattacaaatatatatttcagtgaaacaaaaggaaaagacaaaatagaagttaatgaaatttgaggggaaactctacttgagattatctgatgcggtgatgatcatatatactccctaataaggtatctttagctactctaccggaggaagaaagtatatatattcatatatatagggggatgaatgaaactctcctagaaaaaggagaatcttgtggtgaaagaagtacttttggatccttggttttaaaccctgatgggggtgaaccgtcctgttttttaaaaaaggatccattttcacagaaaatcccaaaaaagacccggcaggggtacacccttttttatccaacgaactggggttggtctcttgaagcctggggccacaaattctcacgggcaatgggggccaccttttttccctcaattnttcaaaaaattttttcttcaaggagggggcctaccgcgaaggaaggcttataaagaggctcccttttcacagagggggattccctcccccttacgggtgagaatcgcacatatttttttggttccacctcttggggggagagcacactccttgggaggg

SEQ ID NO: 54026 - DNA, 3533 bp, Oryza sativa
  unsure (1)..(3533): unsure at all n locations
agtttgttgttctctagagagaagaaagtgagttataataatccccctcaacggtttcccccttgtggaggtaatatacccccagagcgtaattattttcatctttgtattacacaaggaagagaaaatgtcgccgcacataaaaaatacaacatggcgtcgtgacgagaagattttttaaaaacaacgactagttgtctacgacagaaggtgtttttctctagagtaaacacatgaacaccatgtggaaacgccatggtatccccatattataaggtctagtgacacataaataacaaggcaaatgtgtcccctcataacctctttttaaaataaagagatatattcacgagaagaaattaaacccttatccacttgtggtttttaaacaggaaaaatgtctgtttgtgtcccattaataatggccccccgttctattttttttatatggcacatccgccaaggatatataaatttaaattaatgtgaattattcctatctataagaagaaaatttggtccccaaacaaaaaatagagttcaatttatgtggtcaaaaaattcacaatatatatttacgttaacccaaaggaaaagcccaaaatagaggttaattaaatttgaggaaaacctctcttgaaaatattttaatgcgttatgatcataaaaactcccaatttagttatccgtaagctactttaccaagaaaggaggttatataattcaatataattagaggaatgaatgaaactctctatagaataggagtatcttgtggtgatagtagaacttttgtatctttgtttttaacccctgatgggtgatgaccagtcatgtagtagtaaaagaagatccaatattccagagaaaaatacaaaaaagagatcctgacatgggctaacctctcttttatgccagactgacactgcgtctgtactccttgaagccattgggtacatcagattcctacacggtcaaattgaggtccagctctttctctccctctcatttctctccatcatctctctctctcctccatgcatgcgtgcccatacctgcagagcagctagctctatcaaataatgctactccctctctttcacaatgtaagtcattctaccatttcccacatttatactgatgttaatgaatctagacatatatatttatttagattcattaacattattatgaatgtagaaaatgctagaataacttacattgtgaaacggaggaagcagaatccatgaatcataaagtgtttgtttcttggttattgtcattcgtacatgcggcaggtcgttgttcacttttgacacaacatatatacatactttctggagacagctccattaattgcaagtatacatactttgacataataacatcttaattgaaacatttcatagctagggttacaagcatgcagagattagcttagcttagcttagctccatgaaatgatgcatagtagattgatagagtaaataatattatacagtgatttgatgtgccaaagaaggagctagacaggttgaaacaaaaagaggcagggctctactatgcaccaatgcatgctctctcttgcatattacagatactaaagctgcatatgtagtatatgtgcctgcgttgccatagctagacctatataatcccggtcgatccgtgcatgtgtgtttatgtttatactggcttgtcgatctgatcgatgcagcagcatatgcatgcatgcagatggtcagagagagagagagagagagagagagagagagagagagagagagagagccaggatgcaatctttttagcctgcctgctgctcatctcatgtaaacagtgcttgctctcgcttgctttgccttttcgcaaaagcagccacacgttgtcctcccctgtgctgccacaagccatcacacaccttttcttttcttttttttcttttttttgcccctcttaattagcttcagtacgatactccctccgtcttaaaaaaaaatcaacctagtactaaaatctttatgtctagattcgttgtattagtagaatgcgtcacatcgtaatacgaggtcaagttttttttagaacggaggaggggagtaccacctaatactactaccatataactacacacttacattaaacctaattaacgaaatttctcactctagttaatatatataatctccgacgacccatctcatggtcatggatctccaggctctgagctcgccgtaccttggcaatggcggcagcagcagcaatggtggaggtggtggtggaggtggctccaacagcaagctccagcatcagccagaagccagcagggtgagtatatagctatacaatatctactgtagcttatatccactgtgcatgcatgcctgcactgcaaacgcccccccacgcgcgagagatcgatgtgcacaattcccgacgttggctgcagcagcaggggttttttttttctctcatcatcaccgtgcgtgccatatccatctgcacgccttccatccgcggttcgcatcgcatcacatcgcatcgcatctgtatccttttgcgtttggaatggctttgaattggcagctagctgggtcaacaagggtgaaagggagcgtaagtattggcagaaaatatccaggcttaatttgcattgggtcgtcgttgcatctgctgctgctgctgcaaatctgcaatagcagcagcctggtcttttttaccgtgggcaaggcatgcagatgcagatgcaggcagcttcattattgggtggcggctgatagataggagtaagtagatcatcggaatgaatggtcgttggtcgttgttgttactttgttggcgtggtccaaacgtaaccacggtccatatatataggaaaaccgttttcgtccttacttagttgttgtagcattattttctggctcatatatatatcgatatatatggttgttggtacgttggggggtcgtcgatcgaactcagatcgatcacgcttcaaattaagcccaaacacattattttaccatatggtgcaatctatcgtttgtttcttgttgtttttaaatcatatcatttcaatggtttttaaataattatcgtgtgaaaaatagacacattcaaattaagccggcacacatacaatgcatggggagtagggaatgcataatgatgggggggggggggggtaaaacacataaaatgtcattggagactactatagtagaatattgagttgcatgcacccttacgcgaggcctcctcaagccctttagcatgaaatagagcgctaaccaagatttgatctcgagatctttggatctgattgcatattaagttgtgccccaatcaattcaaactaaaagccccaactgattagaaaaagcagacaattcactttatattcgaaaaaaaaacacactctctatatatattggttattaacactagccactttgtagaggattaacaaaaacattggggatcctctagagtcgncctgcggcnatgcaagagtgagttcctaccgtgcacgc

SEQ ID NO: 54027 - DNA, 1903 bp, Oryza sativa
  unsure (1)..(1903): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatttacccaatagaactttattcataatatctaaatccaggaacacccaaaccctaacttgatctatagaagagcaaacaagaggccattaaaccaggtggtattttttaataccttggtcttcttgccacaaaagtcttctcctgaaatagtccatcctatccctaacaccctgtggcagtctatagaaatagatcatgtacaaaggaacattggtcagacttgaattgatcagcactaatctccctccaatagactgaagtcttccttgccaacaccccagtttatgctccattttattttcagctttcttccagtctttatttaagattctctttttgtcaatagggatacctaagtaagtcatgggtaactccccaatcttgcaagtgaaaatctagctatatagaagctgattctccttagcctctccaaaacaaaacacctcacttttgtcaaagtttattttaagtccagaaatttttgcatctgacaggatgtttatgttcaggttgcaaaggttgcagtgtagtgcaaggtggtttgtcaggtcacaatgcccacctcagactacaaaactttttcaaggtttgtttgacacgctagtattttttttcctgatgcaagaagcgagtggtcagtgtgcaatgcctacatagcaggacatggtcttttttcaaagaaataccggatgccgttcgtgctgtcatggatcagaaacacggaaagaatggacgttgggcagctcagaaagaacgggtggaaaacaccctggcttttctggcctgacctatccatgttactgctgggaaagaatggatgagaggtatataggtataagagcatccccagcagcttctctatctggtcctccatccctaatttgacgcataggagcgaaaaaaccacctccagcaaatgcgccatccagtcatccaaaactagcgcatgcgccaaaaccggagagagaaagggtaaatatagcgtgtctctctcctcacgccatatcacaatggccgcgctcccgcccctatccggagttccgcgacctcccctccatcatcgtcgtcgctggcccctttttgattttttttttacacacgtcacctggcacttcatttgatcagctgccttgattcccaccaacactatgccattcactcgttcatccatccttgttagattggttgtgtgatgtttttcattattgcaatttgcaaactgatctttcccaaatttcccgttttagtacgaagattcgccaaggcttttgtgtattccctaataaaagaaaaggatgaaagaaaatctcagttgtaatattctaatgctcttttgttnnnntngtggtcgacatgcattcaaccggnnnggggggggntttaatnagaattctcaaattacgtaaattgcaagtaaccaanntnaagagtatatgtgtancgtaatgtacgtttagtataataatctgctcgaagttgcacgttgtgcggtgt

SEQ ID NO: 54028 - DNA, 1358 bp, Oryza sativa
  unsure (1)..(1358): unsure at all n locations
gcgtccanatangactnactcggtcngcacgcccgcaggtcgactctagaggatccccgtcctcacaatctggcgccgctgctggagagcagcagcccgcacggctgggagccgctgaactgcacgtcgaaagggtccctcgcgtcgacgaagccgcccgctccgaacgacgacgctatccatggcagctcgccgctaccaccctggtgttggtggtggctgccgccggctgtctggaggacgtcttccagcgcctcgttgagcggctggtactggagcggattcagcaagcagtcctgtgaagagctcggcagctcacctgtacaccaaacagtggcgagttctttctctgtcagtgttggatgatctatgagggctttgacctagctaagacacctgatggaaagcaatgggcaccttgaggtaggttcagaatctgtgcgttctctgaagccggcatctgcacggactgggactggatggtggttggtgatgactggctggtgcactgggactgcaccttgaattccactatgcggttggggaacttgtaggcgtcttgctgcaacttcaccaccagcgcctgcaaattaattagcaatattaattgggtgacaagacaattatactgccatgcatctgaatcaattagtaactacttttggacgctgtccaggtgctgctcataatgaggatgtcctttcatctgtgcatcaggcatctttcgatgccattgatggcaacttgcaagtctttctcagaatttcaggtgtttaccttctgtgttggagtaagagcattcagagtgaagcagtggcttccaacgatcacaccgacaacctcatggatgcagttgaagagaaggattatcccatgcccgctgcagtaggagtaaagcttgtcgtccagaacgcactcccgtgcatgctcaagggtggtttccacaatcttggttggcacttccactggccaagttaacactgggaaaaaaaaagggggggacactgtggcgcgcggttttctcccggaggggatttgtgggggggagaaaaatattatttttttttttttttgtttgtgcgcccccacacctcctgtggtggggggggctgactcattaagtggacagagaaggttttttaaaaaatagaagatttatttgggaaaagggaggaataatattcttacaacctacggagtccaaatgggcgcactcacccaaattctccgggggaggttgtaccagggtgaattctcaaaactgaaaagcttttggtncccccccccnnnnncncccccttnnnnnnnaaggggccaggggncatangcnccnnnttnnnnccnnccaggnnnccccc

SEQ ID NO: 54029 - DNA, 1323 bp, Oryza sativa
  unsure (1)..(1323): unsure at all n locations
cgcgtcacnttanagacaactcagtcngcacgcctgcaggtcgactctagaggatccccgtactagtgtactgctacatgacgggtcataccagcgtactactaccacagtccacagctcagctcttagcaagatgctgctatccatccaggacaaaaggcaggcgctgtagcacacgtagaccacgccgggtttcagggttgcacatgtgtagagtaggtttgacccccggactcgccgtttcaccatgagctactcctccagcactgtagcgcaggacattgttcaagcttggggattgaacgcggacaggcatcacaggccaggagaacaatcaaaaccttaaaccaaggcttaatagcgcgcattgaagaaacacacctaatgcaagaatagcattgaaagggcaacaacagatcggcgaagcatcatgcaggccatgcattatttggaattgaagcacttgccgttgggaccagacagtccctccagcttgagctttggaggaggaaggggaccaatggaccattggtcgcgcagcctgggatggttgccacagcttccagtttcagtttcatctcctcttgttgctgctcccattatttggaccacaaaaaggggaaaaaaacatgcaggtgctagaagtatacgtatgtatgtacatctatgctgcacaagtagcataaaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcccggcgtttccttttttgggggttttttcttttttccccctctttccgcttttatattcttttggcggccaccccacaccacgcctttttttttttttctgagactctcccccccgcggcgggggggcgtttcgtaagatataaatggggttccttaaggttcgattaagggtttacggacctctaccccaaaaaattgttatggggagggtcaccgtaaggggccaccccctcaaaacggtttgccctttacgtgtggggccactctttataagggacttttttncnnnnnnnnnnaaacncccaggagcgnnnntgagcccaagcctcaaannnnca

SEQ ID NO: 54030 - DNA, 1353 bp, Oryza sativa
  unsure (1)..(1353): unsure at all n locations
ccgccccaggtaagacatgctcagtcnnnnnnnnnnnnnnnnnnnnnnnnnnnnnnnnnaatgtttgatgcatatatgcaggtttgaaaaacgtccatgtcttcatcaaggaggctgatcttgtgaccttgcctgcagatgaagtttgtacaatgacatgaggtgtttcatgttgctactggacctgtaactgttcttttcgatattccattcctggactagagaacctcaatttcctaatatttaaacttcatanacgaaatataaacttactcatctcatgtttggtagctactacaagtgaccttgctgtcaacattgatgccaattttggtgtttcggaattgttccatcccaccttcttctcttaagggtatctttgctttgtgattggngataggagcaaaagcacatctgtattgcaaggaggaagattatggaatatgtagaattaaaaagagagggtgtaccgaactacttatctaaaagcttgcaattgcgcataaaaggaaagaatatataatggccaacaaggagcttcacttttgtgtttttaagagacctaccaaattttctccatcaaaaaatggtgtgacagttggtgccgcgcaacttgaaaagacttgtttaaaaggtcagatgttagaaaccaaataccatatctttgcagactttttttaacattattctgttggttatatagatgatggtgtggctggaaagcaagttccacactggaacctggggaggttgaagaatctaaaatgtggggaaagagttttgctcaatactctcctgagttttttgtaccagccacgtcttttggggttccctagaattatttaataggattttggggcttcttagaccggattttggaaaagtattgattacaatccctgggggggcggagaaaaatataataatatttcttttttttataaaaggcctttaacaaattttgttccaaaaactaataatatatttctttcttaggaggtgctttaaaagagaatatttggggatataaacaaaaaataaaaatttttttctccacaataatggggagaaaaagagagggtttnttttttctttgggcttcctccacccacctctctttttttcttttgggtggccgaaaaaaagggaaganataaccttgggttataccaaggagcgtgttgggttgggttatcataaaactttctacaaaaaatgtgaaatacagacgggccccaacccctttttttttnnnaannnnccccnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54031 - DNA, 1311 bp, Oryza sativa
  unsure (1)..(1311): unsure at all n locations
ccgccccttgttgacttgcatagcangacgcccgaggtcgactctagaggatccccttgcacattgttgcaatacttcacttgttacagctttccattctagcttttccgggtactatgccaaagtcagttgaaactttattcctggtatctctataagagcagaattggctttaatgtaattctacaagacatgctagagaacaaaattgactgccctcactttcatccctagtttgaagccatcaggatttcattccaggttgttatcttctctctaggtttgttcttcagctcacctgccatcttttccttagaatcaatcttttcccagccatcaaaaggaacaaagcggatgttcttttgttctagaatctcaaggagtcccctcctgccttgcttttttgaatcagaaggtcccatgaacaaccccttcttgtcatcttcaaggatgctcgccacctgtatataacagtaagtacaatatgtagatagtctgttagtgaaataaaattatcagctaaccaagaactataactcctgaaaaagagtcatcatgattatttcacaagaacagccttcctctacaaagtagctattccattgcaaagacagtagtggatgagcaaatccacaataattgaggatttgaggtgtatatggacctaatgaacttccatgttggaactttcaaaacgaataaatcaagctactccaagatatatttgaaggcatttgttgagtaaaccaaaaaaactactataagatttaaggtaagcaactataaagttacactcaggcatcagggtgcccataaaccttctcaaacacaatgatagaacataagaaaacaaaaaggcccatactgtttcttcggcacaatggagatttgtggcaactatgccagttggccctttttttaaccatcccacccaaacaggccttggttcactggggggatttctcggaattttacatttatccttctaaaaaaaaaacacccttggggccgcctcttttttaaaaaaaatattttgtgggggggggggaacacacaaacaaacaaatctattttcttcccctccccctctcttgcctaataaaaagatgtgggccacttgtttccacaattttttagggttaagtgttaaaccaacccacaaagctctctgggaggtaaaaccaaaggtattatttggccctcctgttttttcaaggggaacctctccgggcggggttgttcctcatntttttnaanannnnnnnnnaatcatcnntttncgngggnnnnnnntnnaaccnttacacccca

SEQ ID NO: 54032 - DNA, 1316 bp, Oryza sativa
  unsure (1)..(1316): unsure at all n locations
catggcactttgtggaccttgaataannnnnnnnnnnnnnnnnnnnnnnnnnnnnnnnnnnnnnnnnntcaaaaaaaaaagaaaaagtaaagctactatactgtagtcattctgtctaaagctcagatatatgttggacagtaaaattgtaaaacatgtcactgcaatgtattagatggtatgcaccacagctacaacagacatgattctgcatggtcacttacaggaatgaatgaagtggtatgtacaatccaacgagcacttccagaacttaagcaaaaggcaagacttcaggaccatcacctctgcagcaaaaacatgtttccaggtttccaggatgatcagcagcacaagtttggctagcagtgtcactgtatgacacgatagctgacataaatcaatatcaatgtacaagaacatgaacatgaacttcatggagcgtggacccgtggaagagaattccaaccaaagcaaaagctgtccttgttagaatactggagaataataaacgaaggacattggaaagaacctttatcaaaagataaaagcgttcaaagagagaaattatgcacccgcttttgatcaaccatttctctttcttttctcttcattatatatattatgaacaatacacaaagatttagccagaacttaacatagcctgataggccaaataaaaaaaaaggttaatggcctcacacaccagttgttgagatcacaactcaccacactgagacaatcaattgggtttattgtcactcattgctgtactcgaaaaaaacctcgcaatctctcatgacaaacactgaaagaaagccaagaaaaaaaaaagcccatgaatcatgtgggaggcctcatttgttccacatggtttccatttgttgagaggcctttggttttgttccaactaaaggtggcgcccaaactatttcattgaggggttttttcaacaaacggatttgtaaaaaagagggggggggggggctctctcctttgggaggtataaaaaaaaacaaaccttgtggggaaaaagaaaccaactctcggtggttngcaaaaaaaaaaaaaataaataaaactactcctcttttcttccanacgcttttggggaaaagaatatttttgcagaagttttatggtttaatttcaataatatatatttctctttaaataaaattttgtgtccgccccctttttataaccccacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54033 - DNA, 2299 bp, Oryza sativa
  unsure (1)..(2299): unsure at all n locations
catggcncttgattgacnaactacagtaccncaatgccnnnnnnnnnnnnnnnnnnnnnnnnnnnnnnnnntacatgtatcgttctaagggatgaggactcacttgatcaggctgtcctctctttttcacggcattgtcatgtaggagctgctcgtacaatggaaccacacataaagagggtgttgtattagttattaagtgattaatcaaagctaagtttgcagtgatagttattaaaggtgtaaagctagagacaaagtactggccccatgattaactttccagaatgcttttatggaccaattaaagcaaagctttagacaaactaaaagcccctttgggaacaaaaggatcatcttttgtgctttacttaactgatcagctgggtatagatcccataaaggaaaaatgactaattgatcgaataattcattagttacttaatacctggccagggtcttctggaaatatgctgttcctttctccttgcacctataaaattaaacagcaattaaagggaatcaaacagctagcttttttatcgaccagcatatatatactcatttggttcgtcaggcataaagtttctgtcaatacttttatcgaaagatctcacagagatacgatgctctgaataaaatcataagcacaagctttttattcttgattattgtgtgcaaagtttgttctgccattacgtaacctaatctaaactaatctagctaacccatgcatatggtagttttgttgttctttttgcagtgtgcaaagatcagtgcatgtgtcaatccatggatcggaagaatagtctattgagaccagtacaataaaattgcaatgattagattaattaataatagcaagtgtactccctgttctgcagtgtgcagactcaaatgcatgtgtcaatgtggatcagaataatattatattgagcagtacatgaagaagtaacgtaaccctccaattaacaaaatgtactgacgcaacacctgtgcaggcaacatagtttggaataaagccataattttagataaaatatttcaagtgtatgtgctacatgaaaatagttgtgaggttgaagttgtgggcacattttataaacttatactagctaaaatttgtgaggttgaagtttggtctaaaaatttgtgtatgaccgtctaatgtagccttttcctaaaagagaattcttgttggaaaaaaaaaaggttttatgcgtggtgtgtggttatttaattacaaaacaacctactatatgtacgaatatgttttttctatcagtatatatttttcccaacaacttagcctagctgccaaaaacatacaacaaatatgtgcgcaccactgtactatagttgacatatgaacagatagatgcatgctagatagtaattgacaacgtacttggaacacaatcacttgacattaccctttgtctttattgtggacaagctctgtgaggggatttcaatattatttgtgtgtactacgggtcatgcttcctaaataaagttaactagaataaattgcagtagtactgatagaattatattttgtgcacataaaaaaggtagagatactttattaatcgtgaggtggttgcaggaaaccaacaatttttcatcggtttcaacccgaccaaatcattggtgtgtttctgtcatgacacaaagcctttatgacccttactgttgcccatagcttggggactaaattgttttgggtattcccctcccaagggggtccccggttaaaacccatatttattgggagcgggtccctttttttatattaaaggaacggagggttttcttattagaggggcgtttatttgaattggtggcccccacttattttccaatgatcccaaggcctccgaacaaatttctggtttggcgttttttttgtttaggggcttgaggggcctttcttaggggccttgccctcatattttctcttatgggggctccaaggcactttttttttgttcccccccccccaccccactatgacttccttcctccaccaccttttgggcgcgcgctctattgagatggcatttctcccccattctcttgttacccctcttatagtttcatctgaggccccgcccatctcatcctctatggagttttactctaacgcgtcgccttctaaccatgagaaggaaaaaccgcgtgctcaatattttctttgtcgcaattctcttatccacgtggttatactaatgcaccgctatccttcccacaagatcacccttgtcgtgcgtccctctgtcttctattcctcacgtct

SEQ ID NO: 54034 - DNA, 1303 bp, Oryza sativa
  unsure (1)..(1303): unsure at all n locations
gcgccttgacccccattganaatgctnnnnnnnnnnnnnnnnnnnnnnnnnnnnnnnnnnnnnnnncttctccccctatccttttccttggatgattttatcatcacctcgaagcaagcgctctcttgattgctgtgacggccatggctggtttggggcctgatcacggtggagacccatccttcctctgtgcaatggatttttgtccaagaaccaaattattccattagccttttcttcggtttgtttgcgtttcatctttagaagtttcagcatattgaaggacagccacaggaattcagcaactcacaaactggtcactagttttggtctatcaatatactgttctacttggaagtagtagtagcttgcaagaagaagcgaagatattcatttgttcctgcaaaatttctctcatctgatctggattccggtctgttgttttcttcagagccgtgggatcttggtggagttcagtttgggttggaacacgatacaagcctgcaaccatgtgcaaggagtgtactcgtactactaattttctgccaaaaatgccgaaggatttgtccaagagaccgaggggaactggtcttgggtggtcaaggtataggaaaggaaaagaaaacctgttaggagctttcttgatgagattgcttctcttgccgatgcttgtgttactggctgctaatctagcctaaatttttcaacaattttttctaagagggagttgaatttttttcaaaggaaatcgtaccatttgcatgtagacacatggatcgctaatcttggttggacctgatcttgtgggacgcctataatttgaatttcgtacgaaaacccttgcaaataacacgggcggcggtatttttattttattttccgtaggggtttggattggacaaaattacacttgtgttacccccctgatgagaggcttgttcaacccaattgttttgcggatggaaggaaattatttgtatttgtttctcacaatgaggacctcttacaccactggtggtggtaaaagcccaatccccgttataagccgagctctcccggcccaatgtcgtggttacccccttgttatattgctcccagggtggccggactcacgagaactcaaccctggcatgttggtgttgttgccctttttacagagcgccaacaattcgccgcctctattatatatatatggcgattgccacacatgagngaatatgttgtattttcggtgtaaggcgactaattacaacacatcctcgtcggcgcgttttcaggtataatggacaattactctgcgact

SEQ ID NO: 54035 - DNA, 1293 bp, Oryza sativa
  unsure (1)..(1293): unsure at all n locations
cgtatgtatgcaatgtccacccatcacgatctttctgtcctcctgaattcttcccgaagaacccaatccttctctcttttgcacattcacctttgcctgcagtgccaatgaaatggacttccccttgttgttctttgaaaagccagggttattaatctcataagaatcagatgaagtcctaaagatcactatgtcatcttcgctattccagctcctgttcatttgctgccccctggaaaatctcacatcaggcagctcaagattggtccgagatgactgcagctgccgagacactgccctctgagaagctgggatattctcccgtgtctcagaaatcctcaaaggaatccgcgcaggactgtatgagcagattttctccctagaactgacctgtggccttggctcaagaatcttggctgctgcctccatgatttgagccgcatttcttgctgaactaaatcccggattcttgattggagataacaatctgtgatgggacattggtaagggtttggctgaccttggcggcaatgtttctatctggaacctctcaatcgggctgctcggcatcttctgagctctcagatccaatggcttcctcatgtagccatcaactcttcgtggcacataactgaactggtcactcccggagtactctgggcttctctttaggctctggctgtccctaaacgaccgtgtgtcacggaatggtgtgcagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttccttctcttttacatgaccttgcctcggggttgggtggggaggcgtttaattctctaagggggatccgttttcacaaatcgggtatcccggaaatctgtgacaagccccaaggccggacctcaaaggccgtttgggttttatagttcccctgcgcgttaaaatatctcaaaagggggacacccggattaaaaccggttccccagaacttgggctttgtacaccctaaaaaactcctttttttggggggttttaataccgggttaatgggatcc

SEQ ID NO: 54036 - DNA, 2861 bp, Oryza sativa
  unsure (1)..(2861): unsure at all n locations
tgtaggtttttggagcagggcgcccccccccaccgctgggcgcccgtggtatttcaaaggtccgtcttttacacgaaagattctcgccgcgttttctttaggcgggcgcctttttggcccctatttgtttcgagaggcatccctccctctagctcgcggctgtagaaaaaaaaaactcccgggtgtttttattaagtggggaaaaaaatagggccgcttttttgcccaaaaaaaaagggttgacctttatcttgggaaaaaccctaaagggagagcggaccttattggtcccttccctccggtattaaaacccccggaagatggccttcccgtgcctcgcctgtttttttaacancccttggtgtattccgcctatgtttgagagtttgtaacccacttaatattttaaaattcccggctgttcggaaattatgatatgctcctataattttcccatagatttataacaaaaactgcaagaaaacctacgccgttttttattttcgtctcaaagttataccgagatgattatatcagttatatcatcatatataacttcataaacatggataacaaaaaatatatctatgattattcgaagtaaatatttcgttcattatgaaactgtgataagttacaataacattagagtcatgataacattatcagattgtcaaataaactactttcatgtattcatatttttaatttttattgtgaatatattgcaagaaagaccagatacaaagctcttactatggtactacctgcatatgttatacgtagataacttaaaggtatcaagcatatgtcccattaatcttgaatgtgtgtccaacccacttacaaattattatccaccaaacatcgagctacaattactaacaaggtatttgtgcatcatatcaaatatctaagataagatatgatgaacatgtgtaccattagacgcacaatagagataaagggcattttataagggacattcgctcatttaacccttttctaaagcttaacatcaatttaatcattttaaaaaaaagtttgcttatttgaccatgtttttcaaaatcgaagttgtcgtctgactctactttcactacatcctgagtttttcatttagagaaaaagaataacatgtatttacaagcccaaatgtctaaaataacactgagtacatcaaccttatcctcaaccactcatttgctcattccttatccccatctctcctctctctctctccaaagcgtgaagggcaggaggagcggtggcggtggcataacgacagctgcggagggcccccggctgctttgcggagggtaggagcggtggcagagaggcaacattaacttgccgacaaggaggaccgctggcggtggcggaaggggcagagacaactcggcagaggggaagcagcagctccatgaagggtaggaggggtggcgtcggctcaccgacgtggaggaccgccggcggtggcgaacgggaggcggtggctgtgaaggagcggtagcaaccacggatatggtaggaggagcggaggcagagggatggtgtcggctcggtgatgagcagatattgaagttgtaaccagattcagtgatgaggaggatagccagtgacggtggaggggccgcggcacggtgacgaggaggaccaccggcgcccatgcgcatctccgccattagcttgctacctgcggtttcttccgcataaaattggaccaaaggagaaaaattaactttggaaaaatatggtcaaataagtaaggatagaagtggtatttggagcttttgttaacaccgatgaaccgatgaatgcccttaagagaagagggtcagagtgtagcttcggttttgaaaaggagggtcaaatgagcaaagtgaccaaaacagggtcaaatcggtagttggaccttcaaattgggtcaaatgtgcaattgctccattttataatatagattatatcattttgtatcattttatatacatacatagccaaagacacgtgtgatgtactttaatctatctaaaaaaaacatgtctacgataataagaatcatagaaatttaaaagacaaactcaagagcatataccctaataatacactaatagtaaataaaaatatcaatggctaatccctaggacatataaaattataaagtattattttatcggtttattaaactccctaaagaaccctcctacaacgtctattaaagtctttaacaaataagaggaaactttaaatttcttttgtaacagataaagcatctaaaacttaatcctcattaatttaattctcccattaattttggctattgggtcatttcaatgggtatgtgtatacacacattatttaataaaaaaattattcatccaagcatgttatctagcagaaaattatttgagatgtcaggtgaggttgtagtgacctgttgcatggtttagagggttgttgtaaggatgactagcgttgagttttactaggttgccagccatccaatgcatcacaaaaagagcccataggagattttttgtgttttgttgatcgagccaccattaagagaaggcaacaagggaaccccagtacaaatatttttttatgactaaatcttctcttaaatcaagtatctatgtaattttatttaagtcgcgttggcttaagcatacataacttggtatatctagaaggctacatgttagaatattcaattaacccatcttagaaataataatacttagcaagaactcaagcagataacaaatttatatcattaattttgatatttaattttaatcgnnnnnnnnnnnnnnnnnnnnnnnnnnnnnnnnnnnnnnnnnnnngtcaaacatgacatc

SEQ ID NO: 54037 - DNA, 30180 bp, Oryza sativa
  unsure (1)..(30180): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactcaccattcctgcagcaacttagctaatacacttatgcacctctgcttagtaaattaattaagcaggaaactgcaaaagttacagtagtgcagaagctaagtgcagtgactagtagtgtgacatcgtcggaggcgaccggccggaactgaagaataatgaaggcgaccgcggcgatggtggtggtcgtgctgctcgtcgcggcagcgtcgttgcatgccgccgacggagccgcggcggcgccgcgccgcgtgctgggagctgacggcggcggcggtgatcagtcggagagcaaggtggaacataaatccggctgcacgaacaacgataacacacccccttctggtgtctgcccgccgaacgcgccggggccgtgattaatttgttcagctacacgtcgtcgcccgcatcgcaaaattaatactcctatataaattaattaatcagtataaattaatactcctatttggctgatgaattaattccttcttggccttgatgaactatattttttccgtaaataaaagtaagttcaggtgtgtacttgttgcatcgcgtttgatgcacgcaacacgtttaattgattcaacgaatgttgatttgttcagtatactcattgggctcttcctgtaaaagtaaatgatgaattttgttttggtgttttgttttgtgtgccccgcttgaatctgcacaatacattttggaataattatattaaggatgtcggtctgaacaaacacccatgttaaatacagtaaatacaaacgtcatctctctctatctaatctacctatctaaaaaacgagaaaaaacaaacagagacatacaaggatttgaaccgtttagacgtacacattgttatctagacatgtggccacgatcctgctttcttatatactccctccgttatgagatatatgacatttctgacagcatcgacgaaattaagtatacaacggtgaagtgaacatggcttaactagttaactagttatgttttttttaaacaacccacgtacctaggttcatgacctagactagaaatggattctcgtatttacgactaattattttttcagcgctagccgacatacccgtcaacatcgaggtgcccatggtgacttcgtcaatctcaaaatatctcaacatagtctttcggatgtgctaatagggtagggtgtatatgtgtgttcatatatatgagtgagcatgggcgtattgtgagcacttgcatttgcactgtgtgtgtttttttttaaaaaaagtatagagcgaatttactattttaccctttattcctcttcatcgatgtgtttgtccatgccgctgcgtcgccaaagccttggacgacgaggaggaccgagggggtttccgtctcccttcacgccggctcgttcgccatctctcccaagccacctcgaagctggctcactcgccgtctcccacatgccacttctcgtgaccacagtgtttagaatagaaaaatatggatctcacaatgcttagagagaaaataaatgtgggcgtgccagtgtatctaaatacacaaaatataaaacatgtacaacatatacagatacacgtgatctttattaattgaattaataagatatagttttcgtgtataatataaaaatcatgcaccattgcttgtcgttgggcagatcttgacatcagcgatgtgatcttctggttctcaggacctcgagaggctactggttattacctccataggttagaacctattggagaacctccgaataaactgcttgtgatcatctttttgtcttaacttcgtgttcttcatgcataatgataagatgggtgttgatgtagatgtgtgtgggtgccaacaacatatccacggcttcgtcggttcgtgcgccggtatcggtgacaagccttcatatagtctcgatccgcccgccattattgttcaacctcatcggtcttgaacaacgtgtaagtgtagtttgttggtgaagacatgatttgcgtagcttgaatagctcgatgtcacaatagttgcatcgagattatattagaaagggagaagccattggagaccgtccgtgttgatgatagcctaattaatcgtggcttggcacctcctacggattacgacggctctataattatgtaagaactagaggttggttgcattgaaattattacttcacgactgttaactagcattagcatatgaatctaaactgcaattttattaattatttgcatgcaatacattaatatgaacaatagcatactgaaattatgcactgccttgcaatatttgatgattatttaaaaaattaaaatatgacacactcaatttccaattgtcagttcctcattaattatttgaatagagaaaaaagtataaaatggatttaatatttacctgaaaccagcttgacctgaatacgcctgtaggtggtagctagttctggtgatcgatcagattgtgtgatccaaatggccgctagctcaggttatccgtgacgtcataggaggaaacttcatatgcattacatcatcagattaattaattgatcggtcattctatattatcccaggcaattcaacgaagtcacgattcaattcaactattcaagcagtctttgcgtcaaaaatgaaaatattcaagctgtcaatttgatcaggggctgtcagtatatttactgtacatattcttgtgacaattcagttctcaactggtatcgtacgcaaagaatgctagctggcacgtacatacatgtgcgaccgttattccaacagacatggcagtcaaccgggtcacatcatgtaaactagctgcatttaattgtatgtttagttccatgctaaaattaaaagtttgactaaaattgaaagtttgaagaaaaaagttgaaagtttatatgcgtagaaaaattttgatgtgatggaaaagttagaagtttgaagaaaaagttaggaactaaacaagggctaaaaactggatgaaagacttacaaaaaagagagagagagagaacatttgtatgtacgtagagagtctattttaaactctcaggagacttcccttggttacttgcatgttactcgaatagttatgaaaatttttttgagtagatgtattaatatgtgatattaatatcactctacaaacattcaacttttaactctataaacattcaacttttacatgtcgccacgaaaaaaacattttgattgtgaacatatcactgctagagaaaccatctttggtcggtcggccaaaatttacaatagtcctggttctaataaaaatcaggactaaaaacatattaatttagccccggtttaaaagctcaggggtactttttgacaccaacgggactaaagatcatttttagtcccggttcaaaaaaaacagcaggcggggttagacacctatattttttttagtcccggttggtgttaccaaccggaactaaagatctatttgtagtactggttgacggttggtaacaccaaccaggaaaaaagatcggcatacgcggagattgagaatgaggtgtgtgcgtagattggatcgaggaggcatgcgcacgcggtttctatctcctcttccctcccgggtctatctcctcctcctctcctttatctcctctcctcactcacccttctcttcctctccttctcctccccctcccccctcctccccctcctccccacttctctggcaggcggcggcggcctcgcgtggcggcggtggccgggcggcggctggcggtggaggccggcgcgccggcgaggaggccatggcggtggccagcggtggaggcgggcgtggccctgtatgattttttcttttttcctttttgattcgatctgtgtgattcgatgtgttgatttgatctgtgagaatgaactatattgttgtgaatgattttgagaatgaactatgtgttattgtgaatgatttgagatgattatgtttttgtggatgatttgagatcgatggtgagagatgatattttttaatgatttggagatattgggtgcgagatatgaaaaaaagaaaaaaaacctgttaccaactagaattaaaaataggcatctttagtcctggttgtataaccaggactataggggattacgaaccgggagtagaaagcctttctccagtatgttaactatttgtagtttaatttgctttttttcattgcgacatgcagaaagctgaattttaagtttgtcgagtgatatatcacatataaataaatcttcttagagcttttattaactatttaaaaatgacatgcaaacaactgtaagcatcctctgttcagaatagtttccctatgtatgtacatacattacagagcttatcagttcggctttatcgtgattcatgatttcaaagtgttaaacggaatattttatatattagtaaagttttttcttaaaacgttatataattttatttttgaagaaaaaaaaccatcatatagctacacgaagatatatatagttgaagaaactttgaagctatatatactatgcaaaatgaatcgatccatgcaaccatttggattttcaacgtagaaaacggagaaaaatataaacaaatgctatcgatcaatgttggacccgcagtctcgtatgaaatgaacgattggagaaattttacaacgtttttcccacataatctattgcacgaaaaagctaaggtaatctcctgcttcgactcgagacacaggagactagctagtcaaacgtttcgcagtgaaaaacaaccgctgggaaaggagtgatgctgaacattctttgtttgactagcttgacgcgactctagctagctagctgaacgatcagtacacacgcgttttgttcatctgtgatgcgatgcttaaattaaacaggtcgtctcttagctaccctccgttttaggttataagataatttgactttggttaaagttaaattattttaagtttgactaagtttttacacaaatatagtaatatttacattaccaaattagttttattaaattaataattaaatatatttttataataaatttatcttggatcaaaaatattactattttttttataaagttagttaaatttgaagcagtttgactttgaccaaaattaaaatatcttatacgctatctcgatcagtacgttgccagaccaagcatgcacaacgtttattatattttcgcctctttttcttacgtaacatccatgtcatcatctagccttagctttcatgaattaatgatgaattcatcagtgtttttcttcatccggctggccggtggtctcatcattaattcatgcatgcagcgtacccttagctttcccagaaattctcggtttaattcctcgatatatcgatctcaaccatgcgtgcttcagaagctgttttttagatgacagattcagctttgaaaggaaagcccaagaatgaaacatatatatagtctggccgaaagcgatcgagttgatctcatcaagacatcaaccatatatagggacatcacgtgttcatcaaattaatcttcagtcagttcttgaaagttgaatcttggactcaaaacttacctccaccgttttacaatgtaagactttctagcattgcctatattcatatagatgttaatgaatctaagagaccttttgcagcacttggaaggtacccaaggtacctctcctcaacttaaacatccaccgttgattctcaaagagtagattaggaattgaattaacataaacatgggcagtttagtaattgttctttagccatcgtaatcaaccgttctttattcttttgctatatctttctgcacacctggatgtaatttttcgatccatccagccgcacacatacccctatataatggatgactcaaatttcaaaactaggttttatacatccatccatctttattgtctttagaaagtaatccatacaaagagacggaggcgcatcaatcaatttttcgtttggaaatcttcagagtcacatgcaaatctcatgcggatatatggaaagacgcgtggatcaattacttagttctaatcatcaattatgtggtcttcaattagcatctagttacacgatctgcaaacattaatcaagtactcctagacgccgtagttagtttcttcattagttatacagattaggtgcaagccgtgtgcagtggcatcaacagactgaagacgttatcatctctctgcgctccggccgccggagcagcagaaaagtttcccgtttagttcttcctctctttatgaaatatagaaaccaaattacatatctaacctttttcaagtaatgcctggcccacatatttaagtaccttttcacatgtatgtggatcgttagattggaagccatgaacagatttgacgcactccaaacacagtagaaaatctctgaatatatatatatatatatatatgtctagattcattaacatttatataaatatgaaaaatgctagaaagtgtcacattattaaatggagggagtagtacttcttcatcagaaaccatgcataccaattcttccagtttgatccgtcaagaacgctgtcgatcaatcgtgcagctaggaaacttcaccctattttttctcttgatcgcgtttgaacggcgagataatctcgatcgagcttggactgggagctactagtatatattataagtacatctcatatgctcgatcaccacacctgcagcaattaataacctagcgcatatcaacaagcttagccaagctgaagcgaactgcaagatagctagctaattaaggaagattaagccggaactaattaatcaagattgatgaaggcgaccgcggtgatgatggtgctcgtgctgctcgtcacggcggcggcgtcgctgcatgccgccgacgccgccgctgcggtggcgccgccgcgccgcctgctggccggagctgatgccggcggcgccgttgagtcgccgccgccgccgccgccgctggtgtctgcgagcaagacgtcatcgggggcttccgactgcacgcacaaccctactaagccctccactggtccatgcccgccgaacgccccgtgattaattaactaattgaccagctacacatatctattaattaattccttcgtggcgttgattgatacagtagtactacattatactccaaatatttactcatatatatatgtagtatatatattatggttcattaactatagttggttgtcgtaaatactattataggttcagttcgttaattaattagttgttcttgggttgtcgtcaataataccagtaggcaaacagtgccacacatatatacaagtgtcaccgtgtcgtagcttgctgatgcgaaccttagatattgctgtagtttgatttgttctgttgatttatgtacgtatacctcacaataaagacaaacaaattagtccattaatttgttcagtatttgttgggttctgtacttctgtctgtaaattaagagcatgtacaatagtaaactataagccaactataaccatatatcgagaagaaaagagaggagagagaagaaagtgtgctatagatttatagccggctgcaacacggactccaaaacgttgtgtgtgtatgagaggtgggaccgagtattaatggtgtaatatatttttatagttaactattgtatgaatgggttattatattaattatagttgttttggagccaacagttgactatattattaaacttgctctaaatgacgatgaatattttttctttcgccaccacgaattgaattccctgatgatttttgtttggtgtcgtgtactcgtgttccccgcataaatttgcacaatagatttgggaattattaaggatgcctatcctgaacaaacacccatatgcatatatactagaatcagtataaatacagtcgccatctctcagtctccctctcggcatgcatgtggacacaacccacggctttcttgtgtgtccttttcccaacattcaaatagaatctgttttcaagttttattgtatttttatttacattcctacatttttttggttagtcaattaatttgttttatatgacccaagtcaaagcaggttgcataagcaaccactacccagaaattggactattcctgatggcaggaaaaccatcactactggagaattgataattctccggatggatggtaaaaattacattagtttcggttcaaatagaaagcaggattaatttttaggttcaaaagccaacgaaacttttttatctttagtcccggttgataacatcaatcgggactaaagatcattttaggcccggttcaataactgtcaggccgtgtcaggccatatatttaatcaaatatctctctcacacatccttatctttatttctcgtccttatctaccgggcgcgcctctctcgcctcacctctctcgatctttctctcttgctcgctctctcaagaagctagcggcagcggcggcgccctggcggcgaaagctgtagtggcggtggctgcaccctcccctccgccagatccagctggaggggaggcggcacgatgggaggccgggcggcgtccgggctgcggaagtagcggcaatgggagtttcctgtcaggagacatttgtcctgatggccacggttaacccaagcaaccataagagataaggtccgagatgatatatatacagctatatacaatactcggtggactataatcctcaaatatcctctcatttttgcaggacgagatagaaaaagataaacatgcaaattgaaattcaacatatcctcaaatatcctctcattcataaaatattaagaaaaagataagatagattattatgttatatatcattctataaacatgcaaattgaaattcaacatatacatgtaggaaaaaaataaatttaactgtgaatagtacttgtgtacactactacataaatactcatctatgcaggatgagaacccctcatcagtaccggttcctcaaccaaaactacaacgttgacactgatgagtgggtggcaccaatgctggtcttggacttggcactcattgtttgttggttttgttatacgatgaatgaatgaattactccttggtcttgatgcaaaaagaaatagggcttagacttttggacggagggagtacttgttgaatggaaaatttgaatgagattattcatgaattaatgatgaaattcatcagtgttttttttttcatccggcttggccggtcgtcttatcatgcattcatgcatgcaaccccttagctttcccagaaaatctcggtttaattcctcgatatatctcaacgatgcgtactttagaagctgttttttagattaacagattaggctttgaaaggaaaacccaagaatggaattaaacatagtctttgccgaaagcgagtcgatctctcatcagtcatcatcaaccacagggacatcacatgttcatcagcttcatattcagtcatgctcttgaaagttgaatcttggactcttaaaaaccaagtatagttcttcagaaaccatgcataccaagtcttccagtttgatccgtcaagaacgctgtcgatcaatcgtgcaggaaacttcgccctaatttaattttctctcgttttgaacggccggcgagatcgatcgatcgagcttggactgggagctattataagtagctcttcatatccagatatacctgcagcaattaacctctagcaagctgatcagttaattaagctgaaacgagctgcaagctaatcaagctctaagagagtgcgacctgcgacgtcggcgattaattaagccggaattactgatgaagatgaagccggcggccgcggtgatgatgatggtggttgtgctgctcgtcgcggcggcgtcgctgcatgccgccggcgccgctgccgtggcgccgccgcgccgcctgcttggagctgatgcatgcgccgccaccgccggcggtgtccgagagcaagccgtcctccggctgcacatatggccctaacttgccacctggtatttgcccgccgaacacgccgtagctaattaaccagctatacacgtacgtacgtcgtcgacgtcgagcatcgcatcgcatacaagcaaaagatttgggctgattaattcattccttcctttgatttgtagctagcgttgattgatatatatatagatcatatgtgcatatatgttactacctgtcatgaatatattggttgtccaaaataaaagttttagttagttattagttagttgctgcatattgttgatgcacgcaacaacgcccaagcatagtacgtggtagtgctggcagtagcttgttgaccttacagactactgtagtattttaatttcttctgtagatttatgtatgccccaggagggtggtttcacgatataaataagagggaaaatgctgatttgtttagtcttcattaattgggttctgttgtgctgtaattaaatgatgattttttttctttcgccacgaattgaattccctggtgatgtttgtctaggtgccgtgtctacatgccccgttcccgtggcatgaatcttgcacaataaagtttggaataattgggatatatgtcaagttttaatcaactattcaaaatagattattaaatacaccgtaacactggatcatggaggagcgtccatatataatttgtgtcatagggatgtcggtttcggctgaatcttgttaataatatcgtgccctagtgtgttgtcgtgtttctgttcttgttatcgatgcgctatcatatataacagggctctagtggacctactctaaaaatacactctttagggggaaaatgtttaggttaaaattacactccgagggagagtagaatttatctaacagtatctctttaaaataatagaatttatgatattcgctttaaagaagctacaaccaattattacaaatgttgtagatcgagactgtcacctataaaatcacaacttaaaacaagagaactacatataactccaacaaaaaatagataagaaaaactttcatctagagttagtgaggaatcgcataaaacaattgtttcgcagaagattacaagttatgtagcatcttcctcaaatcaggaaatcgtatccccgaaattagcgtccgatcatttttccgattgaatttcgctcacatcaccatcgatgactgaaatcgaaccgaaacggaagataccgttggagagaaactcactaatcaatatgtcattcgcatgcagttgccactgtaatagccatcaaagtcgatccaaaaattaccaatgtcacacaaagcctccaaaacgatgccttcatgaaggacacaacggagacatcgttacgacttgtctgaaaaaatgccccagctagcggtggtgagtcgtttgcacgtcgtccatggcgcgcttcgtcaattggtctctgtgcaaaaaatgttatacgttgatcattcttggatgagatagtactactcaaaagatattcagactgaagatcagttatgctgcctcctgtcctgagtgagtaagagtgcgacacagataaataaagttaattgttcatttataccaacaaattaacagatgaatcagcgcatagctaattaactacatatatacatacattattctgcaacttgctagctctgaaacgatcaattattctacgcgtaaaatttatactattataatttataaacatcagcaattcatcggaagtgtacgtgtagacagtgtagtgatatgtatacatatcaatcacggcatttttggtggcgcgcagggacgtccagaaatatgggggtcgttgctgcagccagaaggccctgacgacgccttgctgacggacaccagcggaggcggctgctgacggcggccgccgccatcctctccgagacggcgcgccgccgcgaccgcgacgccggcgttcagagacgccgcgacgagcagcagaaccagcagcgccgccgcaccttttcctcctccctccatgtcgcaagttcagcctgaaattaagcctcggttcttcgttgctaactaataagcagctagtagctagattgaatgcttgatcaagttggtgtttctatggatgcaaatcaaactgtaggatatgtgggtatttataggtttcagatgagtatgatcgaccaagttgatgatatttttccgcgaaattaactgtgcaatctgacgcagaagacgtttttgacggattaaactggtgtcttattcaatttatcggtgaattttacgcgcattgtgcagatctgtgatgtcctgaaatcaaagttctgctggtttctgtactggactgaagattgatcattgaaaatgaacaaagctgcgacaaaattctttacgtcgcagctttgttcaagttcacctgggtaatggacacatgatcctcttctggaaagacaattggctgcaagaaggttgcgttcgatctattgccccttccatctacgtacgatcatgttccggcccacgtgcgctggcatcggacggtggcagaagcgctgctggatcgcagatggatcagagacatatgtggggcgttgggtatccaggccatcccggactacctcaagctttggtcgcttgttcaatctgttgatcgcagtaccaccaacccagattcactcagttggaaatgggagagtttgggccaatacaattccagatcaacctatatataaggccatgttcttcggtcctttctctcagccccaatctggaaatcgctcgccccgcctcaacgtcatttcttcatatggttggtagctatgaacagatgctagacaaccgatcgttttacgcaaccgtgggttgccacacctggatcgttgtgtcctctgcgatcagcaagatgaaagcattgaccatattttggtagcttgctcggaatcaaaggcaactttggtggtagacgttgagagcgatagagcatccagactgcttgcctctaaacgagacatctttccacctctgactttgcagaagccgaatgaagattcctaagtcacatcaccgaggatttgacactgtcgcaacgctggtggcttggacgatttgaaaaagaatgaaacaatcgggtattcgatcaacagaacaggccttgggtcgaggtggcaaagggaaaggttgaggaagcggtgctttggtgagcagcaaactcaacgattcccttcattttgccgttgcgaggtcgtggtagccaacttatttttcttcttgtttgcttctcatgttttggtctcctgctgatttttaatttactttgtatataacttttatttctcttaatgaaaaaaaatgcgtttcttgtgtattcctgaaaaaacttgaacaaagcattgtaaaaagtttgaatccgtacaatatatacttgactgaaagttaatcagctggtatgcataacccatttgacggctaagtatatgttggaattttgatggaatataacgagaaatttagctagtcaacaagtgcccaagtcattggttgatcacggtaggcgcaaatctccagtcgtgatcgatcaggacagtccagataccacagaatattcagagcaaatctttgccatggttgaaatgttgacagccttgatggcagacagtgatctggttcgctggcccaataggagtatccgttttttaatagatgacgccgttaactttttctcacatatttgaccattcgtcttatttaaaaattttatacaaatgtataagatataaatcacacttaaagtactatgagtgataaaacaactcataataaaataaattataattacgtaatttttttttgaataagacgaatggttaaacatgtgagaaaaagtcagcggcgtcatcaattaaaaaatggagggagtactaactaattaattagtcgtatgtaggagtaagaaaatatgtacaagtaatgacaacttatgcacgcaaaggtcccataaacaacacagagaatttacttgacgacgatgttcttttcagttacctggaaagcaaaaagtatatacgtactgtagccttgtttctggatcttccatggtttctcgacattgacatgtatgacaaggatatatgcattgttcaatactttgatgaagatgtcctgctagtcgtaggtctagtcttctacactgactataaatgtactagactgaatgcaaaaacattctcaatcgttgtcgatgtttcagagaattttacacatggatatgcaggtttgtaatatagaatgataccggtttgacttgaatatacctgaccgactatatatatatatatatattaaatttgtttggtgctccatggtgcccgggtaccattgttgaaattgagtatatacccaattcaaatgagtatgaatctttttcaattacttaggtattaacattaactactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattattataactaggtatatactcacaatttaaaattttgaaaattttgagtgattttgtgcattagataccatggtgccccatatgagtgtcctatatatatatatatatatatatatatatatatatatatatatatatatatatatgatgcgagtcacacgcataattggactgatttgaagccctagaaactagcttgacttttcaatagtagaaaaaaaaaagttcgacttaactgaatggatcgtacgtaagaggatgcatggaccgacttgcgcttaattgatcatagacaagtcaaaagcttaagttttcatatttttttagtgaaaaaagcttaagtttagtgtaattttaccgtccttcagaagacactggacctactaaattttcaagtgtaaaatttttgtacgtctaattaagtactaattaaacatctgttttatgtaaaatttagtaatctcgagatattttctcgaagaaacataaaaattctcttctcgttgtatctcatcactcatcagtcgttttgtccgtgacgtcacaacaggaaacttcgtgcatcacgtcagattcgatattgtacattgttacggcaatttttcaatggatgccgtacgcaaaataggatctggcacgtacttacgtttattacgtgcgtgcgttccaatagacttggccgtgaagctgggtcatgcatatatgctagctgcgtttacctttcaaacattcaagtgagaaatttgaccaacgaatttctagcaaagatttgtatatatcaaaagggtataccatttccttcactgttttactgttttagtacttaccgtaacatatatagagttacacttaaataaccattcaaaacttcagttttatttgacgatagaactataaaactccgtgataaggcgcggagtgccaactaatagtactacatacacacactcttacccttgcctcaactttcgagttgtagtcttattggactaaaaaaaccatttttctatatgatagcttttttttctagacaagtatggacatggagcgaaaatgccgcctacgaaaatggtaaccccgtgtaagtttgtagcccgccatcaaagataggtttttgcaagtggaccacataagggcgccgcctgcaaatcatctttggcaggacattaattaatacataaataatatcttaatattatttatgcattaattaattatttaattacaacattattgataaaaaattattactaaaaaattggcaggaaattttaaattttggcgcgcacaatttcctaggcgccggggccttcttatcgtaggtggcccctacctttttcccatgtggtgcgtcgtgctcccttccacctaggaaaatcatcttcccgagcggaccgactggccgcctgcgaaaatcaattattttcgtaggcctttgcctacaggtggaatctctatccacctggaaagaccgttttcggccgcctgcaaaaatatttttcctagtagtgccaggtcattggtttttcttcaatttcatcttcgtccactatgactggttgccaactgtttgtctccaatcctcttctagtactatctttatttttcactagcgtaagtcaaatttaaacttcaaaattttcaggatagtacatatgtacattgaatgtcagtttttttcaaacaaaactgtaacaatttgtatgtattttgagaaattgaggggacgtccaactcaagtcaagggagaagagatacttaatttcctcatggaaaatgctctttgttggttgtccagaatggtccaaagtctgcaatgcaaactggtttgacttgaatgtctaaaccggttacaatggctttttccttgtcagttctctgcagccaggtttttccttgttttttcctttttgaaaagtaaccaagggcaccctgcaactcagcaacttgcaggctgaagagcgctaaccgtgtggaaatacatatgcagcttgtgagagtattgtttgcctgaaaaaactgagggcctgtttagttcccaaacaaaatttttcaagctgccacatcgactatttagacacatgcatggagtattaaatatagacaaaaaaaaaaccaattacacagtttgacaggaaattgcgagacgaatcttttaagcctaattgcgccatgctttaacaatgtgatgctacaataaaatatttgttaatgatagattaattagacttaataaattcattttgcagtttcctggcggaatctgtaatttgttttgttattaaactacgtttaatactttaaatgtgtgtccgtatatccgatctgacatgcaggggcaaaattttgtgccaactaaacaggccctgaaatggtgaactaaacaagatttgtcaacaagaacctgcagcagtatttgaaggtagaccaaacaatttcctatggaaagttctgaatatctagtatccccagatcacatatcagtcgaccaaacaatttcctatgtatgaaagttctgtataccatatatttccctttaaatttctttgctgcggcagtaactctgtaaatctgtatggccgtcaaacaggttaggatacagactagatctagaatatatttctcgttctatatactctagatgctctgcttgtctgctagtcccagatctcaacaagaagaatagtcatcgaatcagaactattagacgaagactagctagttacctagttcacgcttgaaaaattctggagtttacacatgcattatagtattaatagcgcagataatacattgccttgcatggatgaattcagggaaaaaaacttgaggaatatccatgttaattagctccccattaattaaggagaatatagtttgcagcgagaaaaaactgttctaaaacacgtgcattattaaactgatttgaataccagaaaccagcttgacttgaatggacgtgtgtaattcgccagagacaagtcaaaagctttaaattgtagatcaaattgtagtagtagcagcatctcaaattgtagatcaaattatagtactgtacattcctatgacaatttgatatagtactgtacattcttatgacaattctcaactgtagtcgtcgtacgcaaagaatgacggttattccaacagacttggccgtcaacagggtcaaatatcctgcattcaccttttattccagtttgatatatactcatgtattatgcacttttggaagtaataattgcaattaaagcttgttccagcaggtttgaatatttaaagatataccgtacttgctaactcatgggttgcatgcgctattattgttgttattatggattgaaaaaattatgctaaatatgttactccctccgggttgataatatttatcgtttagacaaaagcacagtctccaaaaaaacaactttaactattattttccattataatatgtataaaagtgttaacaaatatatgattttattaaagtacattttaagactaatctatacatgtaatcatcatatttgaaagataaatcttttaaaaataattcataatcaaagattctaaagtttaacctcaccctagtaaaacgacaagtattatcagcctggaggaagtacttattattttctaaattaaatataacagttttggattaaaagaagagtgaatgtcaattacaacttggtaagtaatgattttaaatttcaaaattaatttaatagaataataaactgagagtcctaaatgggaacatatacaaccccatatttattgattccagaatcatttctaaattatagcagactagcttgaacttaccatgtaaataaagtttcaactcgctaattactaattttgaatttgataattaaattgatataaaaagcactaagttgagagtacatgatggttagtacaacatatttactgatttcgaatttttagaattattatatattgggaaaaaaaaagtccatgttatctctaattgtaaactccgtctatcccataatataaggcatgatcaaactcggtctctaaaactaatttttagcttatagtttctcatatactacaggtttacagtaattaacaaaattataaccatatgaaactaaatttaaatgtcaatccaatgatattatttttagcaaataaaatttaattcatattgtactaattgttggtcaaatgttttaagagttgaatcttagtgtgtgccttatattatgagatggatggagtattttatctaacacggattctggatacaaactagtactagttagatcatttttaacttaacacgaaagattactcagattgcacaattaggtttagttattatataatacaatgaagtttaaagagtaatatgtaaaaaactataacgataaaggtggggtgacatattcactatcacctgtcactattagaatttttttcaaaggagtatagaaagctagaaagttcatgatacttaatggtatatgttttatttaattactacgaatacaatttatagttgtgattatatgatccatataatcaatggccgaataatgttcttggtgggaactccctcaaattgtccaattactaaacggacggatattaattcctggttagcgtgggagctttttcaaagtgtctccaattactatagtactccctccttccctaaatgttagacgccgttgatttttttaaacatgtttgaccgttcgtcttattccaaaacttttgtgaaatgtgcaaaactatacgtataaaaaaagtatatttaacaataaatcaaatgataggaaaagaattaataattacttaaattttttgaataagacgaacggtcaaacattttgggatggagggagcatatatcatcaccggtttaatccatcaaaaaagtttacaacatagtcgacgctcgacggtcttgatatcgtctgacatacatctctatatatgtatccatgtgacatcgagctcaggtagctgtatataagtagccagcactgcgccctttctatcgatacaacaagctatagtgaacggcaacaacgtatacacacacagagagattttcagccatcaaaagcacacacgcaccaaaaatacacaacattctagtactacacatatgatgatgaagcagggaggaggaaattgcaacggcggcggcgcggctggcgggagggccacggccacggcggcgctgctggtgtcgctgctgctcgtcgtcgcagcatcgcagccgcacgccggcgtcgcggcggcccgcctcctcgcgccgcagccgccggtgctggcgacggcggcggcccagtcgtcgtccccgctggcgacgtctgcagccggcagcagcaaatcatgcccgagtaactgcaccaataaccccaacaatccttccggttgtgtttgcccagcaccgccggcataacgagctgagaaatccacctacgtacacaacaaattgctgcagaatgtaccaagtcgcttcgatcgagttgttaattaattaatttgttttacagaagtagccgagaccgcgagacgagtgtatatatgcacacgttactaataaattgtttgtcatgagattctcatgcatgaataatgtagaaacctagctccgattctagctaggattaagccaatataattaaagttgcatttctgattgttttaggaataaaggctattatagagtatctgcagtttgtatatctttaatttcatttgtgtagctttgtcgctggagtggtttcttcgtttgtacacatactgcttacagagctatatatattttcaaaaagtctgtcacgaggtgtactaattctgcgtggttaattcgttcatcttaccatctagagaccccgagtttattattctgtcaccgagaaaagtaattccaatatgtaccacccactactactaggatgaaaacggatcgaatacggtcggaaactagctctatcatatttgttttcatattttttttcggaatcggtatcggaattggaaacccggatatgaaaacggaatcgaatattatcgaatacaaatacggagcaaatacgaagcgaaacaaatacggtgacggatattaatcggaatataaaaaaccctcaaactaagcatcacaagtcaacgaacaaatataactcgttatttttttaataggacatcagccatgttagtcgttcacccttaaacgacagtcacaactcaaaattgccctccagaaaattaatcctatgacctccatttcctgcgcttgtgtttgttcagaccggatcgagatgtttgcacggtcgccggtgtccactccactggtctgcaatatagctgcaggtgtgccactaccggcgggctgcaacctccgccagcttgcccggatcgaagccctagtgctccgtcgtcctcgtgctcctcgtcttcctcgtctcttccaggcgctacagcagcagcgccatggtccagttcgtcctatggggcgccttcgcggtgtcctacccgctcgccgccggcctcatgcggcggcgccggaggctgtggcgggcgaggaggcggcgccgacgaagaggcggcggctgtggtgatgggagacgagacggcggcggcagcgaaggggcgaggcagcggtgggcagtggcggcggccgcctagatgcgtgggggatttgggaggcagcggctgttgtgttgcctgttgctagctagctaggtttagttgaaactttacataacacagtacacacatagttgggttgggttgggctccttgggctgattcatatgaatggctgatgcagtactccggatatccgaaaaaaaatcccggatagtttccgaccattttccgattccgtcggatatcacccttactgtattcgttttcgtatccgagaaaaaaaatccgaattcgtttccgaatccgagaaattccggacagttccgaccgaatttttccgaatcctaaaattggtccggacggacggaaactatccgaaccagtttcatccctaactactacacaataggatgtcctcacatatatggcaattagatctacaagcggtgcatacacttgtccagatacatggtaaaaaaaggttttttttaatagagggtgtaagacattttcagtccacatactgagcctcatagaaggctaaaatttaaaaccggcacatataaaagaaattatattaccaccttacaatttgcatgtcttcttttttctttaaaaaccaacacatatgtgatattatatgtactggttcttaaacacatacttcctccgtcccaaaaaaagacaaatccttggttttcgtgtccaacatttgactgtccgttttatatgaaatttttttataattagtattttcattgttattagatgataaaacatgattaatactttatgcgtgacttatctttttaatttttttcatatttttttcaaataatacgggcggttaaacgttggacacggaaacccagggtttgtcttttttttttggaacggagggagtatactattacatgatatgtaccggtttagaaaaaactgggaaaagaaatcgagccgagatgggaccttttaatcaagcggaggctatagtctctagaactccagataagtccatatcaatctcctccatcacacacacacacacactctctctctctctctctcatacacacacacattctctccctccttgcctcctacctgtcctcgctcgcatcttcgcactctccccctactcaccacctcccactccgcctacaacacgcgactacctcatcttcatcttcaatgcactcctcgtcctcttcccggaccacccgacacgccacctctttcattggctggatccatttgtagctactagtgcatcaagaatcttgagggttgctggatccaggttttgtgaggtcgatggccgccgcatcggtcgaattcaagctcgtgacagctagatccttcatcgtgcaagcttgagggttgctccatggcgacgccgagtgtaggcagctagcgggaggcacataaacccacatcagcttatttggagtggaaattaaatcatgaattacccactatggtacaacttcaatttaattatcatgttacatcctcaatgaggccatcagattatatctatacatttaacgtctttgcaatattctttgtcataatttatagataaagtttatatataaatcataatttatatcataaattgttaccacattttcacaactctctagatgacacgaagagagcgaggggacatacagtagtccaaagcgttgttatatatggcatactcgcgcggttgtaatctatcagtctcctaattgattccataagaaatatcatagttagatttttcaacatacataacagaagagagacattttatcggtcaatgttgaaaatgagaatcaacgttcaatcggatggagtacgtatcacctgtcgctaattttcgtttggaacaataataatcaattaatgctgaacattctttgtttgagtcatgttgacgcgaccggctgatcatcagtccacatgtgttttcttcgtctgcgaagcgacgcttaaagccggcgccatctgctagtcgtccaaactcgaaacgatcgatcgttgactaaccaagagtgactttcttctgggtaatatgtactccatccgtttctaaatatttgcgccgttaacttttttaaatatgtttaaccgttcgtcttattcaaaaaatttaaagtaattattaactatttttctatcatttaattcattgttaaatatacttatataaatacatatggttaaatatacttatataaatacatatagttttacatatttcataaaagtttttaataaaacaaacggtcaaacatgtgctagaaaattaacggtgtcaaatatttagaaacggagggagtactacgtaataagtgacccagcacaacgtttaatttagtcgtgcgtgtacttcgtcgttttttgcttacgtaattacgatgtaatcagcaattcagcatgtgctgcctgaccgatctttgctatagttaactctgaataatgtattgttgtaaatgcacatattctgcatgcatgcaacgccgctggtatatgaaaatgtgaattagtcattctatttaaagtcaatttttaattctactttttatataggttaaattttaattaatttatatatttatagagtgatatatcatatatttatctatattttttagaaaaaatatgtttctgtagacgacttgtaaacaaggggaggtttcctcgagggacgaattgcacactttttaaaaaaagaattggccatgccctcataatatatatggtttcaacatttttcaccactctctcttgatgtcatgaacaaaacgagtatgtattgcgtactcgctcgtttctcatccgtcctaattgatttcaaaagaaggatcttagaacattacattaatatatggagtatactaaacgttacattaataaaagtaatatgcaaaattgaaagatctcatgtatatacagagagttagatttgccaacatccaaaatagaaaaaagaagacaaaaatattattgatcaatgttgaacacatgagagtcagcgtttgtcactcgcagacaatccgatggagtactacgtcctagtacaatgaatctaacaaagtgtcacatcaactctcaggccccctttgattcaaaagaaattcataggaattttagaggatttcattcctataggaatttttcctacaaagccctttgaatcaaaggaatgaaccctatggaataatatgaaattcttatggaatgcctcttcccatacaagttttggaagaattttaacaagaggtagaacctcatgaaagaaatcctttgagtttttatctctcctcaaattcctgtatttttcctgtggtccaatcaaacggtcattcctatatttttcctgtgttttgcaatcctctgttttacacttatattccagtcagaatcctatgtttttccaattcctccgttttttcattcctgtgattcaaatggcccttaggttggctttttttgacggagggagtatctcctgtcgctaattttcgtttggaataataatcaacgaattaatgctgaacgtccattcgtttttctcactcgtttgacacgactagctgatcatcactgtggccacgtgttatatatgttcatcggtgatgcgacactcaaagccggccgtctcctagtcgtcgaaactactggtcttcctcgttgactacaatatgaccaagagagtttacttccgggttatatatatgtacatgccaaattaccagcacaatatatgttcatttttgcttacgtaatagtattgatgtaatcagcaattcgatcagcatgcaagctggcccggccggtcttaatttgctagttaaatctgaatattactacaatgtactataaatgcacatatattaattcttcagtgcatgcaacgacgcaggtatatatgtaggaacggaagtgtgaattgaactatgtgttttattcagagccaaatttattatttttaactctattaatgttggttaaattttggagtgatatattacacattgatttaatttttttcaatttttaaataattttaagaggacatgaaaaacgagggggagacgttctcgaggggcaaatttaagagactttcgcatgcatgcatttatgtctacaactagctgggtttttctatctgaaaacgtgtgatgactggagttgtggactaccggtcgatctcactagctttcgatggtcggtcggttcatacttgttgggtgcattaatcgtatcctccaagaataacgtagtagctgcaggaaacgattgttttattgctgccctaagttgaacaatattcccagaaaattcccagttaattcctcgatcaatctcgcatatatgcgtgcgtgcatgtagctaggcagctgccagtatataaacacctccgtgctttcatgtttgagctcatcgaatccacacaggcaatatagagatctctatctccctcgatcgatcgatcacctgtattaactatatattaatccagctataactaattagctgcagtctcctgcacgtacacgtcggcagcgatggcaagatcgtcggcggtgatgagggtgatcatggcggcactcgccgtggcggcgatcatcctctcggcgacgctgcacgaggcggcggcggccaggccggtgcacggctggaacccacaggcgaagggagcggcggcggcggcgacgactcggcacggcggcttcgccgccgttcagctcgccggctctgtcccgtcctgctgcaccaacggcggcggcgccgggaattgcccaccgggtgtcacgtgcccgtaagtccggccggccggccgacacggccgccgtagctggaggagatgatcgagttatgcaatgcaagctgcggaatctgcagagtacagggggattaatattaagcacacgcttcaattgattttttaattttgttcgtcaggttcgaataaattggccaggccgtatataagttacaacggcattacagatttactaaagttcattggttcatcaacaatgatcattttgtatcatatgtatcgatcgatgtcatgacattaattagaagcattgattaattcttcggtatggatggatagatgtgtcatgtaagtatatatgctttgaattaatactctatgcaacaagcttgttgtgtacactctgtgcatgccaactaacaaattttacagaaaattctaaaaaaaatggacacatatatgtgtcaaatcttatcttcaaatccattataacaaaaaaaattctaacaaatttttactcttaaacctgttagattttttttcacttttctggtacggttaaaatataatgaatttaaatataagactttccaaataagtttaatactattaggagcagatgtccacttttttatataatttttcgtgatatttactagtgtgcacggaaatattgtgtgcataggatatgttctcatacatatacattgtctttctcaaactatgaaagcagcgtctctgaaaccagtggctgattctttgttgatcaaatttcactcctatcatcgtcggcgaactaacgggaaaaatcaaatatcccctcatttttttacatgttacttaaaagacataaaaaaattagtaggttagatcaatatgtcatatgtctcttcacaaatatgcaaattcaaattcaacttatacaagtaaaaacaaaaataataaatttaattatggatagaacgcgtaattaatggtcaaatttgtttttttttttgaattgtataagtcgaattttaactcgcatctttacgaaaagatatatcatatattgatctatcttgataatttttttaaatttttaataactttttagacgacacgcacaaaacgagaggatgtcccctagagggacaaaaatccacttccgaactaatgtcaaactaaagcggaagaaaacattgggagttagctgaattgtagaacagacattctcctggaacttaccaccataattaccattgaacccgatccgacaaggaggctgtcacaaggacattgcactaatagagaacctccatattaattcgacgacttcaaaaaaaattacgatattttgaatgttcatcatcgctattccggacatccaaaacaaggttttctcctcttgatggttcacccataggacagatgagagaagggacgtcaccacgccggtatatcatgtctaggaaggtgtatgatactcacaggtatcaccgatgttagtactcagatcaaacagaagcacaggtgcgacgacaaaggccgaccgactcaacgtatcctaactgattggacggtctatttatttggccgtcaaatgggttgtaattatgcatacctgctgcatcaggtttcatccaatcactaaacatttcagtatttgcgtgatctagactggtcacatatgcacgcaattgcatcaaaaaagaaaaatctagatgcatgcatgtgctacaaaagtaaattaccagtgccatgcttgttaataattagtaccacaggttgaattgctaacccctccgtcaagtacgttgcttataggcagaaacacatccattaatccatcgaaattaaactataaatagccatgcatgcgaggttagattaccacactggtggagaaaccctttgtagtcccggttccgtaacccccctttagtcccggtttctaaaccgggagtaccaatccaggactaaagatcgctatctttagtcccgggtgaaataaccgggagtaaagatcgatctttagtcccggttggtaacaccaaccgggactgccggctgagtcatctttagtcccagttggtgttaccaaccgggactaaagatcgagctgaccgttttttttttttgcatggccctgttgctgcatggtttatatatatatatatataacccatgcatatatatgtttcaatacatatatatgcatacatatatatatatgtatatatatatatattatattatattatatgtatatacatgcataatatatatgtatttatacatatatatatatgttatgcaaatgcatatgtatatagatatatatatatgaccaaaatatatttacattatagaaaatgtgtacacatgcatatagaaacatatgtagtcatgtattaattacaatccattatatgtcatagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacataatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttaggaagttcgtacgggaatgaaatttggtatgtaggaagacagtaaaattaaactaactctgtgttgtatagcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcatgatagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54038 - DNA, 719 bp, Oryza sativa
tctcctcttgatggttcacccataggacagatgagagaaaggacgtcaccacgccggtatatcatgtctaggaaggtgtatgatactcacaggtatcaccgatgttagtactcagatcaaacagaagcacaggtgcgacgacaaaggccgaccgactcaacgtatcctaactgattggacggtctatttatttggccgtcaaatgggttgtaattatgcatacctgctgcatcaggtttcatccaatcactaaacatttcagtatttgcgtgatctagactggtcacatatgcacgcaattgcatcaaaaaagaaaaatctagatgcatgcatgtgctacaaaagtaaattaccagtgccatgcttgttaataattagtaccacaggttgaattgctaacccctccgtcaagtacgttgcttataggcagaaacacatccattaatccatcgaaattaaactataaatagccatgcatgcgaggttagattaccacactggtggagaaaccctttgtagtcccggttcgtaacccccctttagtcccggtttctaaaccgggagtaccaatccaggactaaagatcgctatctttagtcccgggtgaaataaccgggactaaagatcgagctgaccgttttttttttttgcatggccctgttgctgcatggtttatatatatatatatataaaccatgcatatatatgtttcaatacat

SEQ ID NO: 54039 - DNA, 2607 bp, Oryza sativa
  unsure (1)..(2607): unsure at all n locations
tatttaacggtcnattttgtaagctggcagggggcgagcttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattatcagatggctgctcaatattccttttacccctatgttctttgttatctttccaggctatgtttgaaattgctgtaggatgaccatctttgtccagtttggcatcacctttgtagtcagcatgtatccgtctgtcggctcttatgtcattgtcatctgctctattgtccgtctttacatcagtctcaactttattgctcggaaattcaaccctgggatcactgtagacatctcgagtgtcagcctttgcctcccgaacatctaccttagtgtcccatggatctttattttgctttgattctaatctgccatcagatgagattgagtggtccacaaagttggaggggccaataggcatcctatgtgccagagagggcctcttatcatcccggggctcaatacgttgaactttggcaaatctcccatcatgttcaaacgaaccatggaaatcactgctgcctggttgaataattttcccagaagggcttgagtacaagctgctgtcatccaacggccgttttgccggtgtggagtgactaccctcctcatgcgacctcttgggtgcaccactcattttccctcaaaaatgtcaacagtccttcaatatgaaccaagaaacacaaatacaaaaggatatagcccaatgcctttgacacaatgcactgccaaaaaaaaatgaaaatttaggtcagaacacatcagttactttcttttttccacataaccagattgtgtaatttagagtaagacatgatgtataaggtatttcaccaacaacaagaacatttaagggtgcttatgggcacatctaaaataaccccctacaacctcatgtgcagtaataaaaaatctggaacaatttagtagtaaagagcatgttggcatctaacaatccacaaaacgtcaatctaaattcaatccaaacaacaagaaacaaaaaggaaggtgttctgctaaaaagaatctcctttgtttcttgacatcttgatgcagtttggatatgaaaatttgtggcgtagaagatgccaacatgccctatcttactgttctttttcacataatctatcatcactatttgcatggtttttaagggctggaagcacccttggggagtaaccgatacaccgcattccatattgacctcagtactctgttcctagttcaccaaacaagattcagctgtatattgcaccaagctccctgttatcgactaagctactgttatactgtagtccatcagaatgagggaaaatcttcaagtttgtaaatgttcaattctacaggaagataagtcatgaaaaaatgatttgaatgtattctcaaacaaattacgtgcagccccctcgtcaatttccatgccagcccagcaccctcctctctcagctacatcatgtcttgccatttttgcggtgtccagccggactggtacaacaggaacagggtggaatcggcacccaacagaattaaagatcatttctttacccccaatttcattttttttatcaagagaatggcgtagctttcactagttcaaacgaaggagtggcggatctaacatgggacatgggggttcacttcagttgaacccccaaacccaaacctcttttttttaaaaaaaaaaaaagaaaaaccaaacctttttgggaaccatcaaactgttattagtgttaagggttagggaaaatttctagaacagaagcggtttgacgcaaattcgagaaaaaaaagtgcgtgggtaaagagagagatgggaaagaggatgtggttcctcaccaggatggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 54040 - DNA, 1166 bp, Oryza sativa
  unsure (1)..(1166): unsure at all n locations
ttggattcgctgcgtgaaaaaaccttgagcaaaatatatatgagccaaatttatccaaacatcaggcatctggacaaatatacttcctgaagcagcttcatgtacctaattcatttcaaattgctaatgtaaatttctcataattcacagtaatcatatagaatgatgaatagtagtctcccctgacctgtgtaaataactccttggcaatatcccattgggctttctcagcatataagatcccaataccatttgcagcaaacatattaccatggtgctgctttagtacctgcatcagacattgagatctcaaaagtgagcaaaacaagcacttaatgcggccacactatccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaagggtatatatttggcaccgcccgggccgaccggattgtggaatcccctctgtcaatgcgacctgttgtgtgttaaatataaggcttnccgtgagacattaaccggngggtgcataatatggggatgaaaaactgtgcgcctgtatgaaccacccatatttggcaatgggcccggtgtttccctttttcggggagaaaaatggctgtttttctatcaccccccgagatatacatttaaaacacccccctttccccctgtggtttgtgagaaaattaaatataaagccctccaatgggggaataggaacccccccttctttagggggcctttaataaacgcgccggggtgttggtggtgttatcctcaccaagtggacccttttaaatttttgtacggcccctatatgccccgcttcttttttggtttttttttcctttctttttttttgtcaccagatgccggcgttttttcctgccaaagaatttaaaaataggggggcctccctcttatggttcc

SEQ ID NO: 54041 - DNA, 4712 bp, Oryza sativa
  unsure (1)..(4712): unsure at all n locations
tatgtgcnngaatagaatctctctgtgtgtcagccgcggactcgccggtggtgagcggcgggtgaaaacccagctcggccttagccggaccgacaacgatggttcattccccctcctgagggcgttatcgtgttgtctcatcccttaagagtggttgccgggtgaaagcccagtcttgggctcttttgagcccccgacggacggcggcggcagttttccatcgcttctctccttggagacgtcgtttagacatccccttgctgaaaccactcaaacgattggtgcaagcacactctagatagagttaggctttgtgttggttgtgggcgttttttgggcaatctcgtctatgttcctttgttggtctagcggcggtcggtcacgctttgcgggggccggtccggtactagccttctcctagacctgtgtgttggcgttgtcggtgtatgggttgggggatatttttttttcttttttcctggtacgaccttccagggtcttgtaatttttttcctgctctatcagtaaaacttcgcaccgtctcatgcgagtccgtcaaaaaaaagtatacaaggcattggtatagtataatggactaagcatgatgaagttatattatagttaattgaaagtttagaaaacctatgaaattttttaagattgtcggagatatgggcccgggggtatgcgaagtgaggggaatctacattcccatcctgccacgtgtccctacagcctggtcctacccccgcattccacgagtcgcaggagcggccggaggggggaggggggcctcggggtgccgcgtcatgcccctcgggcccttgcaccgctttgccccaaggccctcgcccagccgccatttggcggggggagcaagtgaggacgaggcccaggctgaacctccttttaagcgcgcagcgccccaactgctccctgtcgaatttaatgcagtggggcagacgtgcggcgtgcccgactggcgcgtgatggtcaagaatgaccggtctgtgaccggcctgacgccggtcacgtctgactagacagacaaccgtgctcccacgtcgcatctgcctccggcggagtggaggtaggtatgacccgtcccatcggagggtcattcggagggcggccaccacaagtcttcacccattaatgagggaatgacaggactgtcccccatgttaggcgagagacggcgctgggccccgctcaaggataagctgtggtttagctttcaagcaaaggcacaggtcgagttccggtcaaggtagggtgggtccccatccgagagaagagtaggtagaggcggtgcatgtggtatcccttgaggtataaaaggaggaccttgctcatcgagaaaggggatgactctcggaaaacctgagctcgaggaggagggaactaagtgtgttctccggagtttaggaacccttgtaactctcagtctaaatcccatacacaggagtagggtattatgcttcatagcggcccgaacctgtataatttggttgtgtgcgagctagctaggagccttggggacggatacgtgatttctagaggcaagctttttcccctggccgaactcactaaagggggggtctcacgatctcccgctagagaggatcactcctcgacagctggcgcgctaggtagggggaagtcgcgcgctttaaagagaagtcgttttcttctgccccaagtttccctcggccctcgacgatgatggtcgaggtcctggaggaggaggcggtggtgtacacccctactccgcctgggagtgaggatgctagcgagagccgcggccctcgtcaccgccgccgcaactctccaactcctccccgccgcgatccctcgcggagggaggaccccacccagtcgggtggttcggccctctccccgcccccgggcggagggaggccacgacgcgtcagggcacggcgccgcctcacttacggtgacggcggctcgcctcgaggcgcacttcaggcagcgggtgcccttctggggcatccccccgtgaactcggagccggagacccctgtccagcgctggttggacgacgtggccaacttggtcaccactgcccaacgggagctggccgcgggcagccgacccgtcgtcaccggtacgtcgcgtacccccattaccctctcctcgtcagcgaggaagagggcctgtcgatcggccacggcctcaaggcggtccacggctccaacatcgtcggaggcctcgggaagccggaggcgtcacgatggcctctacggggagcaggacgctcgaatcaacatcgagcgacgccgggacgagcgtcgagctgctcgcatgggggaaggcgcctcctcatctggagtgctgcgttcctcctcacgaggcggccctcctcccacgctcacccctagagggactagttgtagggccttcgtggcgagtctccggaatgtttggtggcccccgaagtttcgccccaacctcacggagaagtatgatggcagcatcaatccctccgagttcctccagatctacaccacgattatcgtggcagtagggggcgacgaccgggtcatggcgaattacttccccatggccctcaagggtcaggcgcggctggctgatgacctagccccccgactccatcaactcctgggttgtcccccggatggtcattcggagggcggccaccacaagtcttcacccattaatgagggaatgacaggattgtcccccgtgtcaggcgagggacggcgctgggccctgctcaaggacaagctgtggtttagcttccaggcgaaggcacgggtcgagttccggtcaaggtagggtgggtccccatccgagagaagagtaagtagaggcggtgcatgtggtatccccttgaggtataaaaggaggaccttgcccaccgagaaaggggacgactctcagaaaacctgagctcgaggaggagggaactaagagtgttctccggagtttaggaacccttgtaactctcagtctaaatcccatacacaggaatagggtattacgctttatagtggcccgaacctgtataatttggttgtgtgcgagctagctaggagccttagggacggatacgtgatttctagaggcgagctttttgccccggccgaactcacgaaaggggggtctcacgatctcccgctagagaggatcactcctcgacaaagatagtttatggaaaaagtatgaattaccccctgaagtatcgtggtcgaccaaatcaccccactaaactcgaaaccagacattgctcaccctgaactttcaataccggataaattaccccctcgaccgaatccagagtggttttgtcccatgtggcgtacacgtggcaatccagtcagcattttatttttttaaaaaattatggggcccacctatcatacctctcttctcctcttcctcttcctctctctcgggctcaaagcgtgcacggcgcagggacgggcggcggcgcgctggggcggacgggcagtcggcttgcgggggcgatgggtggcggcgtgctagggcggacgggcggtcggagcgcgggggccgacggtgggcaacgggcgatggcgtgctgaggcggacgggctggcgacgcgcggggagggcgcagcggacaacaggcggtgccaaggagggcgttggaggcgacgggctacggcgacaagtccatcatcccctcgagctccgcagctatggcgacgaggcgatgagtcctcggctcaggccggcaccgtcgaggtcatccttccaggcagaggtggcagtgctgctaagacgacatgaggtagcccttgtcgtcatcgtccttttggatctcaaagtctgggaggaaggaggagagaggtgtggagcctcttccccggttccgacagggagtcggcatgatccacggcctccctctctctctctttctcggctcaggcaggcggcgggcgatgaatcctcctcggggagggcgtggcaagcggcacgcgtggcggggagggcacggtgctctacgacaatgagttcgccgcccatccacatcgtccccatcgactgtcgtcgctgtcaatcggagccacacacccgcgccaacgatttcccctccctggccgtcgtgcccgccgctgctcgccttcggccggagtgacctagccatgcgcactgccactcgccacccagctccgtcctatgcctccgcgtctcgcgctgccgcgtaccgcatacccccgcgcgccaccggcacgccatgcgcgcgcgagagagaagacagaggaagaggggaagaggatgtatgacatgtgggtctcactattattttaaaataaaatgctaactggattgccacgcgtataaaacagcttagattcggtcgagaggggtaatttgtccgatattaaaaatttatggtgagcaatgtctgattttctatttaggggatagtttaagtcaaccccgatagttcggggtaattccatactttttttttcctcttttttaacgagtttactcctgtgactctcatgacgtttggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54042 - DNA, 2993 bp, Oryza sativa
  unsure (1)..(2993): unsure at all n locations
ngtgagagaagaggcccatataaagagccgaggcccaccccacgaaagagcaaaatcgcttataatgagattggccgcaccagagaagccccccacatataaaattttttgagccgcgaggccgcgaaacacccttatgatggtaacccatggaggcgccacggtatttaataattaaggagaatatcgccggacgcgccgacaaagaaaataataaaataacgagagcgaggcggacccaaaaggggtgtaaaaagatatggtcccgaacgagggaacatacacaaaacggcgagggaataacgaaacagaaatagaagggtctataccctcaaaaggacgaaacaatgattgtgtccgcgagacacagagaaagaggttttgaaatacaattttacagagggaaaaaacaacctatttttccgagaaaaaaaaacaaccactgaccaaaacgggggaaaagatgaccaattttaccccgaataggcacccaggggaagaacacccgatttttaattgagcgaatagagagatgatcaagaggacaacatacttgtcaaaagatggaataaaagaaatagtgagacagcaaataaaagaacgggaaccccaaattaaggtgtacccttaaaatacgaagttagaagcaagagaaatatttggaaagaccgtcgcggtaggggccatattcgcagaaaaataatctgccacaaggaacatttctacaagcccagaaatttaaagaccccaggggttaaacatatccagacggaaagaaaaacgacagtcaaccgaaaacaaactcccacaggggcaaatatgatccaaaaaagacgagaaagaacggaaccaggtggcataaatgagaacggccaaacatgtgctaaaaaatcaatggcgtcaaacatttcgaaacggagggagtattatggtatttgttatttgtaccatattgcccttcaggatgtctcgtagtctaagagtaactagtacaatttctctaggcttgcattgctggaaggaatcatgtttcaaaggagaatagcacacatgttaagaatttatcaagataaattatccttttgtcctctttggattatcatctaacatttgtttcaattgccagcaagagtaaccattttaaaggaatgccgtttcgtcatgtcatcaaaaactttgtaattcaagggggtgatttcgatttcaatggtgctgcccaggaatggatactgaaagccaaagccagtggagaaaacgctctaaggtttgtccccaaatcaatgcacatatagaattctgttgaaaagtcttggttttgccagacttattttttttctttacactacgtgtatttctatgattttgcagtccaaagcacgaggcattcatgatcgggactacgaagaatcctaataataaaggatttgatctttttatcacaactgctccaattcctgacttgaatgacaagcttgttgtatttgggcaagttatcaatggacaagatattgttcaggtactttacattgaattctctctggatgcattaattcagttgcagtttccatacatcattggaacctttcatttttcatttatatttaatatcatttttctaaaaacaatatatttcatgctgagatgttcatgtccttacctcatgattagtattgttacatatttgtacattattttgagttacagtagtgctaatgccaataggaaattgaaagagttagacatgagtttaataggtgtgctaatggagaggatatgagctaattcaatgtcattatctacaaatgtatcagacgcatgtgcttcaactggttgaattagtattttctgagtatgttcattttaatgagactttttgcttgtttgatgacttaaacaggagatcgaagaagttgatactgatgagcattaccagccaaaaacccctatcggcatactcaacatcacgctaaaacagcaagctttgagctgatagcttgttgtccttacctgaaaatgacttatctgtactccaagagggtccatacatcgcctccaattgctgctgaaattgattatgattatggcttcctctagaagcccatgggttgcaaagaaagaaggcgcttaatcttgcctggcagctaaaagcttcttccgtctcatggagtagttgtgtataaatttatccctggtgtcattcggctgtcagtttttgcaggcattacagtgtattttgatgcttggttgtttcattgtaaatttgaagcccatttggatcatgaatcatagaacttggaattcatagttagttatgaggaataagttcaattgagggccctttaactttacaccgaatccgattttcgtccctcgatcagaaaaccagacacaacgggtcccttaactattaaaaacggtgcaaattatgttccttagcggttttgagagcagttttggctgacgtggcgcctacgtgggttaattgactcggtctttggttgacggggcattgacatggcgcttacatggcaattcgaccggaaaaaatataaaaaccggggacccacatgtcaatcttacatagaaaataattaaaaaatttgtgggaaccctgttggcccccacttgtaaatccaaactcacctttcctcttttttctctcttcttttcccaattccctcttttttaatattttttccccttctcccttttttttttcccggcaagagcgggcaaaccttggaagagggcgggtggaacccggtcccccacccggccaaagacaataaactttgaaggaggaaaccgcgggcatttaaaagggaggggaggttattttggaggccgcccatgggcccaccctctgggcgggggcttttttactctaaacggggggaaaggggtcaccccccccgcgcccagggaaaagagagtgtgaccgccttcctcaaaaccgcttctcaacggatttgtaaatatcccccgggaggggg

SEQ ID NO: 54043 - DNA, 4160 bp, Oryza sativa
  unsure (1)..(4160): unsure at all n locations
gatgttcnttaggtgaccatcgatggccgccggaggaggaggagatgcaaccatgcggggaggtgtggcggtggcagccggaagaggaggacgtccgacgtgcgctgctccccccgctagtggcggcggcgcgggggcctgggagtcgccaaggatgccgaggtcgacattgatgtcgtccgcagccacggccatggcgtccccgtccgcatccggcgtgcgccacagaagcggcggcatggggagcggcgcctcagctgttgcggcggcgacgtcaatggggggaaggggaaggggaagctcctcgctccggtgggctgccgctgacaagctcggtggtggtgaaatgcgacggatcgagtgccatcctggcggctgggggctcttctccgacctctgctccagaccgccgccttcgtcctcttcacccatcgccagctgtcgtcctcctcactccggtgggcggtcgctgacaagctcggtggtggaggcgggttgcggcggagggcggtcgccgctccctctcccactggccgccgtcggctgcacacctctccctccgtctgtcgctatcaagcccccgcccacggcgctcggccatcgccggcctccctacatcctccctcccttttattgccccggcttcctcctccagctcgctgctctcgccggtgggcgccggtctcaccgccccctccagctcgccgctctcgccggaagaagagaggagaggggagagagatgaagagagggagatggggagagaggaggaagaagaggaagggtgagtttgactgacatgtggggcccacaatttttttttattattttctatatgagactgacatgtgggtcccacgggttttattatttttccgggtcgaattgccacataagcgccacgtcaatgccacgtcggacgaagaccgagtcaaattagccacgtagacgtcacgtcagccaaaaccgccctcaaaaccgccgagggacctaatctgcaccggttttgatagttgagggacccgttgtgtctggttttccgatcgggggacgaaaatcggattcggtgtaaagttaagggacctcagatgtacttattccaaaaaaaaagtgagaaaatggacatttggccatgtttaaaacgcgcggtttgctggaatgccatcccaaaaacatgtttctttaaaatgccactatgaaacacgtgctcaccgtcgctttgacattttgaccattttgggcattttgaaaatcatttttgctggaatgtagggtgatgagacggaattgccctcaccggcgtcttgagcaggcgggttcttgcctcgtgccggttgcggtggcgcagctcccaccgggagcccagctcgccgtcgtggtggcgtccgtcggcggccgccgctccgcagtcctctgctgcgagggcgcggctgctccggagccgtaccaccgcggcggatggagtgcggcggccatggaggtcgcgctcggcgggctcgtcgtcgctcgcccggcgatgaagcgcttaaggttcgattctcgaaacatctgcttcaactctttttttctgctgttcctttctgattctgcatcatcacggcttattgcaaacttctttgtccatcgatcgcagaacgaaataggctctcttcttttgagcctgcagattgctcttcttctgtatcttggttcttgtcccatggcgcagaacaaaaggctcttcttttcgtcttctcttcatcctgcatataggttcttgctggagaccttcctcttgtgcacatcattgttcttggctttgctgtagacggagccccaggccctcagcagctgcagttgcgcgcgcaccgcgcctcgcagtccgccgacggcgagtgctgaaacggcaggagctccttgttagccagctccacgagctgcctccgcacctcccagtacagcccgccgacctcgccgctcgtgcagccgccgccgccgacggcgcataccgagccgtccgtcgtgttggccaggcactcgcaccaggcgccactctggatttggaggttggaggtgttgaggagcacaagagtgggaatgaggatgcgaggtggagcacggcgaggtcgagcatggtggagttgacgcggaggaagccgagggcgaaggcgctggcgagggcaattccatcttatgacccgacattccagcgaaaatgatttcaaaaatacataaagtggtcaaaatggcaaagtggcggtgagcacgtgttccatattgtcattttagcgaaacgtgttttcgggatggcattcgagcgaaaccgcttttgaacgtggccaaatgttcattttctcggaaaaagtacaccagaggtccctcaacttgtcattgagttacaaaaacgtcctcaaaccacaaaccacatatgaccccggatttgtccgacgtggcggctgagtcagcgtaggacccacgtggaccccacatgtcaggtgtccacgtcagcacctactcctctcccctcttctctttctccatttctctctttccttcctccctctcgctctttgctctcgcagggcatggggatgccggtgacgaaagatggtgcggctggcgacagcggctccccgggaggcgccgtgctgctcaccggtaacgtcatcgtctgggccggcacgtcggtcctcttcctctacgccggctaagtcctccttgtatgaacttcgcactggtgcaccaccgcatccgacaagtggatgacaccaagcaatcaacctcggacttcacggcacggctcctcntggatgagaacgcgtctcacggcctccactcccattttcntccaagcccactccgtgctaagaatgttcgcgtgccgcctcgtcgatctcctccactcgccactctacctcccgcgccgcctcaccatcctggacatcgcgtcgcaccggtggtcgaagcccaacgcggtggcctcggcgctcctctccccgctcctcctcgccgccgccaccgcacccaccacaaccgccctcctctccgccttgctcgccggcatcctcctcgccgctgccgttgcggtcgccacggacgctgcctctgttgagttgtgatccaaatttatttgcacttaataaaggccagcttctgctgtagcgaagcggaggcccattgccagaggcttgggccggagcccccgcggtacggatcgttatcccttttagggttccaccatatatatacctcttgtaagccgccatgcggcgttgaaacctcaccccgatatagtaaagatattttgctggctggcgcctgtgtttttctctctcatgctttgggagggtttttccacattaaatctcgtgtcttttgtgattgatctattgttctttattgtttatttgcccatcgtttcctaacaagtggtatcagagcttgttatcagattagggtttcgcgatggcatcgataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54044 - DNA, 1789 bp, Oryza sativa
  unsure (1)..(1789): unsure at all n locations
aaagagggggggcccgtgggtaaccctcacaaaaaattttttgggtcagggcctgtacccttatgggcccctaaggggccccctttaagctttggggggaacccgccaatgggccaaaaggaaggaaaaaacaaaagaaggggctatggccgtgcaaagttagggtccactgggggaaccccaccccccccgctttaatgcccgacacgggggggcccattgccattaagcctaactttaattttccaagaccccgggtaaagcggttttaggtcactttccgggtgtagatcaacccctttcttcccaatagggagccgggcactggccaattggtggtgtttcaggcgcgcgctttattccatatgggccccggggtaaaggtccggggaagctttattttcaaaccacgtgtccctggccaaggggattcactccggtggcccgggggtgccattatttccctttggacctcccccaaccgccgaatacggcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatgagactgcctgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaatcgcttatgtgaaacaaccggagatctccatcaccgcgacattgacctgaagaacccggtaacctaatgttctccgaaaatgaaaatggggcccgaatggcgaaagggaccccacctgcagcggctgattaaactacccccagtgtgagcgttaccctaagaggaccgctaaacttggacgcttcctaatgccccgttctttgctttctcaccttcctttttccccggaagcgttaatacccggcgaaccttagagggcggctctcgttatggcgcgcattaagccctaaagcactttccgcaaaagacttaattggggacggtcccgtatgaggccttccccccatgacgttttcgccttttcttaaaggccacttttataagggcactttccaacgtgagaccctanccttttggacggcttttgcctaaggcg

SEQ ID NO: 54045 - DNA, 17071 bp, Oryza sativa
  unsure (1)..(17071): unsure at all n locations
tgtggtnnnnnaatggtagccctctacctcccgcgccgcctcaccatcctggacatcgcgtcgcaccggtggtcgaagcccaacgcggtggcctcggcgctcctctccccgctcctcctcgccgccgccaccgcacccaccacaaccgccctcctctccgccttgctcgccggcatcctcctcgccgctgccgttgcggtcgccacggacgctgcctctgttgagttgtgatccaaatttatttgcacttaataaaggccagcttctgctgtagcgaagcggaggcccattgccagaggcttgggccggagcccccgcggtacggatcgttatcccttttagggttccaccatatatatacctcttgtaagccgccatgcggcgttgaaacctcaccccgatatagtaaagatattttgctggctggcgcctgtgtttttctctctcatgctttgggagggtttttccacattaaatctcgtgtcttttgtgattgatctattgttctttattgtttatttgcccatcgtttcctaacaagtggtatcagagcttgttatcagattagggtttcgcgatggcatcgataaagtatgatctactgctgctagactataagacgagattctcgctgtggcaagttaagatgcgggctgttctagcgtaatcttcggatcatgatgaagcgttggaaagcttcgggaagaggaagaaggatgaatggaccactgaggagaagcggaaagattgtaaggctctgtcgctgatccaacttcatctgtctaatgatattttgcaagaagtgttgcaggaaaaaactgttggagaactttgacttaaactagaatcgatctgcatgtctaaggatctaaccagtaagatgcatatgaagatgaaattgttcacgcacaagttgcaggagagtggttctgtgttgaaccacatatcggtcttcaaggaaatcgttgccgacctagtgtcgatggaggtacagtttgatgatgaagatttaggtcttctactgttatgctcactgcctagttcttatgcaaatttttgtgacaccatactattaagctgtgatgaactaacccttgtaaaagtttatgaggcactccaaaacagggagaagatgaaaaggtttggatcagtctgatgcgtcgtcctccaagggtgaagcattgcaagtcagaggcagatctgagcagagaacctacaacgacaacaataatcgtgacaaggagctggccgttggatgcgatgaaggaaagatcatgggtaattgccctcggtgcagagcagcagtgctcccccggcccttctcatccctccctatgcacaagggcgacgacactcccctgtcctccctagacggcaatggcagcagcctccatagacggcgagggtggcagtgctcccctatcctccggcatatgtaggcagtggtttgcaaagatgctggtgtgtgctctgctttcttggtttggttatgattgtatgtttttttatgaaattctcatcttctgttgtggtgaaaagcctttatggcttgattttgtttgcagcttcatctcttatgtctacaagatgtttggtcgtgttcctcaaattttgaaggtttttggccagcaaccgggcatactcgttcattttcctcaaaccttaaaggttctgggtcagccacaaacggatcagaagcaatatcagacttattttgcttcctgcgggaaccctgcgatctcttcacaatctggatgtgcgcatggaagaagggaatcggaagaaaatacatggtgttgagtttgatggatgaacgacatggatgcgagctcgacacggatagggacggcatacaaaattcttgggaaaacatcttagatttttataatgggtaaagaatatatatacaccaggtgatttcctgctttttcctacaggaattactaagcaattctcaatatatttttttcgacaatcaagctaggaataaaaaagaaaaaaaataaaacatcagggtttatcattacttattatgaaacaaacaaatgatacacacactttaatgtaaaacatattaataagttaaaatattgtgcaaatgatgtagggataattgttggatatgattgcatgttgatttgtaaaattaaataatttgtatatgatgttgtatgcttgcatgaggttatatatgtaattattgctagtgtgatgatgtggcatggttgcatgtggaggtttagacttagtgtgctataactttatataaagtatatatatatagggggaatatccagtgaaaacccgtgaaaactatatctaaattcacgaagaaattactagagataggtataggcatgaagtacatcaaatttgtcttttttgtttttctcaaatgaagttgagtttggacttgagatttgatatgaatgtatttcatgcctatacctatttttagtaatttattcatgaatttacaaaacttttagatatggttttcacgggttttcacttatttgatggtttttaccgtatgtgccccatagatatagatagatacccaatgtgtttagattaatgtcaagtatttattatttggtcctaacacaatcgaatgataaacaatattttctttttctccgattatggtggtaacttttatacctctaaagtaattacaatagcaccttttccctattagcatgcggcatacatgaagctgatttgatttttgggtgcatcttaagattttaactgttaggtactggagattcctagaaatattcaccatagagtacttagcagctgtggggcagagaatcttctgggtagtcaccaatctccaacaaaggctgtttttagtttcacattaaaattggaagtttgaagaaattagaacgatgtgacgaaaaagttgaaagtttaggtgtgtttagtttcacgccaaaattgaaagtttgactaaaattggaagtttatgtgtgtaggaaagttttaatgtgatggaaaagttagaaatttgaagaaaaagttgggaactagatcacctttgtgtgtgtaggaaagtttgatgcgatggaacagtgggaagtttgaagaaaaaaattagaaactaaacaaggccaaataaaaaaaatctagcatttgcgctctctatctctgaagccatcatatttactcccgtggaatcctatgttcaatgctactcccatttacacgtgcatgtcaatattttccttcatttgatgtggtgaatcggatacaaattctgcagctgctttaccgatttgaaacaatacaatccggtccatactccatacataacgacactcaaaattatttgacaaaaacatcttgaatttttataataagtaagaaaaaaaattggcgacaaagggatgacaaaaacactatgaatcttttaaatacgcaaagataaaagaaaaagaaaaacttatatataagtatattggactaattattttaccagagtttcacttttgcaatgtttttttacttataatgctagtcattgttactaatcttgtactgtgaaccatctctacatactcatctctctaactctctcttcttcgccttcgattcctaatggtcgttgttatcaccgctagcatgtcttgttgcttaagcttgagctatgcgtctgctcatcgcggagctcgagagcctctccttccttcagagctcgagatcaagatatgatggaaagctgggtttgtcacggtagaattttgtttttttttctttttgttggttgatctttttctttttctttgtctgaaattgtactttacatcatacctatcatacttatgttcaaaagtgtatttctaaatcatagcccttttttaataagccgtacggcttataactaacatatggccaatctatagggccgaattactatgatataaatgaaatgcaccacatgttcacgttgatcattaaaaacttttaggacatgtacaatgatgattaatagtggtctctcagcgttactaattaggaatatttgttaacatggaaaggagagacaaaatattgttgctataggtaacaataactcaacaacgattcttcacctctataatatggatacatggttacattagggtgaaaaaaagaaagaaagaagaatagtaaaaggaatatttttcagttaatggttagagcctttatcgtttcaactatcataaacacacggtctctaaataataaataatcttgtactccatatgtcctaaattataagacatattgacatactttgaccattaatttatttcatattatgttcctaacgaatatgaaaccagtgatataacatgcataatatttagcatagatatggttaatatgattattagttaaaagttatcgagtgtgatttttttaaaaactagcgcgtcgtataatttaggaagaatggagtattggctaagagattatacttgtctctactctctactattaaatatgccctgaagctgatgcataggaagctcagggagtgatgccacgttagatatctaacagtggaattttcttcttcatttacctctggccggtatttaaaaaaaagtaaaattcattctagtccacaaataaccaaagtggcatattggactaggggtgtatctctatttccacttagcaccactaatctttataatctgttatatgttggattatgtatctaggtttgttcatgtttgagccatgctgggtggtaatttccggtgagaccggccatcggtgctcggtgcatggtagctgggaagcagttgacacaagggctccctcgagcctcgaaggctcctacgccgtccatgctcctaaacacacccaattccacacatccaacaaaaacactctttcaagggaccgacccctccgcttgtggctgtggctggtgtgccgtggtgtgagcttggctatcgacatgcagataacactacgatatgtccaccatagtgtctccaccaaggccctcactatgttcacacaggtggtcatcacgcgttgtcatccgagcatctggccatgttgccagcattagggccaagggtctcggccaacgccacctcgatggcttatggagggtacttaatcaccgaggtcgctagttggttgtgcagatagctagacaagtagttcaaagctatcatatggtactcaatcttggagcatgctatccagggaaaaaacaatcttgagaaagtaaaacaaaagaacattagcatcatagcatcaacgctggcgttggagacgcgatcgtaccagacgatgatgtggtgcatgtcaccgatgacctcctggtatcgctctctggtgccaccacaagcaaaccaaagcgactagtaaattagacccaaaaatataacacaatgagtaaatcatatccaaatctataatacacaatgagtaaacatgatccaatctacaattaaaattagatgataacggcttgtttggtaactcgatggaagaggattgggagtttatacaagggaattaatgatgagattaagatggaaatttgatttttaatcctacggcctgtttggcaagagaagggaagaggaatgtgagtttgaaggaaggagttgatggtgggattggtcatgggagttacttttttagtccccatcccttgtttggtttcacatcgaattccctctaagtctcacgaattaacaggcctcccccaggtaagagattggtgggaattggaccccttaattccccatcccaaaccccctcaaattcctaagttttccaaccaaactacagacttaaactcccatatatcataaactcccattccccatcaccaactccctccaaccaaacagaccgccaatatcttgtttgatagagatgatggaaattgatagggagtttagttggatgttaggtcattaataaaaacggatggctaagatttgcttagataaagtaaaggaggaattccctcccagttacctgcccctacgcaagaattaaaaaggagggagttccttcctcaattgcccatcccatcccaccaaaattcccatgtcttccaaccaaacaaaacacttaatagcatcattcctctaaactcccaatccctcctagaaactttctccaactagaagtgaaatgagagacctagcactagtccaatataccactttggttattgaacaaagtgaaatttacttaaattttcttcaaaaataaatccccacctaaacccgcgtcgcctcctcctccgccgccgtcgcgtcgccgtctccgagcgcctcctccgcctccgcctccccctccccctcgcgccgtcgccgtcgccgagcgccgccacttccgcccccgcctcgtaccctcatcgccacgagccccgtttcgccccaagcccccgcacagatcggacccgtggcggcgctcctccaccgtcttacccccgtcccccgtgctactactgcgcgcccagccgccgcagagtagggcttctcccccctgtgccggcggcggcggcaggggttcgtaaggctgcggggaagatggctagcgtatacatcccggtgcaggggacgaagaaggaggtgcgggtggcgctggaccagctccccgccgacgcctccgacatcctcgacatcctcaaggccgagcaggccccgctccacctctggctcatcatcgcggtacgctctccctcactccctcccttcctagttcctagtcctcgcgacgaaaaccatcaacattccctgcaattaatcgctcggagttatagctcgtcggaggcgtgattattaggagtgattcggcgcgtcatggtgcgaggtccactaccctcgggcctcggctatcgcttccttgaaaatcttcccttggggtttctagggccacggtctctcgcttaatcttgcctgcagatgcgcatctattcctgttccagtgttggcattttgatagatttgtcaatgttggttcatattttcagtttattcgctcaactacgtgatgttgtacttgattagctttgttcttctctggttgttcaaagtgaacgaccatgctggtgaggtgccagaaattagtgatgttcatctcccacaagttgagtgcttgcgcacttaatccaggactagccttctgatgaaacctgtacttgtggggaccctctctttcaattgctctcctgagtcttgacaaattgagcctttccgagtggttgatttaactgttgtaaatttggaggaaacaatcaattgtattgttttgttcacttgtgaatcttgtgttgacacagagagaatacttcaagcaaggaaagatagaacagttccgacagattctagaggaaggatcagggccaggtttgtttttagtttctatttctctaactgtagggctactggtcaaccacaccatcttttatttcttacactaatttagattctcattgttacttgaacgcctgttcttgttgaatagtctcttctcccttgcagaaattgatgaatattatgctgatgtgaaatatgagagaatagctatccttaatgctttgggcgctttccatactttcctggggaaggttgagagagcacaacagaaggaagtccatttcaaagaagcaactcaatgctacaatagggcatcaaggatagatgaaactgaaccttcaacatggatcggaagaggttctattatttagagagtttcaaatatcttcatctattgtcttttatggcttagtgaatgttatgcacagcttcttttaccactgctgtggttctattatgattttctgcatattcatttgatcttgggattgtgtggttaatcccgtggaagttttatgtttttgtcatttttgcatttaaatttaatctattaaatttgataatactgtacttagttgattgtatttatttcaaaatgttcttccaacgatttcagtaaaaaaatgttcttccaacaaagctcaatttggttcaaagagatgcagcaacaagtatgggactgtgataatcattttctaatattcataaagaacgttttcatgtgtgtctaatctatttaaaaacatattattttccatgtgtttgttgatgtcacacaacatgtttgtggaaatcatctttgtttgtgaatatcttggctcttcgagacctattagtgttggattagtcccacagagtctaatatagtgtttagagaaatatgttgctccttttagacaaagcaaggagccaatggaggaagcctaagagttgatgtgagtttgatgtagttttgcatagtgacaaccatacatatatatatatttagttcatatttacctccgttgatttatatacatggtatgatgaaggtgtggtgtaagatgtaaagtttggttcctcagactgctttatagctgttttcaacaatcatgtcttattttgaaggtcacattatttataatctctgttaggtgaatgctaacatcttacagtaggaatttcgattgtgcatgtcatggaaaactatcttgttgcattgcaaacacatggggaagaggaaaaactatccttttatagttgcaactattaagcaaaaacttgtggccacgattcattcttaatcagatcgagcacatattattattttgatcatgtgttccagtggcgttcttgattttgggtttaatttcttactacactatttgttttcacaacttaagtttcatgatttgagcttagcgcactcatacgagttctgcagttaatgccatttcttcaccatattaattcatttgaatgattaccagcataacacttcatgattttttcctaacaagtatggttttaagtatgctgatttattgatgttgttcttcaggtcaactctgtgtggtcaagcacgatttgcaaatggcatctgattcattcaagattgtattggatgaagatggaagcaattttccagctttacttggtcaggtaattttcttgaggatttcaaaaatataataacaaaattgtggtatgtcgggtggaatcatggtatgtggggtttgaggttcgcaattcgccatttaaccccccaaaaaaagattcactgggtacgcctatgtgattcacaaataaaaaaaatcagttcatgaatcagagattggattgggtatttatgggggttgataccaaataaccaaaacgtgtcctaccaatttttttggcaagatggacagtatttatgaactgtttggattgaagcctgtttggcagtgcccacgctcaaggtagtgccctcatctaccctacaaaatcatgacctacaaaatttgacaactagttagcaaaccaaacgtaaggcaaggcagctttactctacaaaattttagtagtgccaaaacttaccaattctttggtagggatgagaatcagtcaaccaattcacccttatcattaaagtcaaataacaatatttacttaattcaaatacattcaaaaggattgggagttttaaaggaccaaatggtgaaaaaaattgtgaaaaaactgatattaggattattaaggaagataatgtaatgggcccagtcctccaggcacaccggattgtttcctcgctgtaccttctctatctcaatcattggcgcaaaacagctggtttgacttttccgtcaaccctagcgttgccagccatgctccctcatccttgtcttctcgccctttcccttcttgttgctctttgccgccttctcagtagagatctttcttctcctggaccgacaaagatgcatctagcagcatcttcagtaaacaagtggccattgtaatggtggcagaggtgatgttgacgataagaagcactggtggttactctggttggtttcccctttccactcctctcctttgctgtccatggggttgctgatttggttaatttgtgccaataagatgtcattccctattgatctgagtcgcaagtgtaccacaatgcatttcatgtgattggaactgcagtacgcgtcctcttggtatgtgtccagtaactacttgaagtgattgtcattaagtatgtataaattctgaatggccacagattgcttcttgtaatggtttactctataatatttattcaagttttgaattttgagcttgatatgaacactgaacggataaacctatgacagcagccaacagaagtattatcctatcatagtgtctgtgcattgcggtggatctcaaacaaataaactataagttcttaatatgttcaatgcaaaatatattgtcatcaaatatctaaaaagttgtacagataatcaatattagctaaactggccatttggatacacacaaaataacaaaataagagaatgtgtgtaagtacattaaaaaaaagattgtcgaagagaagtggtgggggtaaagcaagtgctatcattctacactgtactactgtaggtaaatatgacaacctggattagatggcttcacaccatttcttcatatgcttactagatctcctgcattagtttatctttgtactgctccctgtattttggctctttagcatgcagcagataaagatcgtaacaacctattgaaggcactaaaaagtacaatgtggtagtcattgtaaactccagcatctttcttccaattattgtaaccttcaagttataaatcctatctgtgcaggcctctgtttatttcctgatgggtgactcagagcagcaacacaagaaagctctggactattataggaactcactggatctctataaggttggtgataactcagcacttgagttccttttgacaatgccatattatttgctgtgataatattttaacttttataaacttcgtagagagccctgcgggcctataccagctgtcctgctgctgtaaggcttggtatagcattttgccgatacaaacttggtcagtcagataaagctcgacaagcttttcaacgcgttctgcaggcaagccctatttctgtcacttttatagctgtatagaagatttacctcggttaattgattaaactaaactaacctttcacagttggaccctgaaaatattgatgctttagtagcactggcaatcatggacttgcaaacaaatgaaggtaaatgctctgtcctaagtactaacaagaatccttttttcacaaattttccctgaagtctcgcaacttgtgtatagctggtggaattcgcagaggaatggagaaaatgagaagagcttttgaaatttatccttattgcacattggcactcaaccacctagcaaaccattatttctttactggccagcattttgtggttgaacaactgacggagactgctctctcttcaagtaatcatggactgctgaaatcacatgctttctataacttagccagatcgtaccacagtaaggtgatatactctgttcatacacccacgggactatttggttattcttttacttgttctctctgttgaaaccttggatttttttggttgctactcttgtttataaccctcaatcaaacttttaccaaattcagggtgatattgagactgctggaaggtattatatggcatctgtcaatgaaatcagtaagccacaggactttgtgttgccattctttggtaagtatattctcattttagggactgttatgacatcacaagccaattggtcatgtgctgcagtgtatctcaacaaacatacaccaccaactctaaaacactcaaaaccaacaagttgtctttattttagcctttacttgatcagcatgtgagttgtgattgtgacctgtgtgatgctttgggtgcattggatcatgtttagcagtttctgttttgggtctgttaattatattgattgaactggtattttcttcaggataccatgatatatttcttttccttttgctgactgtctaatggttagttcattagtataatgttggactatggttttctgagctgtatgtggaagctgaacgatatgacagttgcttgtgtcattttgaccttgaaactcccatgaggcattgtatgacttgtttcaattgagaaatgtagattttattttatttttgtctcggataggtgaatctcgattgtcaatttgtctattttgcacttctaactttataacctatggtacttttatttatgatccagtcacaatgcgcatgcactacactaacttaaaagttattatacttcttttaccatttctatatgcgcgaagctgttgttgaactgtaagtgattcccgatctttctgtatcaacttaatgggttgaactgattggcacctacctagtgacaatttaaatataaaatggcatcccacttctattccacttgcaagggagctcataggtagggggagcgatggagtataaaatgagttgctaccttatcaacataaacttctggctgaattggctggtgcatgctacccaatatcaatattcctttttgcagtcatcatcatagcactaatagccttttcagattttgtccaacgaagacttcaaactcttaatgtctattttgcactttcatgtggagtgttgatgttttcttatcttttccttgattgattaccttttgtttgacaattgtaaataaaatcatgctatctattgaatcactttatgttcttttttgtcttctttcttctgattgaggtttgtcaaacgtgtgctagcagttctagtagatatttttttaggtcaattgagaataattttcggcatttcttatgttgtttgttacaaaataatgatttgaagttttgaaccaggacttggtcagatacaattaaaatttgcagactacaaaagttcattagctagctttgagaaagtgttgaaggtgcacccagaaaattgtgaaagtttaaaggtgagatgaggcttccattcaatttcatttgtttgagaaggggctatctgtatgaattaattaatgttgctctgtcaaggctattgggcacatatatgcaaagtcaggtgagaatgacaaagctatagaaaccttcaagaaggttacccggattgatccaaaagatcatcaggtgatctctctctctcttgctcactcattataagaaacattctttcaatataatcttatcatgcttcttctgtacatataaagaataaggccctgtccatgtgagaggaacaccactgaacccgtacccagttttcaatcttcagacttttttgattaaaaaatgtggatgttaatatgtaaaccataggaactgagtgctgctaggttgtctgagtgtactttttgagcaccttcctgggctcaacacctggtgcctatcttcttaggtgaacggcagagcacatggccattttttattttaaatctgggaagcatgtcttagcttttaagcatggtgatgatcctagagtatttattattgaaaaataccgcccttaactaatactccataattagttcattgtatatctgtggtgctctgtataacctagaattgaaattgaattttattctcaatctacttaccctacctattaatttatgtacagttattctggtttacatttttaatatgctaaatgtatttataagagcaaatgttccgaatgttacatcaatattgtgaaatgttgtattatttcaattcacttgtctgtttatcgtagaaaagcatgggcatttatttctaatgggttttagatatgactaaaaagattaactaagttggctgaaagttcgaatttctttttgctctcttgaacttctattcctggtcatggtcatacaatctagatgaaacttgtaaccttcaagtttcctttcttaattcaatgatatgcaagccttttttacatattcccgaaaaaaggtttccatttatttcccttcttaaaaagaggaatttggggttatggtgtgcactacacccatcccctcatcaaggtcttctgtgagttgtgactagatatatgtagacgtgtgtgagttgtgactagatataattagtaaaaagtgcattctttgcatatgtgtgtattatattttttctgtcatgtagttatgtaaggacaattattttgattcaccttttactgtagatcttacaatatatttatttggcacccattgcgatgtgctggcaggctggtagttttgtttcaaacctctgatcatccacttatttagagtaggacatattatttagttacttcgtgtttgtgtttgacgcttcttgcattgtgaaaaaaaaacaaacttacaatctattttctgggcacatatctgattttgtagcccattatgttcaatattatgtatataatcttgttcatccatttttcaggcatttatggagctaggtgaattattggtacaatctgattgggctactgctatggaatacttaaaaacagtaaggctattcacttcgctagaagtttattctgttagcctgtatcagattctaccttggatgtatgtttcagtcatagagtttagcatataaattttgtttatttaatttgttgttgatacaaatgtgtactgctttgttttttgatccaattaacgtgggtcttgcttcagtttgaaaatatgaaatcttacctagcagttcacaggctcggaatctcctaaagaaggcaggagagaaaatacccattgaattgctcaatggaattggactacttcattttgagaagggagagcttgaggtttgttactgcacactccatataaaatactttacagtcatttataactgatggtatttttattgtttgctttttcagatggctgaacaaagttttaaggaagcacttggagatggcttttgggtttcaattatagatggcagtgtaggtagctccgtggttaactggagtattcagtatagggaccagagtttttttcaacaacttgaagaagagggaacacctcttgaattaccttgggataaggtcactacattgtttaactatgcaagattgtttgaagagctccatgatactgtgaaagccagtctcttttaccgcctcattattttcaaggtactgccattcccaccacatgtgtgccatcatgcagctcaacagagtctgttctttcatatagtcatgttacgatattaagtttacccaagcaggggagcatgcactgaaaagaatgtgaacatatttaaattctgacctttgctcacacatcctattcctgatgtttattggcgtcgcagcctccaaatgtttttatttgttacgttgtgatgtttgcatggagttccatacctttgcattttattttgtttgtgtagcatcactgatatatgcagtggtggtctctgctttatagtcttcccttgttaaattagttgatgtgttttccatgcttatagatgatattgcatcaatcacagggtttgaaaactcatgatataagatataatttccatgttcatcaattatgacagttaagaatgatttatattcctcagtaatttgatttgtcttgattattacagaaaaatttaagatatgtttaatgccaaggcttgtgaaatgaccacaattattttatattgcatcttgtttgcatgtatgtttatatgtcaattgtcatagctcatgtcacaagctattatggatactattatgcttgaaaagatatatacttccttcataaccatttgcccattatttccaaatatatgtaccaaataattgttccagagaatatatttggtacataggtatttgttgtacattctccctgaaaatgtgaaaacaacaggaccccttttgaaactatttttttagggtactgtgtgctgtacattctaattttaactccttttatttttacatgacagtatccagactacattgatacttatcttaggttagcagctattgcaaaagaaaaaaacaatctccaactgagcattgagctggtgagtatgaatgcttctgcatttttcttcttcttattattaagaataactataatatatttgttgtagataggtgatgctctaaagatagatgataagtatccaaatgcactttctatgcttggaagtcttgaactccaaggtgatgaaacctggcttactgcaaaggagcatttccgtgaagctaaagatgcttctgagggaaaagacacatactctatgcttcaattggtatgtgagcttacttaactctagtacatttatctacttatcactttactggtttgattaacaaccttttgttcgaaaaaggcagatggtttgtgtaccaaattgggaacaaacttgttatagactttgttcttatttttcttttgaaaactaaagcccaaatggggacttaaattacacaggaagatatggataagaattgttatggttaaagtgaagaagtaaactcctcgttatgaattagttgcctgtaattactgataactttgtttggcgtgtaatgtctggacaagtgctaccagctggcacgagatgatgcattgagctttatatattttggatcactagcatatcacccaaattaccattgaggtaggggcatgctaagcataatctaaggttgatgttttcccaccaataggtttacatctgcttggnttgatgcantcatattatgtaactaaatccaatggtttttcttatatttaaaacgaattttccatgttggttcaggggaactcggattaccttggtgcttattcggctcgtgaaaaagccccccaaatttggggcccttcctatggagaaaggccaggaactgntttcaaaatgttgtttgttttatgctcaacaccaattcaggagactcagggtttaatttgtggtaggtgggctgataaaaatacccgaacaacccgctccaataaacttgccctcaaggggtggattaaatggtacatgtggacaagggccaataaaaattaatgagctttgggaaatatacaaagagacaaattggcttttttttctcttttgggaaaaggcagagtggggaacactttttttgtggggtgggaaaagag

SEQ ID NO: 54046 - DNA, 4644 bp, Oryza sativa
  unsure (1)..(4644): unsure at all n locations
ccccctgcaaagcgcgtcgaggggaaatgatcaaggttctaacccgcgcagggttccgggtttaacgcataaaaaaattttttttaaggctatggaagccnacgtgattcccaccatatatgaacttttattgggttttgtaaggggaaatacggtcaacctctcattggcaggaataaaagcaactaagtttgatggtatgtaaaactagattatcagataagttctttaaagtaaaattttgagattatgcacccccaatttttggttttggatatatagatttagttatgatcaattcttatttacatgagcattaggctttaatagtgcttaagctgggtccatccggtctatgtatacttccgtgcggcaaagccgcagttattttctagtgcaacctgattgaaggtggatgaatacaagtgtatgtgttttaattctcaatagcaaatccagcaagtggagtaataatacatgcatattgccatgtcggtatacgtgctaaattaatgcatcaattggctttactcctctctgctgatctggttcatctctaataggttctatcataataaacctaaagaaccaaaagctaagtacccagccacttttacttacctcctacccttcatagttcatcacagggatgatgtatcttgcaggcctgtctgccttcttcctcctcttactaatttccaaaaattttcttggttatatcggcatgggagttgtcaggatatacagatggaggtgaatgttacagcccaggacgaagtagaatgaacaacgaagaacagttaccacaatcagagcctatttgagacattcctgcacgaggttgtttcttggaggaagagggaagagacttcgtggccatctccatctcgaggatgtttgaaatctttctgaacatgaacaaagcattcctttcactcttgaataaatttatcttgctttgtgtatagtgtatagatcgaccctgtcaggccatttttgagatggcacacccttgaaatatggtcatgaccaccaagatccatgttcactgctcgagctgctgctggatttacgacttattactctactcaccgataacttcaagattttactggacacgtgcaaagctgtcagccaagattttgcaacaattgagaactctctattgagtgttaactaatttacgataagaccttggacaaaggatcgtagcaattgaaaccacaaggataacgttgtgcattggttagaggttacatatataagtacgtcactcacaaaaataaggacaaaataattcgaaagaattcatcgtacctaagagaccacagtaccttccatgaatacaaaaactggtaggagggatacaatacggggtgaacgttatctcttccagatctgtttcccccatcgattccattttctccccgatcgagcagctagtcgctttgtcctactcgttctccattcgtcaactcctttggcccagtcaccatactcctccttcctccctcgaccctagaccatcatccccaacatcgatgacatcaccttaacctctttctcttctacagtggatctatggtatgagagagagtgggtatcattacttgatcatgtatggagccatcaacataaggaataaaggagatatgttttagttttaatgaggtagtggttaatgtataaaataagcctaacgttagcagaaatcctactgtatctaatggctaatatttgaatgaagaacaatccaatggctacgcttttgatgatgtggctacacgtaattgtagataatggcaacatatcctatgcacacagaccctcacgtgtacacacgtgcacaccaactaaaaaatgtcaccaaaaaatctagaaaaaatcatacatatactttcaattgtattacacctagggttaaaatcttaacgtcaaattcattatattttagctgtaacaaaaaaacaaaaaatctgatagttttaaggttgcaattttgtcagaattttatctttttttgttattctctatgtagaatgaatttgaagatgcgactttgcacgtagatgtaatactattgaaagtacatgtatgaattttcctagaattttttgtgataatttttagttggtgtacacggtgtgtacacgcgagggcctgtgtgcataggatacgctcccgtagtgtggctaactatataggaatagtagataactctgaaagtccaaagaaaaactcaagagtagatacaaagatgaatatcttatattggtgcctatattgtagagaggcgtcactctttatagcgttacatacatgttgctcacttgtgtataggaccatgtatcacatctctttactcctcccaacctcctatcttctctgctcctatttacacacccctgtttttaaccctcaaactttcactactccctctttatagttcacatgccctcccctcttttctccctcacttccctgtttaaaggttcagtgattcttagtcactatcaaccaatttcatattagggtgaccgatacatatatcaccaccacatgtgaaacacaaggtcgattacacaatttggcaagtctttgctgccgtcagttcattcattggactaaatcttaattgttaactataactagcctatctgccttctttctccactttcctccaattttctagggcatagctcatcagccaagcactgctggttcgatcggcttgggagttgtcaggagatgcagattatgaataacaacagagcacaggatgaaataaaacaaacaatgatgtggtttatttgctttgtttgggatgctactcgaacaacgaagcatggcgaacacgatctgagcctaccggggacacaatcgcacgaaagttgtctctgcaagcaagacaggttgcaaggctcattgtttggtttatctagctttgaccaagcctcataggtggttaccgcacctgctgtgtaagcggtgtatttttgccgtcgcaggagagcctcagtgatcaaccttttcctggttgttatgggttagattgccatcaaaagcaaggatttttatcgtctaccaaacaccataggattatccttgctcagatccaaacgcaccctacctagccatcattccttagccaggcaatattccttcaggcaatggattgttctgagtacataactttattttgcttgatgtatatactttgccaggcaatatttttttgagatattgcacaaagcataagacccaccaacatccatgttctttgcttcaagctgctgctggattaattgtgtgttcgtatcagacacgcggtgtgctgtgtgaaccagcaagcacatgcgcccaagcagcaacagaactcactgatgatgaaattgcaaacgaattatttaaataaaattttgaatgtgaacaacaaatttgagggaaattgaaaaggtgaggggaacagctcaacagcatgctgcctctgccgctgctgttgacgtcgctgcacacctgcacctacaccgtcgcaggagcgttgctgctatcaacttcgccggaggggcgcttttgcgtaccggccgtccattatagaaaatggataattagtatttttctgaaggaagggaaattagtacattacttatttgataaatgtatttggggaaagtgaaaatatttttttgttagaacaataaatcatacttcctccacttcatattacaagtcgttttgatttttttttctaatcaaatttctttaagtttgaccaaatttataaaaaaatatagtagtattttcaacataaaaccagcatattatcaatatattcaagactagagttaatgaaactaatttagtattttttttatgttgctgaacttttcacaaattttatcaaacttgataaagtttgactgaaaaaaaaaataaaaccacttatacagtataaaattaagggagtaaaataatcgatggctagagggagtaaaataattgtatgctgactcttaccttctccctagagcgataagatggagcactctaaaatgactcgacgatataacttgggacaaaggattgtaacaattgaaaacattcctttaaagaaagaggagtgtgtttggacctgagcacctggctcaactaaaccacaaggataacattgagaatcgattatgaggttacagagataaaacgcatcactagcgtataaaaactaagaagtcactattcattcataatctatgacaaagtaaaagaccatacactacgggcctattcggattacagggtaggaaaaaatgcaggaaaaatgcaggataggaaaaccgtangaatatgaaaggaaatcacgtagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatttaaggtaaaggcccggggggccccaattaagggagctacttaccattcaaatgggtggggctaatttggccgcttttaaaaaggg

SEQ ID NO: 54047 - DNA, 1031 bp, Oryza sativa
  unsure (1)..(1031): unsure at all n locations
ccctttcaaaattttaaaaaagctgtggataggctctcacagtctataatacacaaggccttaagcccacaatttcccgtgcaaggaattgcacttagaaaggcccaaatccaaaaccgggcatcttcttatccgacctaactttagtataattacccttaaggcccattttagagagttgcaacgggatcctacataaatacccacccggattaaccctttttatcctctcgggctgaatttggccccaaaatagccccacacnttggcccatccggtgtaccaaaaaatttcctcttaaaagtgagaattgtaaaggggttcaaaatttttaaagggattggttaaagcattaaaatttttgagaagaaaatgcaaacttataagtctgctgaaaagctttccggtgacagttttgaaggacatgtcactatccctattccattttattcttctgtagtacaagatatttgactgaccttgagatctgcaagaaaccaaatacagaaacatatcaaataaataatgtttttacctgttaaatcaaggtcaggaagcacccattatgcatttgaatcaatgatgaaaaaacatagcaagatgtattgttaaacttacccttcaccatcacgcatcctagacctaaatcgaggttctcgttgggatgcttgactaccaccccttgatcgcgccattctcttgcgttggacacttccaagggcttccttatccttctctatatctcatatagtatgccatgttttttttgagaaaattcgatccatagcacagaaaaaaaaatgcagtaccaaaaaatagcacaagaagtttccgctttcgattcatagcacagaccaccggtttttcttcgtcccgtagcacttccgtcgcattttgaagtaacggtgttagattggagtggagaaatttttcatcggactcatttgcccttcgtctcatctccaacgacggccgctcaacacaaccgtccgcctcttcatatccatcacacgacggcactcatnaacata

SEQ ID NO: 54048 - DNA, 2147 bp, Oryza sativa
  unsure (1)..(2147): unsure at all n locations
tttaaatccctctaaaaaaaaggaacgncggttttaaaaagcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgatgatgtgatgcaattgatccatgagctcctccctgctgggtcaaagttggatgataacttctatcgttcaaagaaaactcttgctggcatagggatgccatatgaaaaaatttatgtgtgctacaacaattgcatgctttactacaaagacaatgccgagaaagttagatgtgactttttcaaaacatctcggtatgagaatgacaatagcaaagttccacgtaaggttctaaggtatctccctatcatacctagactgcaaaggttgtatagtaatgaagagatagcagtccaaatgagatggcacaaagaacaccctacacataagctaaatgtgatgatgcacccacgtgatggtgaagcatggattcaatttgatgtagatttttctacttttgcacaagatccaagaaatgtccggcttggtctagctatagatggattcacacctttcaacatgactgctgcgtcatactcctgttggcctgtctttatagtaccatacaatctcccaccagacatttgcatgaaaccagagaacataatgcttgcccttgttatccctggtcctcaacatcctggaaagaacttgagcacactattggaacctttggtggatgagttacttcagatatgggatgatgtaaccacatgggatgcttcgaagaaggaaaacttgactatgagagcagcatatctttggtcgatccatggctttcgtgcttatggtgattttgcaggttggagcaccaatggtaacttagcatgcccaacatgtatgtgtgagtcaaaagcattcaggctccataatggagggaaaagttgttggtttgattgccattgatgcttccttccaagtgaccatgagtttcggactcaagcaaatgcatttcgaaagaacacaacagtacaccactgttagaatttcaatggttactctcattgagaagaggatggcacttagaatggggcaattttctggttttcttcattcacaaactcaaaagccatatcctcccaaagaggattggatacatatttatagctgcttgtagcagccatgctagggcaagtgggtgctgtcctagagcatcccaacaaactgtcctagagcatctcaacaaactgctgtcctagctgtcctagagcatccaaactgaaagtacaaatgctgtcctagagctaaaaagcaagaaaaagcaccacaagaccaagaccaagacttattcatacattctccccctaagtcttgtgcgccgtcttgtgggaaagttgagccatcccgatccgggagcaaacctcaaggaacttgatcctcccaaggggcttggtgagcaaatccgcaagctggtccttggtgttgatgtagctcgccttgatgctcccttcctccaagtagcttcggatgaagtgatacctcacccggatgtgcttgctccgttcgtgaaaaccagggttctttaccagggctagagcggacttgctatccaccctgagctccaccgctccaatgtctctgccgaggagatcactaagcagtagagcaagccagagcgcctgggtcgaagcgncggagcagccggcactcacgggcgatcatccgcg

SEQ ID NO: 54049 - DNA, 2901 bp, Oryza sativa
atataaacgtgtgtaagaatccccccacagaagggaattttctttttaaaacctggtggtggccctgtcggggttccgggataaaccgtttgtgtacccaaggaaaaggccaattttcccgtgtttggttaaggaaaaaaagcttccccaaaaaagtcggttttgtgaagcaccacttcctccgtcgggataatggggtcaagttcaatctctctccaacaaagtaagattgggttgcaatcggtgagtccagccagctcaacaacgcgcttggcgtagcggtctgtcaaagcgtgatcccgaagtcgtcctggtgcacctcgatccccaggtagaaggagaggccccagatcactcatctggaaggtggcctttatctcctccttgaacgctgcgacctccgcatccttggtgccggtgatcaccaagtcgtcgacgtagacacccaccagcaaggcttttccaccattgccccgtcggtagatggccgtctcgtacgggctttgctcgaagcccatccccttgagcgtggaatccaacttggcattccacaccctcggtgcctgccgcaagccatagagggccttgtgcaggcgtagcactttgccctccttgccggggatcacaaatcccggcggctggtgcacgtagaccttctccttcaagtcgccgttctgaaacgtcgacttgacgtccatgtgatggacgccccagccttcctaagcagccagcgcaagaaggagtcgcacggactccatccgtgccacgggagcgaaggcatcgtcgtagttgatcccctcctgctgcacgaaatcgcgtgccaccaagagcacaaagagtttgtgcttacaaagccttttccagctaacttgaccaacaatgctcctgctgctcaacgtagggagcatgaaaagcgatgcaatgattatcttgatataagctgtctcatgcttgctactatgtcccctgagcttcaaaggcaatatgaggcattggatgctcatacgatattcacgggactacgtaacatgtttgaggaccaagcaagagctgagaggtttaatacctcaaagtccttatttgcgtgcgggcttgcagaaggtaatccaatgagcccacatgtggtcaaaatgattggttacaccgagagtctggataagcttggctttccccttagccgagagttggctactgatttgattctccagtcgctccctccctgctttgagccgttcataatgaatttcaacatgaacaacctgaacaggaccttggcagaattgcatgggatgctaaagactgccgaggaaagcattaagaaaaactccaaccatatgatggttatgcataagcgcaagcccaacaacaagaaaagtggtcaaaagagaaaggtaaactctgatgagatcacgagtactagcaactctaagaccaaggttcaaaagatagggcccgctaaggatgcagagtgcttcttttgcaaggagacaggtcattgaaaaagaaaatgtaagaaatacctagagtagctcaagcagaagcagcaggatggaaagagttccacctcaggtattaatgttatagaaattaatcttgctacttcctctactaattcttgggtatttgataccaggtcagttgctcacatatgcaaatcgttgtaggggctgaaaaaaagtaggagcttagcaagaggcgaagtggacattcgcatgggcaatggagcaagagttgctgctgttgcggtcggcactatgccattatctttaccatcaggattagttttggagttaaataattgttattgcattccagctttgtgtaagaacgttatctctgcttcttgtttgcaagcagagggttatggttttatatctgtagacaatggttgtttagtctattataatgacattttctatttccatgcacccatgatgaatggcttatacattgtgaatcttgatggatgttcagtctataacattaatgcaaaaaggcaacgtcctaatgatttgaattccacttttatttggcattgtcgcttgggtcatataaatgagaaacgcatggagaaacttcgtagagatggacttctacactcgtttgattttgaatcatttgagacatgcgaatcttgtttacttggcaaaatgacaaaggcacctttcatgggtcaaagtgaaagggcaagtgaactattgggactagtacatactgatgtatgtggaccaatgagctcaactgccagaggtggttttgggtactttattacctttactgatgactttagtagatatggttatgtctacttaatgaggcataagtctgagtcctttgaaaagttcaagaaattttagaatgaggtacaaaatcatttgggcaagacaatcaagtatctatgatctgatcgtggtggagagtacttgagccttgaatttggcaatcatctaaaggagtgtggaattgttccacaactcactccgccaggaacgcctcagtggaatggggtgtctgaacggaggaatcgtacattgttggacatggtgtgatcaatgatgagccaaactgatctgccgctaagcttttggggttacgctctagagacagctgcgttcacactgaacagggttccatcaaaatcagtggataagacaccatatgagatatggataggaaagcgtcccagtttgtctttcctaaagatttggggttgtgaggtctatgtaacacgtttgcaatcggacaaactcacacctaaatcagataaatgcttctttctggggtatcctaaggaaacgaaaggatattatttttataatcgggaagagggcaaagtgtttgtcgccccacacggtgttttctggaaaagaaagtttatacggagtcaaacagggggatata

SEQ ID NO: 54050 - DNA, 1816 bp, Oryza sativa
  unsure (1)..(1816): unsure at all n locations
tgtttttttctagtcccctttgagccaggtccctaaaacagtgttatttagcgggcagatttgggggtgttgtttgattaagaaccttaccttcaaaaaagagatgccacctaagcctttttactacagaatgttttccaagatggaaaactgtaaatatatttggtccatgcatgacacttagaagattattcttgatatgtgccttcttcctttagagccatgggnaaccttcaagttacactcttggccaagagaaaagataggtctaagcatgaagatgaagagggggaggtgaaaagaggagnaagaagggtggtagnagaaggaaggatcagaagncaagggcacactatggggaagaggaagaagcggaatatagagatgacccagaagcagaagatgattatgcaaacncggcgaggagtancgatggtggcgattcagagaaagccccaggtcaccttcttgctgctgcaggtcttgaagattctgagaaagccccaggtcaccttcttgctgctgcaggtcttgaagattctgatgctgaagaagatgacatggttagtgtttttttttttctttttcataaataacctgtatcccttcatttctatttacaaattatttgcttgtctgctttatcattgttgccactgagttttaattcctttccaagctttgcattgaaagttagtttgcctgttagatctagccttcgcactcttatgttcatttgtattacttttgctatttatcttcactagaaataaaaattttagatgctctggtgcaaagttgccttattttgtcttttcctggctgtagggacaccctcaatctgccatagaacggaagagacgagcctggtcagaatctgaggatgatgagccagtgcagaggccagtgcaacctagcgcaggcgagaacgatctgagtgattgaattagacggtgaagattatggccgaatttgggatcacttcatatatttgtgacgaagaatggctcctgggatgcggaatcaactatagggcgtgctcatatgcacttgtggataattcgatgttgaaatggagctcagacagatggttgaaccagaagtgttaaaaaaatttatctgggagcagagcagtcactgatattcaacaattaatctcgcgtcattctagacatgccatgggttggtggagctaacataaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccttcaattaaagaggggaaaacccgccgactattaaaaacacacaggtttccctctgaaagtcctttg

SEQ ID NO: 54051 - DNA, 2663 bp, Oryza sativa
  unsure (1)..(2663): unsure at all n locations
tgattccnncctgagcgccgtcgtgtgatggattcctatatataattgccacgtaagcgccacatcaatgccacgtgggacagacctaatcaaattagccacgtaagcgccacatcagccaaaaccgccctcaaaaccgccgagggacctaatctatactggttttgatagttgaggatctatactggttttgatagttgagggagtcgctgtgtctggttttctagtggagggacgaaaatcggattcgttgacaagttaagggacctaaagtgaacttattcatagaaaatataactgaggaataagttcatccaaggtcccttaacttgtcagcgaatctgattttcgtccttgaaaaataataaaatccgtgggaaccacatgtcagtttcacacacagaaataataaaaaaagtgggacccatgtgggccccacatgccatcgtcgctgctcccttcttcccactatcctctctcacttcttccctacgatgtggacacggacggggacaatggcgccggcgtcgttgaggcactcgactgtgacttgggtcttgccgtcgggcctgagctaggcgcaggtgccgttcttgcggacctcggtgaggcgggcgccgagcttggtggcgaggacgtggctgaggnnnnnnnnnnnnnnnnnnnnnnnnnnnnnnnnnnnnnnnnnnnnnnnnnnnnnnnnnnnnnngatctcctcggggcgcttggtgaagtggccgtgcacgccctgggcaatgtcgggcgactgctgctcgatgttgacgagcaccttgcagcggtcggcgtcgaggccgatgtcgtcggagacgaagccgatgttgtggcaggtgtcgcggacgatcttctcgtagtcgacggtggccttggtggtgatctcgccgaacaccatgaccatgtttgtcttggtgcaggtctcgcacgccaccttgccctcggggtcctgggcaaggcacgcgtcgaggacggcgtcggacacttggtcgcacagcttgtcggggtgaccctcgttcacggactcggaggtgaagaggaacgtctccgccgccatttctatctgcccactgcatcggttgcaaccaagcaatcagaaaaaagactccatttctgcagatctactgccgccgacagctaagtactgacaaaattttgcaaattaaaattggatccaccaacgctatatctaatatgttctcctaatccaccgacagttaagtaccttttttttctcctaatccagaactccatacacgcacaatcaaagattaaacaaaaaaagaaaacaagaatatccgccaatcactttcccctcccacggcggcggcggcggggaagcaggtggggaagcgggagctcgcccgccgccgcccatggaggaggccgcgccttatctccgccggcgatagagagagatgggggcgagagatgaagacgacgggagatgggggagagagaggaggaagaagaggagggggtgaggttgacatgtggggcccacgtgggtctcacctttttattattatttatatgtgtgaaactgatgtgtgggtcccacagattttattatttttctagatcgaattgccacgtaagcgccatgttagtgccacgtcatatgaagaccgagtcaaaatagccatgtagtcgccacgtcagctaaaaccgccatctaaaccggcaagggaacttatctgcaccggttttgatagttgagggatctgttgtatatggttttggggttgaaggacgaaaattgaattcgctgacaagttaagggaccttagatgaacttattcctataactgaaatttgtagtagtacgcttggggcgaggccttacatgtcggcacggcacggcccggcctaaatgagccgtgcctaatcgtgcatgggccgggccgtgccgtgtggcccattttgagtggtaggcgaagttactaggttaccctcgccattttgacgcctctgtggtgcgtctcctcgtgcagtttttgcccttgatttgatcccccaattcattccatcccgcgaccgagctgggcgtcagcgccgtcgttcgtccctgctgcttccgccgtcgcatcccatcctcatcctccgccaccgccgcctgcgccgatccccatccatccatccacccagcgaccgaccgaccgagcagggtcgccgtcgttcgtacggctgcttcctcgccgcatccatccatccatccatcctggtgaggaaccacatcctctttcccatctctctctttacccacgcacttttttttctcgaatttgcgtcaaaccgcttctgttctagaaattttccctaacccttaacactaataacagtttgatggttcccaaaaaggtttggtttttctttttttttttttaaaaaaaagaggtttgggtttgggggttcaactgaagtgaacccccatgtcccatgttaagatccgccactccttcgtttgaactagtgaaagctacgccattctcttgataaaaaaaataaaattgggggtaaagaaaagaactttaatattgtggggtgccgattcaacccttttctttttgaccacacccggtgtgcaccccaaaaagggaagaaattaagttctttaaaaaagaaggggcttggctttccatgaaaattac

SEQ ID NO: 54052 - DNA, 6408 bp, Oryza sativa
  unsure (1)..(6408): unsure at all n locations
tgtttcagctctaaaacctgcaaaagtgtgttatatttttgtaaaacaccgtattatgggccgtgggcttttttccccccaatatttaattcccatgtgcctcagattccaaagaccaaaagaatttcttttaacaaacccctttctttggggtttcgggttggttggattgaattaaaattaacgttttgggaattgtaagatccacaatgcttctttactattaaatggtccaagttttttaattcctgcacatgaggttgaagggggttattttagatgtgccaataagcacccttaaatgttctgttggttggtgaaataccttatacatcatgtcttactctaanttacacaatcgggttatgtgaaaaaaagaaagttactgatgtgttctgacataaattttcattttttttgncagtgcattgtgtcaaaggcattgggcaatatccttttgaatntgtgtttcttggttcatattgaaggactgttgacatttttgaggaaaaatgagtggtgcacccaagaggtcgcatgaggagggtagtcactccacaccggcaaaacggccgttggatgacagcagcttgtactcaagcccttctgggaaaattattcaaccaggcagcagtgatttccatggttcgtttgaacatgatgggagatttgccaaagttcaacgtattgagccccgggatgataagaggccctctctggcacataggatgcctattggcccctccaactttgtggaccactcaatctcatctgatggcagattagaatcaaagcaaaataaagatccatgggacactaaggtagatgttcgggaggcaaaggctgacactcgagatgtctacagtgatcccagggttgaatttccgagcaataaagttgagactgatgtaaagacggacaatagagcagatgacaatgacataagagccgacagacggatacatgctgactacaaaggtgatgccaaactggacaaagatggtcatcctacagcaatttcaaacatagcctggaaagataacaaagaacataggggtaaaaggaatattgagcagccatctgataatgcagattggcgttttccccgccctggtttgcaaggaacagatgaatcttccaaaggtccagttcctgcagatgagcggtccaaggatgctcatgaatctactggtgagaataaaactgaacctaaaactgaagataagtttagagataaggacaggaaaaagaaggatgaaaagcatagggacttcggcacaagagacaatgatagaaatgatcgccgaattggtattcagcttggaggcaatagtgttgaacgaagagagaatcagagggaagatagggatgctgaaaagtgggatagggaaagaaaagattcccagaaggacaaggaaggcaatgatagagagaaggattctgcaaaggagtcatcagtagcaactgaaaaggagaatgcaatactggaaaaaactgcatctgatggagctgttaaaagtgccgagcatgagaataaaacagtagagcagaagacacttaaagatgatgcatggaaatcacatgatagggatcccaaggacaagaaaagagagaaggatatggatgcaggagaaaggcacgaccaaaggagtaaatataatgacaaggaatcagatgatacttgccctgaaggagatatagagaaggataaggaagcccttggaagtgtccaacgcaagagaatggcgcgatcaaggggtggtagtcaagcatcccaacgagaacctcgatttaggtctaggatgcgtgatggtgaagggtaagtttaacaatacatcttgctatgttttttcatcattgattcaaatgcataatgggtgcttcctgaccttgatttaacaggtaaaaacattatttatttgatatgtttctgtatttgttttcttgcagatctcaaggtcagtcaaatatcttgtactacagaagaataaaatggaatagggatagtgacatgtccttcaaaactgtcacggaaagctttccagcagacttataagtttgcattttcttctcagaatattttaatgctataaccaatccatttaaaattttgaaacccctttacatttctcacttttaggatgatattttttgttacactgcatgtgctagtgtgtgtgtctattttgtggacaaaatccagccagagaggataaatagggtaatcggggtgtatatttatgaggattccgttgcaactttcaaattgagcataatgataatttatctaaggtaggctggtaaggaagttgctgtttttgtattttgctatcttagtttcattccattgcaggtaaatctgaggcatcagccattgtctataaagctggtgagtgcatgcaagagcttctgaaatcatggaaagagtttgaagcaaccccagaagctaaaagtgctgaaagtgtgcaaaatggccccactcttgagatccgcatacccgcagagtttgttacgtccactaaccgtcaagtaagtgttgacttttacaggtggcatatgttaatcccttcatcaatctccaagtttgcattccagaatgttaatatattaacacacctaatactgaatgattgtgtaattcacttgcaagtgtgcatctgtagatttatatatttacaggagattattctattgtgatctctttgaaccagagatgtatattctatttatctttcctcttgaaaccatatatgccaattgctacatatttgctgctcatgtagttgacaaattgcttcataaattaatgaagctaattacttcctttgattttgtttgtttcttaaaatcactgttgtgtaggtaaaaggtgctcaactttggggaacggatatttatacaaatgattcagatcttgtcgctggtaagttcttgattattttccaagcgtgaaacgaacctctgaaagctgatttctaaacggtctttcttttagtgcttatgcatactggttactgctcccctacatcatcacctccaccatctgcaatccaagagctacgagcaactgttcgagttctaccgccacaagacagtaagccttcattctttgtcagtccaattattagacttaaaaaggtcagagcaatatggctaaattagtagtacttgtataacacttgatctaccttccaggctatacttcaactttaaggaacaatgtccgctcacgtgcttggggtgctggtattggttgtagctttcgcatagaacgctgctgcattgttaaggtattaagactgtataagataacatataaggctactgtgttctccttttgctttgagcaaaatttcagtgctttcttttgttttaatctgctgatgtaaaaaccttttattgaccactgctccatagattgtttgcttagtttgtattacatgctttgcagaaaggtggtggtactattgatcttgagcctcgcctaagccatacatcagctgtggagcctacacttgctccggttgcggttgagcgcacaatgacaacaagagcagcagcttctgtaattttctacctcctctttctgttatcaatgttttcatttcaaagacattttacttcactttgcaacatttagtttttgttatcatgagcaatctttgtctatattctgtactaaggtttttttcaatataatctatgcagaatgcgttacgtcaacaaagatttgttcgggaagtcacaatacagtacaatctctgcaacgagccatggtactttcttgacctaccttctgatgctactcatttgctcatgaaagttccatccagcacgtactgcagccttttctgttgcatatgagtgcttgtttgtttcagcgctcaactcctcagcttttagaagcctttgtctaggtctttgttgagctaaggttgctcctactaaccttgtacctgattactttacttcaggttgaaatacagcataagcattgtggcagacaagggattgaaaaagtcattatatacttctgcgaggctgaaaaaaggcgaagtcatatacttggaaacacattataataggtatgagctgttaccgttaactatttggccatcacctgaagttatatttttgacttctgtggagcacagttccttcatttccccccctcctgttactgcaagttttcacaggtatgagctgtgcttcagtggagaaaaggctcgtcttgttggatcaagctccaatgcggcagacgcagaaactgagaaacaccagaatagtagccaccatcactcgcaaaatggggacagggcctcttcagaacatgaactgcgggatttgttccgatggtcccgctgtaagaaggcgatgcctgagagctctatgcgctccatcggtatcccgctgccagctgatcaacttgaggtaacgtcctgctttctaacattaaaatggtggataattcgcatacagaaaccacaattctcacacggttttcttgttacctcgacgcaacgcaggtgctgcaggataatttggaatgggaggatgtgcagtggtcgcagactggtgtttgggttgctggaaaggaatatcctctcgcccgagtgcatttcctatcatcaaactagcccctgcaagtccttcaagttgtcgtagcagccggttcatgaactaatttctcgcaacaatttaaggcaggagcttctctttggtccatgtcgcggttttattgtacaatgtacaatgcatccatgccatgtctgtgtataaatcaagaatgctcagctgctgtaggctgtgttgtgtgtagtattttttcccccttttttcataaactatttgagttctagttgggctgcttctgccccatgtcactgagatgtagctgttgcttcacaatttagctaacctgatgattattgttgaatggttgatgtgctgtaacttaattcagtgctgtgttcatctggggtgtttcctgaccgggcaggttcagacgtaggctatttgactgaacttctggaaattacatgtgatcattcctacaagaaatttagccgaactctgtccaaaacaggaagttgttgcaccgatgttgcttgcttcaaaaattttctcctgcaattgtagctagagaatacatgtggtggaatcctacatagtagtagttcgtaagaataagggtgtgtttagtttcatgccaaaattaaaagtttgaagaaaaaagctggaagtttatgtgtgtaggaaagttttaatgtgatggaatagttgaaagtttgaagaaaaagttgggaactaaacaagggctaagatggccgaagggatattttctgacgaggcgatagacatccatgagtggtgtaaacaatagacgcacacatcatggctatggaactttgttgtgtgtgctgctgctacagcaacatttccaggtgcattcgtgtctcatgctcgggcagtggtagtcgtacttccattttccagtagccctgtttattctatgtactactaagcttcgacattcttctgcatctgtatctcctgagtcctgacacctctcatgccgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtctttgggctctctgtgttcgaccttgccgtatacggaaccgtccggcttttcttttggaaagtgggcttttctaaataaaccttgggtattcaatggggaaggggtgcttccaattggtttggcccaaacccccttaaccccacccgggccttttggggaatttgtgtgggcccccgaaaaccactattcctctgggt

SEQ ID NO: 54053 - DNA, 9544 bp, Oryza sativa
  unsure (1)..(9544): unsure at all n locations
nggagttgcccgcattccgcaaagcttttgttccgtagcctaanaaaacctatgncttggcccgggaaggccccggttggggccagggattgccaaagggctacgttcaggccggccacggtccgaaagncggcggtcacgccggccggggaccgcgcgaaggccccgggtcgagggcaccggtcgcggcaaccggggaccgcgcgggggaccccgttcgagggcggccgacggcacgaaggncgccggtcgcggccggcgacggcctagccaacacgagagacaaaccgacgactgacgaggcaagattggtgcggacgaggagtgaaggaggaaagtgggtgggtcccacggttggctagtgacttttggctggccaaatttggctagtggggggagggttttggccagccaaatggcttagccatctggttggagaggctgttggatgaacttttttggttgaaatggctaaaattcaacttagagagtcacttggagagactgttggagatgctcttaggagttaaagctccaaatcaccacgacgacaggagaaagctaacgaaccatggctacagttctcttttgtcttccttgcacaaacgaactagtgcaattgtgcctccggtaggccatctgtgatagctgtacttcgttgttcgtgtactctccaagaccaagcaaatagactacatcattgtttattctttttcctctcgatttgtgttgttatcctgcatctatatctcctgacgactcccatgccgaagaaaatcggaggaagaggaagaagaaggcgggaaggtatgcatgatgcgtccttccggtgatcgatggtaggaggtaagtaaaaatgcatagcttttggttcttcaggtttaaaatgatgggagcttattagagacgaggcagagcatagaggagtaaagataagtgatgcatttaatttggcatgtgccgatatggctaggtgtattgctccctctgtcccattttaagtgtaccataagtttctgtgtccaacgtttaaccgtccattttattttaaaaaattacgatttttttaaaaattaagtcatacatatttgaaaaatttatgattttttttaaaattaagtcatacataaattactatttatattttattatctaataataataaaaatactaatcataaaaacgatttcaaataagacggaaggtcaaatgttgggcatccaaacccacagggagtactcttagtgcactccactagctggattaggtatggagatcagttagtactcttgacgttttggacagtgacatggtcttaaaaaaacaattttgaccactattttttataacaatatatataaaaatataaataaatatatgattttatcaaggtattttgtaagacaaatatttttatgttatttatagtcaaagtttttaaagtttgataatagactcattcaaaacgacaaaaacgacaagtattattaagccagcgggaaacgacaaaaacgataagtattattaagccagagggagtattcatccacctgtgagtagtctgcatgtcgatctgagcttctgtttaactgagtgaacttgtgggaactaacatggatttaggtgggttttaaactctgtggcacttccaaaatcgccatagaaggttaaaggtttatacagtacggaagaaaagtttactcagacaaattttcttcacacattcatgataatttcaaacaacgtctagatatgatccgaaattaaaggtggctggacaattgggaagtcatcaggaacctccaaatcttaatagtttcccgtagtctcagtagtatcattacatgagactagtctttcagagagcgaacaaaccatggctgtgtgaactttgtttcctcctcttgtctgtaaaaattaaaaaaacaaattaatgtctcaggtacactagtgtcttctgcatttgtatctccggtagctagccacacggacgattgcactcatacttccgtcatgaatcgcttcgcggagaaagaaaattgatcgaagcattgcttattctaccttgctcgtaggctttaatatatttgtgtatttttatctcctaacaccagtacaccacccatgccggtcgaaacagtcggtttcactaatgagctagacccaagaagaagaagaagaagaagaagaggaggagaaacagaaagaagaagatggaaggcatgcatgatcaaggttggaaatttcggaccaaaatttcggaaatttcggtcatttcggtgacccccgatacgatattaattcggccgaaaattttgaatttttcaattttttttcatgaatttggataatatttgttcaaattcaactaaattttgttcaaaattttgaaaatttcagaccgaaatttcggtgacccccgatagaaaaccctgaaccgatatagtgaaccctgtgcatgatacatcctcccagtgaaggagggataagaagtaaagtggaaatatgccatatgaatgtgaggtagtgcaattgtggctagagaattgaagtcatataatacatgtggtgaaatgctacatgtattatatgatggccgaaggggatattttctgacgaagcaataggcatcaatgagtggtgtaaacaaatagcttgcaactttttagacgcacgcacacatcatggctatgaactttgttgtgtgtgctgctgccaggaacatctcctggtgcattctcgtctcaggctcaggcaatggtagtcgtacttccttgttccattagactcccagagaaatccaacaaatcacagcactgtttattctatctactactgatgttcgacatgatcctgcatctctatctcctgacacctcccatgccgatcgagaccaagagcgtttttttttttttttttttttttttggaaacgagctacccaaagaacgaacaggacgacgatcgaagaagatgaggaataggcaagtgaattggctgtgtacgtacgtagatatcagctggttcaggtttaaaacgatgggagcaagagcaacagttaaaagatgagccagagaagacatgagtagcatgccctgaatcgagacaattatggtggtggacgcttcaggcgataaggagtccgaactgcttacctgtcaatgagccatctttaacaattggctctgtgagagccgaatgaagattggggagcggcatcgtcgaggtttcgacactgtcgtgacactggtggcttggacaatttggaaggaacagaacaactgaatcttcaatcaacaataaaggtcttggaccgaagtggcgaaagcaatggcagaggaggccatgctttggaagtcggctaatcacgagatccccgctgtttggcctttacgaggtcgtggtagccaaatttagcgcgagatattcctatagttttccatagtgtcctgtatcggtcctctgcttgttttccttttatcactgtaaataacttttatttctcttaatgaaaaaaatgcgctccttgcgtattcctaaaaaaggagtaaacacaagcctttggcatgtatacaatatagtggtatgtagtctggattaggtgtaaggctgtgttcgtatgtaagtgctgggtgttgtgcacggaaaatggagcgatccattagcgcgtgattaatcaagtattagctattttttttttcaaaaatagactaatttatttttttaagtaactttcgtatagaaactttcaaaaaacgtaccatttagtagtttgaaaaacatgcgcgcgggaaacgatagaggagtgctgttggtgcactttgtaaacatagagagaagaaataaagttgttatctactttgagagttcttcgatttgtgttttctcgggtgcggcggtccaactggcgggacaccgacggtcagaccgacggtatcacggcagtcagaccggcggcggtgacaggagctagcggcagatttcggcggtttgaccgatcgatctatatcggttagactgacgtgttccagacagtcagaccggcgcaactacttcggtcagaccgctatccatcgaatttgagggtaactttttattccgcaaaaagattaggtttttgggcataccaaccattcactcttctctggttggcttacttcttgtgtttcgatcctacagaaaataatctctctaggcaacataagctactctgcagttgatattttcctcttcgttacacatgtgatactcgttctccttttcttaattatctctaattactatatatctctcaatatgtgtgcagtagttgtgcttgcaacacaaacctcagtataccgatgctgctacgtgaacaatgaacccgttgattccataccaaatattcagctgtctacatgtctagattgttaattaattctcatccatgaattcgacgggtggcatatctcccaatgtctcccatgccgaaataaggatcgggacattgacgtgctagcaaggaagaatagaattagctagggaggaattaaaggaggccaagaaatggcaacgacctacatgaacatcgatctgatctgtaccctcactgtgtcatgcattctgatcgatcgcgagcgctgcttgtatattcggtagctaaatggtaaggaagatgcaaatatatgaacgtgtaaaagaagagatcttcttgaatactttaaattaattagaacccttgatcaataatgatctaacggacagagagagaaggtactagaaaaaaggtattaaaggagtgggccaggtacgaaaggtggaagggtaaaatagtaattgatttttattaaattatttttcggtaaatggcaaaagcggtggacctcgtttccatgatctccatggcggatggcgcgggaggaggtgttctgattagggccgcgtcaattgatttgagatctccggtgatcgatctggtcaatctatctgcaggattggattgttcgcttgatcgcttcatcactagttggtcagttggtgtcgtttttctttcgtatcctgtagctgtgatctcggctgcctgacagcctgaggcccttgtgcttctgaaacttctgattaatttgatgatccgaacctgagatgagattgactgccttgctgttagttcgatcattcaagatgttcgatcgattttgattgtctcatcaatgtgcatgatcgacctgctcgagtacccattaccctttgccttcatggtgaatggatttgtgcagtgtaaaaaattttgttcctaaattaccctttgaagattaacggtggataacaatttattaaggaggtacctcaggtaccttccaagcactgtaaaagacctcgtaaaagaaagaggaggagagcgaggtagtgcaaatgcaggtaggccgtaggcaggtgagaatggtttttacttaccctctgtatgcattctgtggtatagttcaggcttgacatggccaaagtaaaagtttgagtactggtgagtaaagaagagggagggaagatgtaaagaaatgcataagtgccaaaatgtactcaagtggcagcattgtcagtggtgataaaaaaggatcatgttttttttttccagcttcttgaagtgcagggcagcccagtgaagtactcttgactctctacagctatatatcttggatgtctgcggagtgtagacttaattattccttgagatgttagttcaattcgatcaattcaattgcattgcatatcaaactttggttaattaatttatgcctcagatgaaggaataatgatccacatactgctttccatgcagcatagtgtagaccaagaagcgtgaggttaagatgttccatgtcttgaagaaaaggggaaaaaaatcagacaatcaattgtactaaaataaagtttccggcagtatatatttgaaacttaccaggatacaacacagccatagtaagaacattacaaaataaacatgaagttaagttagccaaaggttttaacagtgtctggtgttgggattagcttcttaagtcacaaatcatatgccaattaattaaagaaaagcttcaataccctgtggaatgagaaggcaccatgcacaaccacaaaatttcaagaatttcatagagcggtgaagttagtcactgcaacgatgcttagtctccctggtccttcctacaggatgcaggtactagacaagcacgcagcactgatacagaagacaggaagaccgatgtgtgtgtagctgcccaaaggaagaacgctgcaagctgctcaagatttggtggcgaatcactgcatccgtgctactcccagctccattcttttttgtttgacgttggttagctcaaaatcgaactaaccgacgtcaaacatttgtgcaaggaggtaatacttagctacatgtcaagacggaacgtcttggaacttttttccagtcaggtactcggggataggggtgggcgtgcaccgggacggtccgacgtagactcgtctcatgcgacccacctaggttgtaaattaacggtgtcaaacgggggttttggtgggtacaatgagtcgatccataaaaaagaagatcatatcctgattacacatataacatgccaaacaaagtaaaagaatgtagtagtaaaatataacctattgatttcttgatcagaaatgtttgatttcaactgatgttaattaatagcaacgacttgagattatcttttctatcaccgacgcatcatcagtgctagcacatacaactatagtagcttcagaaattacagcaatgacaataacacttagttgaagttccgattcataggaccagatcgaatacctcaggagcacaagaaagctacgagtagattgaaattaagaaaaacaagtgctttctggatcaaaatcgataaaagaggaataactcagaagcatgaggaagcagcagatcgagtagatcgaaatttagaaaaacaagtgctttccaatagatcgagtagattgaattttttttttaaaaaaacaagtgctttctgttagaataaatgggttaggcccgatttatttctattaaaatctcaagggcccataataaatgttaaagataataataccaccttgagaattaaaagtggagtatctcaacttaaatagagagttattggaggctcccggttgaccgattgaggtggggatcggaaagccacgcgcgccgggacggggcggggcgggcgcaccgtcgatcagattctccacgcattctttccatcgctggttggtttctcttcctctgtgtgcctgtgctacctctgttctgttctccccgcaagtgattgggacgagcagggcctcgaaactacaccttcgcctgagatctgcacgcgtaggcgggtgatcaggtttttggtttgcctgagatctgcacgggtaggcgggtgatcaggtttttggagagtgcttccgcatgactgctccgctcgcttcttcgtctacgttcggttaaaactacaccttcgcctgtaatctgcaagggtaggcgggtgatcaggtttttggggagtgcttccgcatgactgctccgctcgtttcttcgtctacgttcggttaaaactacaccttcgcatgtaatctgcacgggtaggcgggtgatcaggtttttgggagtgcttccgcacgactgctccgctcgcttcttcgtctatgttcggttcgttctgcatcacgcgatgtctactggtggtggtgcttccggtgcggcaggagatggggcgccaggaacaggaggtggcgcgcacggtgcggcaggaggtggtgcgccaggaacaggaggtggcgcaccgatcgagaacaccaacggaggcaattctgcctcacaatccagcggagggacttttatagggtataaacatccttctgctacctttctctttgttaaatctgtcagtcgcaatgttattacgttgtctcaacgttaatgcttattttacccttaagcatgctcctggttatgtttagctttattactagatcatttcacactgtgcatgtcatgtttatagtcttaatattttggattaaaatatgccgatttatgaccatatttccaacactctcttgatcatatcaataaaagaggaactctaggttaattggctacctacaaagaagagcccaagtgttctcttccttgtcaaatgattgtgtcaaagtcgagggagagaactgataggacgtactccctccgtctcaaaaagactcaatttctgggtttccgtgtctaatgtttaaccatccgtcttatttgaaaaaattatgaaaaaatttaaaaatataagtcacacataaaatattaatcatgttttatcatctaacaacaacgaaaatactaatcataaaaaaaattcatataagacggatagtcaaacgttgaacataaaaagactgagtctttttgggacagagggagtagatgagacgctgttgcaccattgtggaggaaagcaacaggtggcgtcggcatggaggactagactaaacgggaggcactgccatcacgcaggcgcggatgcatggaggacaataggagggaggaggcgctgccatgccgatgttggtgacatgagaagggatgaggagacaccactgctgcgtgcttgtacgaggggatcgatggaggaagacctagcgaagacgtgaggtttgattaatttagtcaaacttgttaccctttggagccagaattttgggaccggccaatgaggctggtgggtcagtccggaccatgcccatcccaactcgagaaagccaaagggccatcacctttgcatgtctcggtgcctcccatgccaatctactaagcatacacattttggttggaattataagataggtcgggttagatcgaacctatttttaagggtgtttggtttagctatgaacgagttaacaaaaggaaatgactattcctcatgtgtcgtggtgatgatatatgtgtctatctatcaccctaatctgaaacgattgatagtaattaaccaacagcatagcaccactagcatgcagctaagggacaatgagatagagcatgaanacttgcatatactgtatanaggatcacannatgaggcaagaagacatacngttgggtatgtgaaaactataagaggtgtaagcgtgtaaattaaagatctgaaanagtcttatgttttccgaaaaagtgcagtagaaaaaagcttggattggtggacgtattacctggttattgactcaggccccgtcaaaagaagtcttgattgattgagaaagtttgggactgggaaagagtaaaaaaacccggtgcacatctacctttttatggagcatggacaaaattaacttgtaggcagtaattgagctagcttctcggttcattaaagctcgacttgttttgagtgtgtatttaacgagcttagncaattgggggcatttttggagattgggctttaagtcatttgctctttaaccgaaccttttccccctgtttatttctaacttcccctttttctatgaaaaca

SEQ ID NO: 54054 - DNA, 2309 bp, Oryza sativa
  unsure (1)..(2309): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagaagcactaactatataaagatatgatgatctcttatacaaacgagctaaataagcaacctgcgacttattaagactacgagtttaaatcactacgagcaaacctcattacgagccatctgagccatgaatttctagctttttttccacctctataagttgtcgcgtcaacctagtgctctacaagatctaccggttgcctcttgtggctcacttagagccatcacatcagaatacttgcacatccagtgtctcccgccggaagctgaaaggtgatcgaggaggatctcaagtcttgatatattcaagcttggctagctaaagaaaaagcccccaaaaagtacaaaacaagtaaagaaaatatacacaaatatatgcaaatatctattcaaaagttagccattgaggaagtgggacaagtcgttgcttgcggatgaggagtggagtatgtggtatccttgtaccaagtgaggacacgtacgccatacgccgaaccagaggggggcgacggcatcggcaacgtgatgctcgccgtgactagtactacgaattcaccaccgacgagctctgctttctggcattgtgatcagtgtccatcagacgaccatgtctctgtttacctctggtttttggtttcatggccagggcactttgctctcatagatgggatgatttcggttgaattagtacttgcatgaaaagaagaacatgtagggctcattcggattgcaggctttttacggaaatttcatgggaatactgttcacttggatatttttcatatcctatcattcggatggtaaaaagtggttgtgggaaaactatagggaaaaaatcctttgctgccgattccacaggaaaaatggaggaaaattccatccactccaagctcttgttctctccctatcctgtaaaccgaatgctcttagcttctacattcctgtgtttttcaatcctctattttctacgtgatttcctttcatattcctacggttttcctatcctgcatttttcctgcattttttcctaccctgtaatccgaataggcccgtagtgtatggtcttttactttgtcatagattatgaatgaatagtgacttcttagtttttatacgctagtgatgcgttttatctctgtaacctcataatcgattctcaatgttatccttgtggtttagttgagccaggtgctcaggtcacaacacactcctctttctttaaaggaatgttttcaattgttacaatcctttgtcccaagttatatcgtcgagtcattttagagtgctccatcttatcgctctagggagaaggtaagagtcagcatacaattattttactccctctagccatcgattattttactcccttaattttatactgtataagtggttttattttttttttcagtcaaactttatcaagtttgataaaatttgtgaaaagttcagcaacataaaaaaaatactaaattagtttcattaactctagtcttgaatatattgataatatgctggttttatgttgaaaataggaaaaaaaatttttatcctttgggtcggatttaaggaattttgattagaaaaaataatcaaancgncttgtaatatgtagtgngngttccattcaggtggtcatggtggnnnnnnnnnnnnnnngnngggttgggtaagggaanccaaggcgaaaagacaccnanncannnannancggacgggngcggtagaganangggtatggttagaggtt

SEQ ID NO: 54055 - DNA, 1991 bp, Oryza sativa
  unsure (1)..(1991): unsure at all n locations
aagaagctgcctttaaaaagccaaaatgggcgcttttaaactcccggaaagattggacagttttggggtgaatataccccttttgggtctaacttcctggggacatttgttccggggttccagggttaattggggctttttcttccccagtaaatggcttatttttaagggaaaagctttaccaaaaacttaccaaaggctgttagataaagtgtgcagcattgcatcgcatgctttccggaaagcgtcagcttgaataaccaacatgctgagatcttgctactgcttagcattagcttgaataagcaatgcatgttataatgatctaatggcagacatgcttggcttcatgcattgaacaggtatgctttgaatgtgaatgtcgagcgggttaataatgttctattgcacaagaggttgcttgaccaggcccgtgaaccaatgaatgggctggtcttcgatgttcgtcgttcgcaggtgattaatgcataacatgacctgtctacctcttttctgaaaccgactaggcatcgcttgatgaccgtcgcatgctcgtatattggctagtgtctaggataagacctcaacattttcataaccaagtgctgttagacaccacagtaccatgtgacgtgttgtgtaatacgatgtaccttttgtgccatccttacaataatcagttaatcactatcctgtagaagtgtaaatcacatatccttgattttgaaactgcatttgttaactgctggttatttttattttatgtacaacagctgcttttgcttttctaaagcttgtctcactgtttcaatttgttctgttggaaagttactgagctataactttgttcctgcaagtcagagtaatagaaaaggacgatgattactatttttttctcctcctttttgtgcatttatctctttaatattttcatacgccataaatttgttacagtttgacttaacacatatatagagattattatcggattataatatgagaagcacaaacttatgaactgattaatgggatctactagcctatgtgttttgttgaacatagtttgatatctcattagaacatatttcatatcaactacgtgaatgtgcaccttttaggctgctactctggatggaagcactgaagttgagcaatcaacttcctttaagcatgaagtacaagatcctcagtgctcatcgttcacatcgagagaccaaaggtgattttgattccagcattttttgtcattgagttgagttacaaattgttttggatagcatcacatcagtacagattagagatggcaatggtgaattcaccgtcgggggtcaccgctgcgtccccatcaccgcggtgaaaaaatttcaccgtccccgcccccgtcaaccacgacgggggtacattttctccagccccgatcaccacgcggtgattttttccctgtggtgaccccgtatcaattagggattagggatcgtagcatgagctgaccttgcatcgtcactgtcgtagcttaccggggggcggaggccgaagccatggtcggccgtcggcggatggcgtgctggcggtggacgacgtgcgggcgagtgacgacggaaggcgctggcggacgtcgatggcgatggcggctcccggtgactacggctgcaggcgccgtgcctgactgcgcgtggacggaggctcccggcggctgccggcggcgcgtggacggaggctcccggcggtgcatcgacgggtgcccgcgccacgcgagagaaggcagcgagcggcggtgcgcctggctctcggcggattgacggtgcatggtggcacgcctgactcccgagcttcccggcggactagcggacggcggtggtgggctggtggctgcgtgcggatctggaggatttggtattttgggtggagaatttgaagttgactggnnnanntnnngnaaaagaaagagcccatttctccaggcaatccatcacacgaagggccgctcaaat

SEQ ID NO: 54056 - DNA, 1574 bp, Oryza sativa
  unsure (1)..(1574): unsure at all n locations
cggtttccgggcctttttgggggcccttttggctccaaaggtttttttctcgcgttaatccccctgatttttgggaaaaacccgtatttacggccttttaagtaacttaattcccgtttcccgcaaccggaccgacccaaggccaagaagtacattaaacaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttatgaaaaaagggggaaaaaatactacacacaacacagcctacagcagctgagcattcttgatttatacacagacatggcatggatgcattgtacattgtacaataaaaccgcgacatggaccaaagagaagctcctgccttaaattgttgcgagaaattagttcatgaaccggctgctacgacaacttgaaggacttgcaggggctagtttgatgataggaaatgcactcgggcgagaggatattcctttccagcaacccaaacaccagtctgcgaccactgcacatcctcccattccaaattatcctgcagcacctgcgttgcgtcgaggtaacaagaaaaccgtgtgagaattgtggtttctgtatgcgaattatccaccattttaatgttagaaagcaggacgttacctcaagttgatcagctggcagcgggataccgatggagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctgaattaccccccgctttaggccccgggggccgggttcctctttatggggaaaaagagaggggtttttcaacccccctttaaagaaaataaaaaaaccccttttataccaatgtgttgggggaaataataaatacgccctccttggggcaaggg

SEQ ID NO: 54057 - DNA, 2161 bp, Oryza sativa
  unsure (1)..(2161): unsure at all n locations
taagagggcgagtggaaatcctcttataaaaaaaataccccaagagggttggtggttgcccttttgaaaaaagcccttattaagggggggctccagctcaagagggaaaactccttaatagggggaagggccccttgtgtaccttccccataataaatttttgggggaaaggtccaataagctttaacgggaccctaagggacccccctatttaaatttcgcggaaaacccggcaacggtgccaaaaagaagggaaaaaaacaaaaggccgggggattagcgcgctgcaaattaaacgtcccccgttgcgggaacccacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgacaaggaatcagatgatacttgccctgaaggagatatagagaaggataaggaagcccttggaagtgtccaacgcaagagaatggcgcgatcaaggggtggtagtcaagcatcccaacgagaacctctatttaagtctaggatgcgtgatggtgaagggtaagtttaacaatacatcttgctatgttttttcatcattgattcaaatgcataatgggtgcttcctgaccttgatttaacaggtaaaaacattatttatttgatatgtttctgtatttgctttcttgcagatctcaagggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcaaaatattaggcttaaaatcaaagttgtccaaaccccgcacggactataaggaaccacaccgttttccctttgtaactcctttagccgcctttcttgttcggaactttcgcttaaacgagaaacgtgtccctttttcccttctggaagcggggccccttttttataagttacacttgaaggttctccaattcggtgagggcattctcttcacattgtgttggtggcccaacacctcgttaaaccacacacctgcgcttttcgggaatttggtgtggggcccacccgaaaaaacaattattccctcgtgaaaccttgtacagttttcccacaggatttgcccgctctcaaaatcttagagggccttctccgcttctttaaaaaa

SEQ ID NO: 54058 - DNA, 14544 bp, Oryza sativa
  unsure (1)..(14544): unsure at all n locations
atgcngccgtgtgatggataacaacttttaatataaaacggagggagtattaactattccatccaatcatatttatgttagtatttatataaacttttcaagcagtaaccattaaatatctaagtctggaggaagggctggtccaattacacatgttcgagtcgtttgttaatttgtaaatttcaccagtcgaatgtagtgataatgacactacataggagggagtatataagagtttttttaactgatatcctggctatctagatttaaaatatttttgtgaaataaaacgattttactatttactattgataatgttgccttaaataatccttggtaatgaaagtatatatgcatccgttataaaatataataacggaggcatatatactttcatagctaaatgttattatattttagtactttttttagtgaagttttttagaactgtacttacaaatcgacctgccattctgattcatgtataactttcatatctcaccatgttattgtggagttgtggagaaggggaacaacacaacttttcggatagagatggaataaagttttgcaaacaaagacatcggttgaaatggattcaacttgttctacctacgatttattttgagaacgatttattggatctttatttgtccattgtgcggcaggttacaaactttctactagtacaattatgtttttttacattgtttagtacaatcatgttgaataaataaaccgatgaatgtccttttaaaacagttattgttattagtactacctggcatattttatagtctagcagacgacaacagttagtactgaagcaaagttatcaatggatgaaacgatgtttatttaagtacaggtgattaacaaatcttttgaaaatgaaggaaatatcaggagaacaaacaaagctggaggaacagggcataaaacaaagtgcgccgcttatccttatacttatcaactaaaatttaaattttcaaccttaaatttaaaagtgattttaggttttttaatcgaaatttatttttgagtctttacttttggatcgctaaaacacatatataaaagttatattcacagattactttttatctgcaaatataccgaaacaatggggctgaaagtggaaaaaacagcgcacagcacgtgaaatggcacttttgcagcttgaaccttctaaacatcattaatttggtacacgcattaatttgacttatgactccttttcttttcaagcacttcaattcattttgataattgtacgacaaaagtgcccgaatttttaagattccctacaactggtccatcggttcccgtcaaaaaattttaagattcatcagcccacagactagtggagtactactgtaagccaacattaaaacttaggaagtactgctgcattaaaaaaaacaatcatatcaacgaatctggattagtgtttatccgagtttataattaggatttattatttgagaaaattccctatatacccctaaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccataaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcatcacaaatatttagtaatttattccttattggttttcacaactcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggcatatagggaattggcccttattattttaggaccgaggatcggatatactactatttatttatttatttattgtttctgataaagccgaacttaaaacttctggtacgagcatgaagtctgtttaaaagatatatttaggttgcgacttagtacctccatttcaaaatttaaatcttattttacaatataggtatttctatcaccatctacactacttattatatcatttacttttcattcaaatttcttctcatactacccccaatcatctttttacttaaccctctcaggctctcacatttattgatgaggcatcaaagtcttttcttctcaactttaatatctaatactaaataacatagaaatgcttatattttaaaacagagaaaatataagtcgtgagtcagatgtagcttaaaaaacagttctgaataagcttatgcttgataggttgatcaactacaattggtaacatgtaaaacataaatgaagcaacaaaacataatttacataaaaaaacttgtatatctgtgtttgttagtggtttaatagcctatgtaaaaaatagtctacgattaaaaaccatgaaaccaacttaaatttcaaaatttaaaatttggttgtgactatatgctacaaagaagatgatgagaacgttctatttttttttattttgaagacaaggttatagtgataaaactaacttaagaaaactctaaatcaacactgaaaattggctctaaaattgaaaattggctttgtcttactcttataaccgttttttctctcgtatggaacaatctactacttttatatcctaaaatagtaatatataatcggattaaatgtaacttaataagacgaattgatttgtctaatttcaatttgggactctttctaggttgatttttttacggagaaaatattttaccacgaagtaaaatatttgtatatgattatcaatattataatagtactacttcattaagtaggcaacgcggtgatggagcgccgcgtcgcaaactcgcatggcgtacgtgtggcggccggcagcgagccaaccgctctcactcacctgcacctgcacggcacgcggctgtatggacgacgtgtcgcatcacgtgatgttggcggcagcggcaacaggcagcaggaggaggaggcagcaaaaggtaagaccatatttagatgggattttaagtccctatcatatcggatgtttagaaactaattataaatattaaacgtagaatattaataaaactcatatataatcttggactaattcgcaagacgaatctattgagcctaattaatctatgattagtctatgtgatgctacagtaaacattctctaaatatagattaattaggtttaaaaagtttgtctcgtgaattagtttttatttatgtaattagttttgcaagtagtctatatttaatactctaaattagtgtctaaatatagagactaaagttaagtccctggatccaaacaccacctaaggccctgttttctccaactaaacaaggcgttaggacctgtttagttctgaaaaaaaattagatgtcacatcggatgttggaaggggtttttggacacgaataaagaaactaatttcataacttgtatggaaaccgtgagacgaatttttcgagcctaattaatccgtcattagcacatgtgggttactttagtatttatagctaattatggactaattaggcttaaaagattcgtctcgagatttcccctctaactgtgcaaatagttttttttaaaaaaaattctatttttaatgctctatgtatgtgtgcaaagattcaatgtgatgtttttggaaaaaaaatttggagaactaaacaaggctttagttcccacgaaaaaaaattcgccctatcacatcgaatgtttagacacatgtatggagtattaaatatagaaaaaaaactacttcctccgtttcacaatgtaagactttttagcattgctcacattcatatagatgttaatgaatctagacattagtttcacaagtaagactttctagcattgcccatattttgtgggcaatgctagaaagtcttacattgtgaaacagagggagtaattatatagattgcgtataaattacgagacaaatcttttaagcctaattactacatgatttgataatgtggtacaacagcaaaaatttgctaatgatgaattaattaggcttaataaattcgtctcgtagtttacaggtgaaacatataatttgttttgttattaatctttgtttattattttaaatgtgtgtatgtatatccaatgtaaaacgcacagacttttcagcctgaagctaaacaggcctaagcatccgtcgtgcagccgccgtggcagcgactcggcgggcggcaatcagggcttgtttggttggtgccctgagcactaagcctgacaaatttgcatgcctgagaggcacataaccagttcatgaattttgcctgtccagacagcctgtgaccttacttgtttggttggccaccatggcctgagaaaaaagactacgattatgcttcacacaattacagctaaacatgtttatggcaaagaaacaaatcttaccataaaattgcatcgtccctccaaccaaaataaatctaaaccatggaaaaatcaagcgaatgcatcaagaagagaatcagaggagaacatgagaaaagagatccccaaatccaatgtatctgacatcaagaagaaaaagaaagctgaatacgagaaaagagattcccaaatccaaccgcatcaaccttccattatttctcacatctgcatgctaagcctaagcaagaccataggaattcctcacatctacatgttaagcaagattaggacacaagatccagcaggcggcggcagctgcttcgtgtggacggccggatccaacgatgcagcagagaagacggcatctgatctgacgaggcttcgtgcggttgcggtggcgccagcatcacacgttgtcgtcgacggtggctgtgctggcttcactcattgtcgtcgtcggcggcggcggcgacggcctcgtgtgatgtcgacgacagcggctgcataggcttcacttgtcatcgttggcggcgacaacgacctcgtgtggtgtcggcagcggcggctacgctggcatcggcggcgactcgtgtggtgtcgatgcgacactggtcagcagcagcatcccgcggcctgtctaaagaggattaggaatgtaactatagagtgctgctacgcctggagctcaggcgaccgtttttggtcgcctgactcaggctaatcccacgccagagggattcaggccaggcgagggagaatacgcgtcaggctagtaaccaaacaaccacatgctatgctcaggcttgtatcaggtcaggcaaattttcctcagggtagcaaccaaacaggccctcaatcgatcactttgttttctcgccggagcaacagtggcagtgatggtgtctgtacatagacaactatggcgtccacgtgcagctaattagcctgtagtaggagtaggagtatatactttggcagtttggcacatgctaggtgcagatccttcagccacatttcgccgcataatgcgaccaaaagctgacttgacaaaagctgcctgctttaccctagtgtttcgtgtgtgcttctccactatttgtactcccttcgtcctcctataatattctttaaaaaaagttcaaattacaaacaaagaattatccctctcaatttaaatccaaacattattttacactctaaatattttaaattggtcaattatccatatatttaatctaaagtggttttgattgaccgtgatgtagacgtggtagtccagtcaagaaaaaaaaagttgtcccacacattagtggttatacctcggcgcaccatgtcctagctgacgtcgacctgccgctgcaactgtccacgggtgagctggacttactgtttacccccgtgcttttctgtccacgcatgttgtttttcttttatgaggtgagtccacgcatgttgttgctagtggtgcccaccaccttcgcatcccagactccgctcgcttagtggtaattgggcgccaatgccggagttcaaagtccttgttggtggtactggtactagcaccactccccctgttcatgatcggcccgcctagtcggcaccacatcaaacgtcaacaacggtggtggtgacttcaccatggctgccacaaccgtcatcacgggaacaggtgatggagccagctagctaacgtgacgcttcttcttatttgttcttcttcttggccttgtcttgcactagagaatcatgtcaaatcaaagccaaaaatcactaggaagtaggagcttgaggtggcctttgtcgtctccaaatcgagatccacttttagtgccttcctagatttgcctcagcctccaaattgagctccatctctagcgccctccccaatctgcctctaggctccacagtcggctgcttcctccaaatcaatctccggctccaccttctccttcttgacggccgcaccgtactcatcatgatgcatctcgatgaccctcctccctgacaaagccgggtgccaggaccaatctcggatagccacgacatcaacgacaaggagtaatgccatcaccattaagatcctcatacatgagttcctcccatctggtcaggtagccgatcgagcaaaaatacttaaaaactattactggctactaaaattaatctttgctactcagtttcgaagtgttattggtaatacaacactacgtctatgttaacctaatgaaaaagcgctagtgtacaaaacaacgacaggatgaactaagaatatcctcacaaatgctactagaagcctagaacccctattcaaaactaaatcattcatccctattttctaagttgcaatcgacacggttgtacccttgttaatcgtaatcgaagggatatgcccacgaagatgccaatgtcctggtggaagaacaaatggactaagggacacttgacgtggccattgtggatcctgctaaaggattttgttactctacaattagtaggacatacttttttttttgtccatgaagaaaaggtagcaattattcttactactttacggaagtgtacgcagagcatgtacaataatgatgattcataatccattctatagtttgggcttattttgctgaggatgagagagaaaggagcaactcgagcatgagttaggagcaaacatagttatctgaaatgttgtattaactccgtttttaaatatatgatgactattttcttaaactgtaatcaacatatttgttcaattagtcaggtatatgtaaagtgaaaatagtatcgtcagatctctctaaaaataatttaagctttatttgcttatttgcataaatatttttataaaatacaaatagtcaaacaaatttaaaaaatcaactgcatatatatttaaaaaataggtagtaccatccttttatacagtacataacttttataaatactaagaatatttaaatggtctctgaatgacatggacatcaaccaatcaagtgccttatatatatatgattaattaaacgtgccaaatcaacttttagtgaaagtgccaagggaattcaggccaagttagctcccacctacatttcacaactcacaaaagagcatgtaaaaccaatcatgctttctaggattactgcagatgctctgtagccccaacggagagcgcgcgggtgtccttcataagtatataggtttttaaatcactaactcacatcccttcatttttcgcactcgcacttttcaaaccgctaatcggtgcggtctttataaaaattttctatataaaagttgctttaaaaaatatattaatccattttccaaaaaataattagtaaatacttaattaattgtaagaaaatggtcgctctgttttgcgtgcgcgggatgtgagttcccaacctcacctcccgaacacagcctaatacgtacatagaaaagatatctataaattatttcttttatatataataagttgcactgcttataattagcatataaatgaaatgctccacgtgtcatgttgatcatatggttccaaaccaagcttgttaggttggaactagcaacctcgatagtatgtccttatcgtggatggaatcatatataaatagttgagggaggcacacacatggtattctgcttggaaactactctaaaatattattatgcttaggagttaggcgtacataatttaatttaaggtgtatttgagagggggggggggaaatggaatattgagaaatacataaaacgggatgagttattagcacataatgaattgagtattaattattttaaacttgaaaaataagttaatatgattttataaagcaaccttttttaagaaaacttttgtaagaaaacaaaccgtataactattcggaaaacatgaatgtggaaaacgagagccttttctcccctttgttcttgtccctaatttgtgagaatatggctaagtagtattcataaatgttgctagggttacaacacattaattgattgtagagcattgctcagcacaataaggtatgtcctccacgagattatgcaatttcgttgaattataacatagaggtggactggaccaattgcaagatggtgtcgtttaatttaatttgtctctttcagtaggtttcaactatttttaccactatgccgtgactttttggttgaactagatgtgttcatgggtcaaacctgatctttcgatgaccgagatcataccttcaagtgttctaactaataaacccaaaagaccaactcaaaattttctcgtaaattaatgaggctctggttggaactcgagggaatgtcgctacggaaagagaattatttgctatcaaaactttaacaaaaatgtttggtaaaagctatacatttgtcgataaattttctcttaaaaatttgataaatataatatgtaactatcatacaatttgtatgtaactttcaaaatcccatgataagatgttaatttcgcgaactagaggtgcacgctatgattttttcccaacttgcatgaatcttgaggtaaattaaacggtttaaaattatgtgaaaattacatacaagttacattgaagttatttatgtaagttacaatgtaattacactataattaaattgtatttacatttgacaattttttggaagaaaaattatcaacaaatatataccaaaatcaaaatgttttccatattttgaaaaaaaaagcttctaggctatcatcagcctatcatgttgaattcatgatcagtttgaagagagaggagaggagagagaatgaagatagaactgttttgaatggagaaataagagggggaaaaacaaaaggggagtgaagagaaagatgaaagggatagactacgctctctgagaaggacatggaaaggaaaaaataaattactataaaacattagaacggtatatactactatctccgtcccatattacttgtctttttgagtttttgattgtcaatgtttgatcattcgtcttattcaaaaaattttagaattattattaattttgtttgtcaattgctttattatcaaaagtactttacatatgacttatctttttttatatttgcactaagttttcaaataaaacgaatggccaaacgttgcaaataaaaagtcaaaaaagtcacctattatgggacggagggagtacattttagtgagttgaacaaattgtactatttgataggcatataatgtgaatcaaattaaagaattaagattctatttgatctgatgctgaaacaagccttaccaacaatgttttctttttaaaaaaaaatgcgaagaagtgcccaacccattccattgcaaacgaaagttatgtgcattggtttgtattaattaatcaacctcaaataaaacaacacaccacacaccctaccagtatttttgaacagatcaaacatactgacttatctaatttttgacttactaacatgataagatatatcttttacaaggtggcaatgcacagaggcaataacggttgttggtgaaaggtggtggcatagagtgaaagacctagttaatctagtattgaggttggtaggggctggctggcgaagaaggaaaattggtgtgagggtggacacgtgctggcattgtttggtggttgttaagcttgtgggcgtttagggcacaactacaaggtgacatacgagttctaggagaaagcccgatctatagtattctaggatagcagtggcaatgcctttggatgctgcaactatcttcaaggtggtgtcgaggtgcccttcttcctatccgatagaaatttttagatgaaatgatatccagatatccttggacgggcaataataatgtcttcatcgtcgcaactttcttggtgttgtcggtttggaggatacgttttttgagtgcgatgtaggccggcgatgattggtcttgaatagaggttggttcctaaatttgtgctatgctatctccttcctagcggtgtggtctttttccccctttctttcaggactatataggtcttgtttggatttagggactaaattttagtccttgtcacatcggatatttgaacactaattagaagtattaaacgtagactaatgacaaacccattccataaccctagactaattcgtgagacaaatctataattaatctatgattagcctatgtgatgattcagtaaatatgtgctaattatggattaattaggcttaaaaaaattgtcttgtttattagctctcatttatataattagttttgttattagtctatgtttaatacttttaattagtgtctaaacatataataatttataatttagtccttgaatctaaacacgacttataggtagtctaatattttttcatgctacgaagtaccttgatatggaactttgtacagtgcgttttattccaaagagaaagatgactataaagtagtaaaatcaaacatgtgcttgaaacttgctttttcacaagttcatccattatcccgaactagaatctgctcgagcgaaagcaatctatcctcctagagtcaaacatgtcataatccctgtcctcctcagttcgtatccaagaatgcgatgccaatctccaggacaaaggggaaggcgaggacggatgatcccgagatgccaccaccgttgtcgccgtgtttacgtatattattacttcgtcgggaaaaaaaaatagtaagaccccgacagaataattaactatctgtcacttttataagtggtgttaaattatttatcaccagaccatatgctatagatcctatatgtaatagacagcgagtgaaaaataattaattaccatcttttaaaagtgacgagaagtttaatgtcctagccccgacgcaacacaatcacataaaaaaaatttccagggggtctgggtgtaaaaagaaaaggtggaattatgtgggagacgcaggggcgtggatgcaaaaaggtgggtgcgtgtcctcgaatccagcgccgcgctcgcagcttcccttctccccgtcgcagcgggggtgatgactcagcacccccatccccacccccccaaatctcctctctctcctctcctctcctctcctcgcgtataaagccggcggccgcttctccgtcaagctccccccctccatgacgcctcgctcctccgccgccgcctccgcctccgcctccgccgccgccgcggcacagcgtcggaaaccctagcctgcgcgggggcggccggaggacagggaggttgtttgtttgtttgtgtgtatcatacggatacggcggcatggccagcggcgccgagtcgtgcggcagccgcgggggggagtcgccaccaccgccgcggacgcggggggcgtcggcggggggcaggcggcggaaggcggaagcctaccgcgaggttctccgccggatccgcgggggcggcggcgcgctcgacgacgacgagctctgggcccacttctacagcctccccgccaggttgattttattttacctagtataataccctcttcttcttctctctcgccgcctctgctgctgctttgggatttcgacgcctcgggtttcgtgcgcgatgaagggaggagcactagctgctactgcgcgtgtgctgtggattctttgggggggtccagcggatcgcactgcaggtcaggagctgtgatccatggccgctacagctaaacatcatgtgtgggtgtgtgtgtggcttgcctatgccctcttccctttgctgctgttgctgttgctggtggtggtggtgaaaagattgcatcggcggtcgtgccgtaggtcgccgtggtccacgcatgctgccactcgcggatcagggattcagaggtcggggagatacgcccgctggcatttctctatctatcgatctctctctctcctcttcggttccagctcttcttgttgtttgtttgatggccatcaggccaagctaccaccaccagcacctccagcaggagcagtagcaggctagcagctagctcggtcgtgtagcaatcactagtacaagcagtacaacacctcgtagtacaagttgctgcctttttgcaaccacgtgaggaggaccatactgttttctttctttttttttctctctctctctctggataagaagagtagaagactgagctatgcttgtcggcatacatgtctgatattaattccatctctctcaagaaaatgaaaagatgtttgatattgactgtttatcaaaacaaggcttctttttatttttttcccccgtgaatagttatccttgtccagtatatgtttgttctttcgtaacaagtatattttgagctagcttgccttttatcatgccagaaatgtgctgctttctgcattcctcgtaacgattggcactgctttctggcgtgatattacacctttctcgtctctacttcctttggtcattttgtctctgtgttccatgtgttaaattctgggcttgtcttgccacagtacatagcattagtcattagagtagagccttaaaccaagaaactaagcaaagcttgttagataaagtgctgcagcattgcatacacatgcctttccgaagcccttagcttgaataagcgacatgctgagaacttgctacttgctagcattagcttgaataagccatgcatgttattatgatctaattgcagacatgcttggcttcatgcattgaacaggtatgctttggatgtgaatgtcgagcgggttgatgatgttctactgcacaagaggttgcttgaccaggcccgtgaaccaatgaatgggctggtcttcgatgttcgtcgttcgcaggtgattaatgcataacatgacctgtctacctcttttctgaaaccgactaggcatcgcttgatgaccgtcgcatgctcgtatattggctagtgtctaggataagacctcaacattttcataaccaagtgctgttagacaccacagtaccatgtgacgtgttgtgtaatacgatgtaccttttgtgccatccttacaataatcagttaatcactatcctgtagaagtgtaaatcacatatccttgattttgaaactgcatttgttaactgctggttatttttattttatgtacancagctgnnntnngnttttntaaagcttgtctcactgtttcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggcc

SEQ ID NO: 54059 - DNA, 6556 bp, Oryza sativa
  unsure (1)..(6556): unsure at all n locations
cgataaaaactatattgggagacaagataatagaggctagatagtatagagtaccacgagaacgatggatacccgttcaaggtatagattaggaccaggataattttccaacgcgagttgtaagatgaccccgagaatatttcattataaaacaaccggcgccatatacaagatgacacatatatgtcataaagtaatacgataaataagatggaagaagccccccggttaaccctgaatggtaagaggatttgaacccattttattcccttgtggtaaataaatattacacaccccgtcccctaaatggtaaattccccccggaaaaacggttaacaagcccccatgcccttctcnaggaaagatgttaattatgtgtccaaatttcgctttttgaaaaataatttcaatatccttttgtcaagcttctgagaaagtacccaaaacaaacatatcttgtatgattccttaaaaactgttgcatctcgatgtccttattggaattcttcgcatttaagtagctttttggtcgtactgatcctagggtcagtattttctgatatgtgatatcattgcaggtgtttccatgaaattatatttgcatgtgacgataagcctaagcttcttagccaggtaaagtaataattcttattttgagatggaaaatatcttttctttagtagtagcatatcaatttgtgctattggtatgtgaattacattttttatgtgacaatttgttatggccaataaggttgagcctcaaattgctgaaaattctgcccacgtaatgccattaatgcatgcagttgatgttgttgtgaacttcaggttcttagcaatgaaataggtacttgcatttgtaggctacagccaacgtgtagtctgttgatgttacctaggtccaggatatacagtttcgttcagtctaatatgcagaatgacatgcaggcaccactaacatgcattgggtcctatatcatgttgcacatttctgatgtactgatgtgtttggacgttaaatatgctgctagagcgaggtgagcatgattttctatggacaacaggattagtatgattgtgaagatccttgaaaaagtagagttcagtcagatacaatcatacataagttgacagggagattggattattatgagtacattatagaaggtcaactatagaaagttgtaacagagtggtcccttttgcgttcatctgttagttgtggtggactggtgcttttatgttgtgtgctgccatctttagtgttggtaacaatgtcttctcaatactgatctatttgtccacgtgctagtcaaagtatgctaagcacttcatagaaattaaagtacctggttatccataggttctgctctgtaaggacacttaattggcaaacacatgtacactctgcatgagagttcagtattttcatgagtgaaggtaatattaggtgggttgaaagttcacttgtacattctaaagataaacccaaataagaaattaagttttattgcacctgaacttatttccagcttaatttgaagacttgcatgtttttatctgcttttccccaacaatgcgttcacatcattttaaacccaaatagccaaatctgtggttcagctgctcacattttgcagaattcacaaagcatatccagttatatgtggagttgtgtgtgtatcatgatatcacattgcagactttatggttttataaagttgtgttttttttttggtttgttttgcctcagttccgcagtgtgaatctgttcatctgtatctgaaagcataacagtaacagtttattgttctgcaaataataattatgaaactttatcagcttcaagcaacacaagggaagaataaaaaagggctgttatgttcaaaagttatattcttgataaacttggttctgttcgctagcttcgcatgattctcagtactgatgtcattatgcccaagttatttacttaattactttgttttggggacaatttacaaaagatctgattgtttttcatccagctaaccgctctacttggggaacttggccttaacatccaagaagcacatgcattttcgacgagtgatggctattctcttgacatctttgttgtcgatggctggagtcatgaggtaacttaatatttatcaattgtagttcctgtaatgaaaaaaggaaccatctctattcttgcttgccaggtgtatatatttcttattcatcttgaatgtcaggccatttaaactggtattgtaatgctcaactacaatttctaccaatgtaaataaatatttagtcaagtaatattgtatattctcagggtaagattgtgaattaaattcagatagtgcgttacacttactttttttctaacctaaaagctgtacaataaatatcagatacttacaaaagcctagagcatacaaaaattgttaaattttaaaacaagaaaatgttcagaagttttataaacctttatggaaagccataaaatttctgaaaactgtacatatatatttgaacagttgcaaatacaaaaattaatattattttcttcgatatttaaaatttttgagattctagttaaatatctgcgtgttacaatgatcttgcaatgaatatgtcgtaaatccattttgatttgattttttaaactaatttgcacaaccactgtatagtttattttagtaataggaacttgtattatacttttagctctatgttcaaagttgctagtagtctattcattatactggatgtttttggaaccacattaaattgtcacgttatgctatatacagtatactgttagcattttctaaaattagctgaaatgttacttgtatctatcttaatataatggtaatgctatttgaatattagcttgtaaagaaggcatgcaaatttgagtgttgctaccaattgagcaactgtagttcaagctaacctaaaaatttcttccattccattgttctaatgctcttgttacccttttgaaaaatatgccaccaccaggtatctatgttgtagttattgtttgacagcatgctaatggcacgaaggaagcaaaataaagttggcatactcagttgcatgtaatgctttgggccctctagtgtactatagcaaatcaagtttgtcatatttgtcataattgtttatagagaaaattgcaatattaggactgcaaacatggtggcttcgttgttttgacactccgtgtggatgacaaatgggcccatctgtgtctatgaaatgtgggtccagtgtcattatagcaaaggttaatgtttgcagtgtcataattgcaaatcccccataagaaatgactcatactgtagcaaagatgcaactattgcagccacttaaatactaacaaaaatatatgagcctatgtttgcaaattatgttacatttttcatacttgtttcttaaaatgaccaggtcgatgttctacgagatgcattaaggagaggagttgaaaagataaaggtaacaagatcaaagaatgcttttcctctaatttggtctgagctgttttgcctacagagcaccaccagtgattaagatcttgttctcagttgttacttttgttcagcaattatattggttcaacaaataacaccctagactcttcggtaaactgaattagcatggacccatataattggcgtacaccagtgtaactgttataataattagtatactttagggggtgaaaattaaatggttctgagttcaggatgaaaattggactttggaatgtaggtcgatggctgtagatttttttttactttaaataaccatgaggaccaatctgcaaacgaacaataaaataagccctggtcatgttatgtgcactttagtatttaaagtccatttctgtgtggatttgcgtcttctaagttctttttaaatattaatgcagtacaaagcatggccattggttcagtccatgcctactaggacaggtcacgagctaatggaggattctcctccagctgattttgtccagattccagctgatgcaactgatgtttgggaagttgatccaaggcttctaaaatttgaacgaaaattagcatctggatcatttggtgatctgtacgttctataatcttaattaacaactccacttttcatgtaactaaattatagctgtgttaatcaccagataccatgggacatactgtagtcaagatgtagcaatcaaagtactcaagcctgagcgggtcagcgttgatatgctgcgtgagtttgcacaggaagtatatataatgaagtgagtgatgagctttgcttatgctgaatcttgtctgttagtttattttaagccgcattttaatttcaaaaagttttccaagaaaaacttttctgtagggtatgaagattaaactttgacctttaatttattgtagaacatattcttagcagctataaaactaatattatgttaaagtactttcaaatatgaatctagtacgtatgattttagtacactgaatgtactggtaatttgactaattgcttgtcgaaatcaacaaagtttgatcttaatgaaattaaaatatgccttatagatgtcatggagggagtaataaactttggtcatgaaatacatctgtaagacattcattttactgatgataaaaactgcactctcgagaataataaatatgttaaagtagttccatggttatattcttaggaaatgaataattcttttcatagttcattacgcacattttaggtttactaaccggggacaatattattgttaggtacttagccaaaacttctcaaatttagaggattattactggaatagtcttaagacacaatgaaaatttagaggattattactggaatagtcttaagacacaatgaatacactcgatttttgttttttcaaattgataagacttgccacctttctacttgatgtatttctttacttaatcctattttcgcagaaaggttcgtcacaagaatgttgtgcaatttattggtgcatgcaccagaccacctattttgtgtatagttacaggtatacaggtctaatgtgtaatagtacttgtgcagaataggccttaaagtggaaacttttctgtttaaattgttcaatatttctaccgtgaatcatgattgatgtaagttatttagttctattctatttcattcccagagttcatgcgtggaggaagtattttcgactttctttacaattttagaggaacttttcagctccctgatgtgttaagaattgcctctgatgtatccaaggggatgaactacctgcatcaaattaacattgtccacagggacttaaagactgctaatcttcttatggatgaccaggtactttgactgcccatcttgttttcttgtcctgttttgcaacatatgtgccaactacagtccccacatcttgatataattgatcacttgaatcttaggcttgtagcataagctattatttctgataccctgatcctgttgagatacttttaaataagatcgaagatggtcaaactcagtatctgttgtttcttatatgtttgcaaagaggccacttgcccatttgtcttttttttgtttttccttcttcctgccccttgctgttgactagtgccacaactgagccactatactgctaacacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54060 - DNA, 2351 bp, Oryza sativa
  unsure (1)..(2351): unsure at all n locations
caaacccccattctctctcaaaaaaggaagcggggggaaaaaaagagcccccccctttagttcaaccaaaaaaggttgcccccggttaagtctcaagataaacccatgtttaaaatataaagtattactccttggcccgaagctttccagcgtgtaaactatccccttaacccctaaattccggaatgacccagttcatcggccttataggagttttgatattttaaacctattgtttattccacaatgccaagaatgttttctttatccttgtaaaggcttcaggagtccagggtttgtgcataaggaaaaggcctacttaagggatatttggtttataccatgcatggtggacttattttcgattccaccttagcaagaaaaatagtgattgcaccattccaaaagcatacatncccncagattttagatcaaancgtggtatagcagtcactnccagnccacaagaagagcaagacataattacggtaccatgtacaattgtaaattgacccgatatatactaccaacacccttaaaagacatcggggcatataatttttattaacatcatatgctgctaagttggtcagaaatcttgtcctgtgaaaggaaaatagtacaacttaccgcatagcttggtctactagtcttcgtggaatcctcagatcttccaacatgctggaagtcaggaagagaacacataagagaataaaatcaatgaatttgatgtcagattgagtatggctggtatcagcagatatcgtcattctaaaaaaatgtatataaggacacaaatcacctacagaagccattgcaagtccatagaaaatgtcatatttataacatagcatattatcgaacctatataagaaaaggaagacacatgtatttgctgcaaacaaggtttaccatggctcattttacaacactaacacagaagttccaatggtcattaactatacatatgatttggacattaaatatagaacaagaaggttttcaaaatagatggaaaacaaaatgctaggatcaatgattcagaaaaggcagagacacggtgttttccaagacccaaacatgtcatgtcattggcataaaggaggaagtacttggagacaaagcaagacaagaagagcatatagggcatgaactagattgtttagcgtacctcagcacgagggagatccatttcagtctcgagcattggcctgtgaggtatctcatcagtgaaggaagtcaaaaagcaagtaaagctagatcaattgtgcttgggactagctactaaatcagcaaatcaacaaatattgcaagaaagggcactaacctgtgatgccaatgcctgtaggtagcatagagggatagcgcaaccaagataacaattaggttccaagtaacgatagtggagtaactgatccgtgttggggccttcttcgtcttgctttgaattagcaattgcttcggctttatcctcgccatctgctattctactcgtgcaggacaacagcgctctctaggaagatcccacaatctaggaatgaaaaaacaattgttcagtagaagcagccagcagcaagaccttgaaaaaacttaactaaaatttgcaacattaggtcagctaaaaaggctgccgttttggcgtcgtcggcaagcaatctgaagtagtaggatataccacaatctatctgaaaagcaatctacccaaagaatcggtagcttctctaacctttttcgcggtggcaatttatccaacgaccagttgcagcagcctcaaacctcaaagtgagggacggtaccgagaccttagcagctaacccttacaatccatcacgctagctaaaagagagggaggtgaggacccctnctnctncttctttatcagtttncccaattcttctagcctnctctatatgtgctgcgctagagcaacagcgaaacccatccacgaagatagtgtgctncaactgctcccccatcctattagnntnccctcngngttcacgccctaagcaccgactgnctcctaactnnnatattntttnttgagaggcnnnnnnnnnnnnnncnncnnnnnnnnnnnggtaggggtttnnncccccgcgggagtgagagggggggccccctaagatnngagagacctcgctcccatcttttttctccgaaattttttattttctgacccctgggagggtgtaaacccccccatattagtggaaggtctctttctctagagatagccaaatattggtatattactattggggggtgggttggcgccacccctcgtctttatattnccttcggcccattctttatttttcnttggtgtcttattgggctgccttttatta

SEQ ID NO: 54061 - DNA, 1235 bp, Oryza sativa
  unsure (1)..(1235): unsure at all n locations
taaactgtttctttttaatactcaaaaaatatactccgaatgggcgagggggggcacaccaacccaataaaaaggtgcttagtgaaaaaagagtgttctccacacaaattcccggtggcagttgtaagttgtatattattccaacaagaaggggggggggaatttccacattttcccaccccaataaaggtgcggcactttccggtcttaaagggaaaatatttttggtggggggattaagcgggcccaaaaatgccaccccctaaatgacttctttgtgttgggacccccttgtgtcaaaccttttatacgaatcgagagcctgcttgtatttgcgttacttaatgataaggaagatccaattatatgaccgtttaaaagaagagttcttcttgaatcctttatataaataagaccctttgaacaattattgttctagcggacagagaaaagagggtacttagnaaaaagttatttaaagtaggtggccaggttcnaaaaggtgaaagggtaaaaatagtaattatttttatttaaattatttttcggtaaatgccaaaaagcggggaacctcgttttccatgatctccatgcggaatggcgcggaagaagttgttcttataagggccggcgtcaattaatttgagatctccggtgatcgatttgtcaatctatctgcaggattgaattgttcgcttgatcgcttcatcactagttggtcagtgggtgtcgtttttctttcgtatcctgtagctgtgatctcggctgcctgacagcctgaggcccttgtgcttctgaaacttctgattaatttgatgatccgaacctgagatgagattgactgccttgctgttagttcgatcattcaagatgttcgatcgattttgattgtctcatcaatgtgcatgatcgacctgctcgagtacccattaccctttgccttcatggtgaatggatttgtgcagtgtaaaaaattttgttcctaaattaccctttgaagattaacggtggataacaatttattaaggaggtacctcaggtaccttccaagcactgtaaaagacctcgtaaaagaatattttcatgtttttgttttatgtgaaaaatatttgttgttttttttctataatcaagaacaaagctgaagaagtttaaattagaaaagtctaatacaacttatgatatgaaacgaaatatagtagtgtccagtcgggtctaatattgcttcatgctcc

SEQ ID NO: 54062 - DNA, 1233 bp, Oryza sativa
  unsure (1)..(1233): unsure at all n locations
ncgctgacaccctttgatgatcgccaaattcaaggctcaagtactctccaccacgatcagatcatagatacttgattgtcttgcccaaatgattttgtacctcattctaaaatttcttgaacttttcaaaggactcagacttatgcctcattaagtagacataaccatatctactaaagtcatcagtaaaggtaataaagttttattatttttccgggtcgaattgccatgtaagcgccatgtcaatgccacgtcaaacaaagaccgagtcaaattagccacgtaggcgccacgtcagccaaaactgctctcaaaaccgctgaggaacataatctgcaccggttttaatagttgagggacccgttgtgtctggttttctgatcgagggacgaaaatcggattcggtgtaaagttaagggacctcagatgaacttattcctcataactaactatgaattccaagttctatgattcatgatccaaatgggcttcaaatttacaatgaaacaaccaagcatcaaaatacactgtaatgcctgcaaaaactgacagccgaatgacaccagggataaatttatacacaactactccatgagacggaagaagcttttagctgccaggcaagaataagcgccttctttctttgcaacccatgggcttctagaggaagccataatcataatcaatttcagcagcaattggaggcgatgtatggaccctcttggagtacagataagtcattttcagtaaggacaacaagctatcagctcaaagctttgctgtttagcgtgatgttgagtatgccgataggggtttttggcttgtaatgctcatcaatatcaacttcttcgatctcctgttaagtcatcaaacaagcaaaaagtctcattaaaatgacatactcagaaaatctaattcaccaggtgaagcacatgcgtctggatcacttgagaatatgacacttgaatagctatattctttcatttggccacctattaaaccatgtctactcttcaaatcctcatgcatagcactactgaactcanaataggnnccatttgtacaatctaatatgaggtaggcatgacacttcactgaaaatttgttttggaaaagttttatttattaaaaatgaagttcctgttgttgaactgccttataaagcttcgaggaattaagtaaaccctgcaatattgcttgtaattgccaaaacacaatgtttcacaggaatgg

SEQ ID NO: 54063 - DNA, 2405 bp, Oryza sativa
  unsure (1)..(2405): unsure at all n locations
tggacggatgaggggggacggggagagaagaagaggacgagaaagggaggtatgtgtataaccagagaaaatgaccggaaaagtactaaataaaggggaaggagatcaccgaaggttataggantaaaaagattgngagaaaaaaaagagagtgtatattttgatacggaaaaagagatatanaaaattataaatggcgggcaacaagcaaggaaaaaaaaaagaggggtcgggaggaaggggggtcatatttttattttgataaaaaaaaaagagagggaatttagggcccaaaaaaaaattgtttttgggagaaggtgacattggacaaaggtggtaaaaaaaaaatttcgagaagagaaaaggggagaactttcccgagatttgaggggaccactataaaaaaggggggcaatgaaagagatacaaaacaattagaggggagaggtggaggagaaacacaatttggggccgaaggtaagtatggatttcaaggagaaaaaagaagggaaaaattttaaaaaccctttaaaactaaaggggttttttattttttttcctcgaagggcaaattaaatttgatacgcaagctcgtctaaatcaaattttttaagtaattatcaattcatattccatcatttaattcattgttaaatatatttttatgtaggcatataattttatatatttcacaaaagtttttgaataagacgaacggtcaaacatgtgctaaaaagtcancggtgtcaaacatttcgaaacggagggagtagcaaatatgtttgcgctacaaacacgctgctacatgtaaagcatcatctcatctcagactacagtttatcatacatcgcatattcaaaaccaaaaccagtttatcacactgtacttaataaatcatagttggcttcttgacctcaaagaacaaatattgtgagcattaagcatttagagttgctaatcggtgagcatgatgagcctgcttcaaattactcgcattgaagttcatgtgatcttgctttcggtgagcataaaagcacttcacaaataaaatgtagtgtttttttgccttggaagtattgtagaatacagttgtcttcagatttcaattcatcaacctctaaaaagatttcatttgttgctttgattacattctttgcatgactaatgacacaggaatagcctaccaagcaatatctttacaagaaactggattcaagaaccttgcatgcaaccataaaggtttatatattctgctgcaaactctaaggtatcattcatttatgcaagatacaagcaaccaacttcatctatttggatccaaaacaagtgcctagactatcaaccatattaatagtatcatgatgctgcgatcactagctgtctaactcattactgcaatgtgtgatgtgttatcaataaaatagaaagatccattatgatcaaagtattcaaagaaataaagctgatgccaagaacacaagaaaagaaagaaattttgcaaaggaaaggaatagggaacacagaagaatctgtccacaaaaagaggtacactagagggagaagtgcacacccttttgctgaaaacttcttgtgtaaaatcttgaagaaagtttaatagctcatgctcccttcataaatcaataggggtctatttgactgagtaagaattaaggagcttacgaaattgagaaagtaggagagtttggaactaaaaatgcattttagtaactgttttggaaaagaagagagtggatgctttgtatgggtggactatgcaagttaccatcaataggagcatgataggaaaaggacctttaaatttgcatgcaagccttatatatttatcaacaatccatcttaaaattatatggattacatatctagatacttatactctaattgtatctttcatgaaataatcagagggactgaatatgacatgtttgtgtggaattgcaccactgcggatagccagagagtccaacacaaacaaataatgccccaaaaatgatcatagacaagtcaacatccatgtagcattatcatgtaaaagtataaaacaagattaagcaaagattccagtgctcaccacaagctaacaaatctatccacaacatcagcagaagcatctttgtaaatttctatagtaattgagcctttggcagtatcaataacctggaggaagaaaattacaatagcattatgttcagtgaatgcttaagattgttgcattaaatattttatgtctactcagtaaggtcatatgcacaaattcccataaaaaaaggttatatgcatcagatttaatttcctatatttacaggcaatagcatacaatctacttctcttactaaaaaaatgcttgactgctaataattagcatccaaacatcataagttcatacg

SEQ ID NO: 54064 - DNA, 2141 bp, Oryza sativa
  unsure (1)..(2141): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaccgggactaaagagagggtagcggcagtcccattagatctttttttttcattgttttttagctagagtttaatccctatattttctcccaaatcaagtgggatacatatcccaaatcaaacctcaaatcaaagtaacatcccaaaacattcacattacaaatcttaagttacttatacacacaaatcaaatacatcacaaatcttaaaaaaattacacacaaaccaaatacatcacagattatacatctcaggtcatgcaacaaatcataaaattatacatcttagtgaatcacaaattgtaaaaaaaaaaaagatgccggtagcggctgccgcctgccgccgctcgccactgggcccgtgcgcggcctagccggccgcctgctgggtgggaagggaggagggggaggagagggctgcgtgggaagggaggagggggagganannnccnnnnncngnnnnnganagngnggnggcggnnggggaggaggnattagacctatcagaaaagatgggggaggaaccacacctatgtatacgatgcgtaatataggcattttaaaatatttaacggtcaactaatggtccactaaccggaatcnnnnnnnnnnnnnnnnnnnnnnnnnnnnnnnnnnnnnnnnnnnnnnnnnnnnnnnnnnnnnnnnnnnnnnnnntgccctttcctttactgtcaacctccataacttggcgtaactctcggtcaataaaatgttttctcgctgtgaaaaagtggtttccctccccacaattaccccaacanancgagtccggatgcattaaacgtggccaaacctggcggttcgcccaatgagcggagctacactcaccattatattgggcttcgcgctcaacgtccccgcctttcacgtcggggaaaaccttgtccccgccgcgttgcctctattgaattcctctacccccctgcggcgagagggtgtttggctattaggagggcgtcttctctctccttccctacaataccattcttcccctccccacggtccggtctcgctcgggcggctgttcttttttccacccaagggcttcctctcttttctcaacttcttgnattttcgtctcgaattacacttctcacctaaatccctccccctacgctcactaacctccttaagagcccccttcgtcggccgtttctctatcatggtccctctccctcccgtcggtcccttctaactcccctctatcaaagccgggcgggtccacccgtcgccgcgttctcgacaccccagcttctcccccctaaaaccccctccgcttctactctacgccccttctctatcacccccc

SEQ ID NO: 54065 - DNA, 1158 bp, Oryza sativa
cgcgatgaccatcagctcatacctgcgaaaacttgcagtaacaggagggggggaaatgaaggaactgtgctccacagaagtcaaaaatataacttcaggtgattttcaaatagttaacggtaacagctcatacctattataatgtgtttccaagtatatgacttggtaacagctcatacctattataatgtgtttccaagtatatgacttcgccttttttcagcctcgcagaaggatataatgactttttcaatcccttgtctgccacaatgcttatgctgtatttcaacctgaagtaaagtaatcaggtacatggttagtaggagcaaccttagctcaacaaaaacctagacaaaggcttctaaaagctgaggagttgagcgctgaaacaaacaagcactcatatgcaacagaaaaggctgcagtacgtgctggatggaactttcatgagcaaatgagtagcatcagatggtaggtcaagaaagtaccatggctcgttgcagagattgtactgtattgtgacttccccaacaaatcttttgtgacgtaacgcattctgcatagaatatatcgaaaaaaaccttagtacagaatatagacaaagattgctcatgataacaaaaactaaatgttgcaagtgaagtaaaatgtctttgaaatgaaaacattgataacagaaagaggaagtggaaaattacagaagctgctgctctttgtgtcattgtgcgctcaaccgcaactcggagcagtgtaggcttcaccacttgatgtatggcttaagcgaagctcaagataatagttccaccacctttgtgcaaagcatgtatttcaaacttagcaaaaaatctatggagagtgttcaataaaggttttttcatcgcagattcaaccacacgaagcccttaaaattggttcaagcaaagaaaacacagtagcctatatgtatttttttcaacttaataccttaccatgcaggggggtttattggtaaagtaaaaccaaaccaacccgcaaggccgtgaagggcattggttctttaggttaagataacctcggaagcgcaccacaggtttaacagcccctctattaaccatatgctctcacctttgaggttaaaatggcacccaacaaaaagagactctcttttttgggcggaca

SEQ ID NO: 54066 - DNA, 11871 bp, Oryza sativa
  unsure (1)..(11871): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagatgataagtatccaaatgcactttctatgcttggaagtcttgaactccaaggtgatgaaacctggcttactgcaaaggagcatttccgtgaagctaaagatgcttctgagggaaaagacacatactctatgcttcaattggtatgtgagcttacttaactctagtacatttatctacttatcactttactggtttgattaacaaccttttgttcgaaaaaggcagatggtttgtgtaccaaattgggaacaaacttgttatagactttgttcttatttttcttttgaaaactaaagcccaaatggggacttaaattacacaggaagatatggataagaattgttatggttaaagtgaagaagtaaactcctcgttatgaattagttgcctgtaattactgataactttgtttggcgtgtaatgtctggacaagtgctaccagctggcaggagatgatgcattgagctttatatattttgaatcactagcatatcaccaaatttaccattgagttagggcatgctagcataatcttagtttgatgttttcccacaataggtttacatctgctggtttgatgcaatcattttatgtaactaatcaattgttttttctctattttaaaaacgatttttccatgttgttacaggggaactggaattactttgctgctaatcgccctgagaaaaaggccccaaaatttgaggccactcatagggagaaagccaaggaactgtattcaaatgtatgttgctttatgctcaacaccaatttcagaggatcaggattatattttgtgtaggttggctgattaaatatacccgatcacctgctcagattaatcttgcctttaacggtttgattaatttgtttacttggtcaaaggagcaaatttaactattagtagctttttaggaatttagcaaaaagttcagttttagcttttcttttttcctttttgggtaaagtctaatgtttagtttaacttctattttcttgctatgctaaatcatcgactcctgaaaccatggtttcctagaagttgcaactactctccccaattgaaaacaatgaaataatagaattggtgtagtcaatttatgatgatgtccaaagacatcatctacaatatgtttctgggattcaagaaaatggtgagtgaatttgtcataaaagtacttccgtaatactacccttataaatatattcttttaaatatatgatattaaaaactagagggtaaggtggtatctcattgaatttgggaaatcataaaagtcacttccatttgaaatgcaattatgtagtctatagaaaatcaaggaaatgaatagcttgatttggagctattgtagtacttcaataaaatatatggcacaatgtgataatatgtgcactcattgtttggatgcactttggtttgatttgttgtacacatgagcaagtattgcttacaaccaaatcttgtttggtagcagaagcatttggtggggatagtgtggccgcattaagtgcttgttttgctcacttttgagatctcaatgtctgatgcaggtactaaagcagcaccatggtaatatgtttgctgcaaatggtattgggatcttatatgctgagaaagcccaatgggatattgccaaggagttatttacacaggtcaggggagactactattcatcattctatatgattactgtgaattatgagaaatttacattagcaatttgaaatgaattaggtacatgaagctgcttcaggaagtatatttgtccagatgcctgatgtttggataaatttggctcatatatattttgctcaaggtttttttcagcaagctgtgaaaatggtactactctctccacatagacagacatgcatgggcagataaatatttaagacaggaaagaagttgataaaagttactgattctttcttgcagtaccaaaactgcctgcggaagttcttctacaacacagatgcaactatacttctatatcttgcccggacacactatgaagctgaacaatggcaagactgcaggaaaacattgctgagagctattcatttggctccatcaaattatttattgcgattcaatgtaggtgtttcgatgcagaaattctcagcttcaactctacagaagacaaaacgaacagttgatgaagtcagtactgctgctttcctatagttggtctctgtttatttgatttttgaaataaataactaaactggcaaaaactcatcaaattgacctttatgttattttaggtaaaatgaattggggaatcttcagccatagttacttatatatctgaattgattgtgtttagagatgagattatgaattagagttgtaatatagaaagaaatgagtacttgtcattctgattgatatttgaaaaatgtatcatcttatatatttactttgaaaaccttatctgtttaatcttttttctctatttccaggttcgtgcgacggtctctgagcttcagaatgctattagagtattcagtctattgtctgttgcatctacataccattcccatggttttgatgagagaaaaatagaaactcatattgagtactgcaaacatttgcttgatgctgctaaggttcatcgtgatgcagctgagcaggctgagcagcagaataagcaaaaaatggaagttgctcgacaaattgctttggctgatgaagctcgccgcaaggctgaagaacagaggaaggcccaggtataggtcttgctgtatttacttcattgtcaatatgctgatgataagattacaagtttatgcctaatgggatggtgttaacagttagaaagaaggaagcaagaggacgagctaaagcaagtaatgcaacaggagcaacactttgagcgtgtcaaggtattttatatgttattcatattttagagatattttcttgtttcccaaggatcaacaggatttttgctttacttagagcctcatctatcactgattaccatgacatatggtctcatcaaccctggcctcttctcgtagtttcgttattgtgtataatattttttttaaaaaaaattgcacaagtatataaaagatatctatctcaaatgtaaaaaaaatattttttcccatgaaagacagatttctctatgctgtttgaaaagataaaactgtttgttcgtttgccccatttttggtgagaattggctactttcttgccatgttctatcgaatgagtttgaaggaacctttaggctgtgttcgttacttgtagttgggagcaaatctctcccgcgcagaaaatggagcgatccattagagtgtgattaattaagtattagctaattcttttttggaaaatggatcaatatgattttttaagcaactttcgtatagaaaatttttgcaaaaaacacaccgtttagcagtttgaaaagcgtgcgtgcgaaaaacgggaggtgtgagttgggaactaacacaaacgaactcagttaggctcttttgaaacctgataatcttcaggaaatcaggtactagtctggcaagagattgatgcacattctacatagaatgggtattaggtttaacaaacttacaagtcagctgaagataagccttcagatacttgccagttgccaaccttaagtttgtagtttagaaaaatgtcaacgtctcttttatatgggcctcaggcaaacctatgataaaacggctttagttttttctgagtcactttgagccaagtccctaaacagtgttattagctggcagattttgtggtgttgtttgattagtaactttacctctaaaagagattgcaacctaagcattttactacaggattgtttctcagattggaatactgtaaatatatttggtctatgcatgacaacttagaagattattctgatattgaccatctttcattaggagcaatggaaaacctcaagtaacactcctggcaagagaaaagataggtctaagcatgaagatgaagaggggggaggtgaaaagaggaggaagaagggtggtaggagaaggaaggatcagaagacaaaggcacactatggggaagaggaagaagacgaatatagagatgaaccagaagcagaagatgattatgcaaacacggcgaggagtaacgatggtggcgattcagagaaagccccaggtcaccttcttgctgctgcaggtcttgaagattctgatgctgaagaagatgacatggttagtgtttttttttttctttttcataaataacctgtatcccttcatttctatttacaaattatttgcttgtctgctttatcattgttgccactgagttttaattcctttccaagctttgcattgaaagttagtttgcctgttagatctagccttcgcactcttatgttcatttgtattacttttgctatttatcttcactagaaataaaaattttagatgctctggtgcaaagttgccttattttgtcttttcctggctgtagggacaccctcaatctgccatagaacggaagagacgagcctggtcagaatctgaggatgatgagccagtgcagaggccagtgcaacctagcgcaggcgagaacgatctgagtgattgaattagacggtgaagattatggccgaatttgggatcacttcatatatttgtgacgaagaatggctcctgggatgcggaatcaactatagggcgtgctcatatgcacttgtggataattcgatgttgaaatggagctcagacagatggttgaaccagaagtgttaaaaaaatttatctgggagcagagcagtcactgatattcaacaattaatctcgcgtcattctagacatgccatgggttggtggagctaacataaggcaatttgtaatttatgtctagtttacgcttaatcagccagacttttgtcctgtgagcttctaacgctgtaccaattttagctcacttacatctcaggatagctgatctcctactttgttctttgctgctaggcaagcgtgccaagaaaagatttccaaaagtagctgatctcctactttgcacctaatttttcagacacttcggtttggcaggcaactgtacgtgctcattggcattcgctaatatcgccctgctctcgtccaaacaaagtaatggatatatagatctaaagtaacggattttttcatgcgatttgttttcaagttgcaccttttgggccaaaagatttcttgatgactgcatatatgttgcattcatgtatttatttgagaacctctgttggtgaagtaaggaaggaagaaagaagaatgtccttcgatgcttcagttgcatacatgtctcgttattaaaaacttacgtaataagaggaaatacgaatggattcggacagcagaagagtgaatgcgagaagaaagacgaagaatacgaatagtcttgacttgacactactttcatttcgtttcatatcataagttgtatttgacttttctaatttaaacttcttcagctttgatcaagattatagaaaaaaaacaacaaatatttttcacataaaacaaaaacatcaaaatatattcaatattagatttaataaattaatttgttcttataaatgttactaattttttctacaaacttaatcaaactttaaaaaagtttaacttaaaaaatcaaagtggcctacaatataaattagaggatttaataaaattaattttgtgctataaatggtattatctttctataaaattggaaaattttttaagaagtttgatttaaaaaatcgaagtgacttataatatgaaatatgaatcggagggagtacaaaacaatatttattcttcctataaaaaaggtttttttggtcaacaatgagtgcgttgcatagctaagccacgcccttcttttgccagaaatcaacatccgactcctttgatcgaacataacaaacttactattcggatggctatgccgtggaagcgagaaataatgtggtttcactaactagtaatctacaaaccagacggatttttagcaccaattcctttcaaattcttacatcgctagccaagcccaagattgcattcaacagattcgcacaaaaattgcaagaaagcaaattcgttaatttccatttcacccacatcaactgcgaatcaagtccttgggatggacttcgatgggtgtatgtgtagtcgtgccgtcagacagccagagaagaatagtcgggagggatggagaatgaggatgtgatgcttgtcgttgtctaggacctggagaatacgtgaattacacagaagagcacttttggctatgtacaaatattctactataattccataccaagcttgttaggttggaactagcaacctctctgatagtatatatgtccttatcgcggatggaatcataaatagtttacgaaagtacacgtaacattctgcttggaagctactccactaaaacattatacttatgagttagccgtacatgatttaattcgtttgagtatggatacactaccacatagcatctttagagattataggtactgtacatgggcggagctagaacaaaatgtagagggatgccacttgcttaatttactctacatcaagtccttgtctaaatttgtatccaagggggtgcacacataatgaaaatgggtgaggtacagctctaactttttttaccgggttcctgggcaccccatgagatactctacctccgcccctggtacctataatcgtttaaaaaaatgattgcattgatactcgaatcaactgtaacccggctcaaagcgtcagctcgatgcttcgagcaccccctgattcccagccccatatgcaatttccccatccatattacaaatcaataagaacacaagagcatatgcacatatcaacaacaaagacatcacagatcaagaagacaagaacaagctaatcgcattgcagatcagaacaattcacataatagatcaagatcttccgccatgaccaaacattacatgttcaatatatcagactcatcgttacagtggatctgtcaccgccgtcatcgattctcttgctgctcgtctcctttgagccgccgccatcaccatcatctccttctagcgaccgcaccagctctcgagcgcaaacaaggtgatccacggtggtgaggtccaaggcgtctggatgcgatgagccccgaactcaaggaggccggatccagcggcccccgacctccggacggttggatccagtgggaagagagagctcggaggtgacgaggaggagaggcaccaccaaggaggggaggaggaggtaaaggagggggaggtctgcggacggaacatccttcgtcccaaaataaattcacttttaatttatttcacttttgaatagtttcttgaaactataatcagtgtattcatgaatgattagagatgagggtacacatgtttatacactgcttccctgatagagttacaataactaatgttgattggtttcagagcattgctcgatcggtacaataaggtacaaacaaactctatatcagcaacaaatgtcctcaccgagattttgcagttttatcgaattaacatagaggtggactggactaactgcaagatggtgtcatttaatttgtctctttcactaggtttcaactattttgaccactataccgtgactttttttcaactagtagatgtgttcatgggttagacctgatatttcgatgatcaagatcatacattcaatctacgtgttcttactgataaaacccagaagaccaactaagaattttctcgtaaattaatgaggatatggttggaactagaggggattttcatgtcactatggaaagcaaactatttttttcaaattttgaaaaaaatatttttcatatattttaaattctatagcaagtttattccttcatcgacctatcaggttagattcatgatcagtttgaagagagaagtgagtgttggcaacgtttttggtcgcgccgccacgatgaaaacacctaatgctctacagtgatataaagtcatcaaccaccttgatctagacaaaaacaagacggattctgtaagtcaaaaccggctaacagagccaatttagatgaaatagggataaacactcttgcagaatttcgggacaaacctataaagaggattcgcactcttgcggcaaggacggacgactttcagcgcaaaccgatgaagatggacaaaaactagactagaactaggcaaaaagtagatgcgatattgaagattcgattggctaattgtgttaaaagtagattgtgtgcatgattgaaccgaccataaccttttattgccatagctcttataaagaaattggtttgcctcctgtagggtcttctccatgtcttacacggggtagagaccaattagaagtcgaaaaacctcagcccaagcaagtaaacccaagacgcaaaaaatcaacttggaggcagagttagccgatttgatcagccacatgcctcagtcagaccagccccacaccgctgatcagaccgacccataggcggcggttaagccgaccctgtgaaggaaacctagtccctttcaaattcagcaatgttttcctattatgtttctaggtgctaaatttaggtgttaacaaagaggagagagtgaatattaaaagtggttcgaagggagaaagaagaggggagggaaaaaagggaaaaaagaaagaggacaataaaataatacgctctttgagaagaaaatacaagggaaaaaacctaaagagtggaaatacactctttgtctttttaagtcaaacttcttaagtttatagaaaaatatattaaaatttataacaccaaattaatttattgcatctaacattgaacatatttggatagtttatttgtcttgtgttgaaaatattactatatttttctatgagtttagtcaaactaaaaaaattgagaaaagtcgaaacaacttgaaacggagatagtagttattttaccaagtttcatttgtaccaccacatatctaatgttttcttcacttataatgttaggtattgttaccgatctttgcaccttggaccaccttctattcatctctctaactatcttttcgctttctccacctctggttcatgaagattgtcgtcatcattgtcagcgtgcctcattgcttaagcttgagctatgtctctgctcacataatagctatatagcctctgcttccttcagagctttgagctcaagctctaatggaaaaccaggtttgtctctagcagaatttgtatttcttttctcaatttctctttatgttggttcctctttcttttgtctgaaattgtacctcacggcacacctgtgatcaaagatgtatttcaaagatgatagttttctttacgcaaaagatagaaaatctaccttatatccattggattaattaattgtgagtcacattgtagcatagccaaatggcaagaaaaacaacagagaactatctaaaggacagaatttcttatattccactaaaatttcatgtagatttaacacttggtgtactatttcatgtagcagttaatctataagagatgacccctaaactaaattaaatataagatatcagtaaattttgtagcaatctagaagagatggcccccctaaactaaaatttccattctccctcgggccaccgggtaccaaggcatattcttgcagttgcatgccggcatacttcaaaaaataacaagtaatcatattttttctaacctgatgtgatcttcgcgaggctacgagtacgacctccaaacaagcatatcccctcttgatttacttaactaatcagtagtacgtaattaaccatctcctctcctagctttagcaatgcttgatctcgtataagattctctattattattagtagtactctagctattatactaatcgccaatgatactacatgttgatataattaattgtcctttttgtcatctacccctcacatttgttccttctgatcttcttgccggacgccgggtgatcaatgttgctagctagggaccgggttgtaaaattagttagcacaattaattaataatattgcgttgtagggtcatatacaaatttttaattagtatttgttttggtgctcaatactactaatattatactaatgtacataatcttatccactgatcatccacagctagcacaagctttgagtggtacaatcgaggagtaatataatgattaagcaagttaattaattaatggtcgatgtagcggtcaaggaggtcttagattattcgcgataaaattaccttaattatacaggctgtgttctgacttctgatcatacacaaggcaggtctgtactgtactgcaaaggcaataaataaagttgtctctactactgtcaaataaacttttttaaattttttattacctggagggaaaaaacacctcaaatacagatttttctagaaaaaaaagtgtaactcgcatcaattatattggtttatatgaaagaatttacctgtagtcattagtattatttatagatgatgtatcttatgctaaagttttctaaaagggaattagtaaatattttttggaaaaaaaaactttcaaatacgactattttatagttatggtgtaattatattgtaactacattataattttaataaaaaaactaaaagttacttaaaatttatattgaagttatatgtgttttcaatatttaaatataagttataaaagttatagtatatagttacactatatttaaaggtatatttaaaagtttttgaaaaaaacttgtggcagtttttcttaagatagtctcatttagagattctcttgtagttggctggtgcaaaaatgcaaattctctatattagtatcacttggcactggacgagcccattatcaaatatatgctgaatatatttgactataataaatcccttggacttgcctgcccgtattcttttttcctaggcgggtagtttaaacaactactttcctttatttagaaagggtaaaacataattcatatttttagttttcctaaataagtggtttttatttgtaggcttcaataccatcaaaattttaaatgggggagggtaaattaaattttttgacccaaacccccaataggcccttttaatactcaatggggtggatgtatggcattttggaactttggcttccgggaaaacaggagttaattttcttttttaaccttggtaaccaaaaaaaaatgtggtaactttttttgtgaaaaaatgaggttttttaaatgaatttattccttttgtgtttccgggggggggtataaattaagggggggagaaagatttgcgccggcaccacacaggg

SEQ ID NO: 54067 - DNA, 1809 bp, Oryza sativa
  unsure (1)..(1809): unsure at all n locations
aaaaaacaataagggtgttttccataggccgggacagggggaccaacgggggggttgtgctaggacactccaaggtttttcataggctttaggcccacaaccgaatcccatcgattttgggtaagagcccctgaatagctataaaaataccttgaactactgaaaaaatctaggaatttgttcttagtttatgaagcccagaaagcgctcattgtaattggttccattgacgcaagcttccaanccgacaaagattgattttagttcgcagtcggaatttgtgttcgccttgaatgaagccgttgtaggttgaaagagttccaagaaagatcaagtggttgatcctccaccagagttggaatacattgcggcttttgaacaaccaaagaggcttgtttgaataaagaaattcgttcctcagctagttgtgatgactagtgcttctagccctatggacctctattgcgatatagtggtgccattgcgcaagccaaggaacctagatcgcatcaaaagttcaaacacatcttacggcggtattacctcattcgcgagatagtgggtagaggagatgtgaagatatgcaaaatacatacggatttgaatgttgcagatccgttgacaaagccactccctcagcctaagcatgaggcacacactagggcaatgggtataagatacgttcatgattgactctagtgcaagtgggagactgttagtgatatgccctagagtcaatcatagagatgattgtatcacatactatgtttacatatttatccgactttgttccttgaaatagataaactcgttattggttaatgaatatgtgattctttcatgagactctttatgttatgtgttgctatttctaaaggatctctgatcaaatatcatatgtggaacaaatatgtttagatgatcagcacatgtattaattgatgatcatgtctcatagatcatggtatagagataccaaattaataatgtggacacatgttagtgaacatgttgttggatagacccaacataagacacggcccgagccatatgagttgtgtcatcagggatctcattgagtgttggagatgaatccttagacctaaaattatcatggttctcaacatgtgtagtagcttacttacggactgataaacgctactccgcaattgcgtagctataaaagtagctttcgggtatgctatgaaacatgtagtgggatatgaaaaatcaagatgggatttgccccttctatggagagatatctctgggcccctcgatggtgcagattatggaagtgcatggccatgccaaaggtgatngangagtcaatcaccaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttcacgatgttatattggacaccggggccccggaatgtgatccccttgccaggcactttgttgaaaaaaaagcttcgtgaactttcccgtggtcatttatgggatgaaactgcgcttgttacacccttttggccggtgcccgctccgttttggggagaaatgctgtcttacccccgaaaatacatcaaaccc

SEQ ID NO: 54068 - DNA, 1025 bp, Oryza sativa
  unsure (1)..(1025): unsure at all n locations
tggtccnnnntttagttcacatcttcaaatcattattttgtaacaaacaacataagaaatgccgaaaattattctcaattgacctaaaaaaatatctactagaactgctagcacacgtttgacaaacctcaatcagaagaaagaagacaacannnnnnnnnnnnnnnnnnnnnnnnnnnncnnncgnnnnnnnntnnnnttttttttttttttttttttntttttttntttttttttttttttttttttgtttttttttttttttttttttttttnttntttnntttttttttttttttttttttttttttttttnttttttttttttttnntgttnntttttntttttttttttttttttttttttttttttttttttttttcgtttttattttttttttttttttttttgtttttttttttttttttttgttttgttttggttgtgtttttttttttttgttgggggttggggtgggggtgtgtgttttttgtggngggggggggtttgnggtggngggggttgtgtttggggtgngngtggngntggttttggggtttgttttgttttttttgtttttgttgtttnttgttttttggtgtgggggcggntgggtgggnggcggcgnggggtgccgtgggcggggggtggnggctgcgcgcggnccgggtgttttttgtgttttgtgcgcgtggctggcgcgtttgggntgttttggttttgtttttttttcggggtgggtgtggggtgttgtttnctgtcggcttttttggcggnncggcgcgncgtgggntgttgnnctggttgtctgtcggcgcgccggtcgggcggcgtgggcggtcngcgcggcncggtcggctggccgtctgcccgcgccgcgcggtgcgcttgtcgnntttggttttgtttgtnnttgtggggcncggggtcggggtngcgcgtttttttgttttgctttnntttttggcnctgcggtggtgtgggcggnncgccggcgcncgggntgctggttgggggcgcgcgc

SEQ ID NO: 54069 - DNA, 1528 bp, Oryza sativa
  unsure (1)..(1528): unsure at all n locations
tcccttaagtttttcccccacaccccttttttcccccccgcaaatttagagatatgtaaaaaatctccagttgccccggttctccccgtgaaattctcggaaaaagcccgccaaccgaaaatgagccctcacttgttctttctttcaaggcaaggtataattccaccggaattcttcccttctattaaagccaaagttcccctgcccttgaaccccaaaacccagagtttaccaaaagacatgttggtctttatggacactgttcaacaatcccaaaaaacaaaagctgtcgggtggttaatttgtagtcccagtcccggcgaagcatcacgtttgccaattccgttcgccccccttttggttcgggcgtatggcggtacgtgttcctcacttggtaccaagaatacccccatactccattcctcatccgcaaagcaacgacttgtccccctttcctcaatggttaacttttgaatagatatttgcaaaatgtgggtatattttcttaacttgttttggactttttgggggctttttctttagctagccaagcttgaatatatcaagacttgagatcctcctcgatcacctttcagcttccggcgggagacactggatgtgcaagtattctgatgtgatggctctaagtgagccacaagaggcaaccggtagatcttgtagagcactaggttgacgcgacaacttatagaggtggaaaaaaagctagaaattcatggctcagatggctcgtaatgaggtttgctcgtagtgatttaaactcgtagtcttaataagtcgcaggttgcttatttagctcgtttgtataagagatcatcatatctttatatagttagtgcttcttatctagtgtcttttaattacatctaaattatttgtgtttagtgaattctttactagttagtgtttattattatgtttatctatgatataatggtaagtttgagataataacggtggtatagttgcgttaatgagcctaatgagcttaacgagccaactcacgagatgcgccgaattggctgagctcgttaagataacaaactcaaacaagtcgagctttaatgagccgagagctagctcattatctgcctaccagttaatttgtcaatgctcattagagagtagatgtgcccagtgtttttttaatcctcccaggtcccaaaccttctcactcaatcagacttattttgaacgggtctgagtcaaatagcagtgatacgttcaacaaatcagcttttttataatgcactttttaggaaacataagtctttctcagatgtttaatttacgccgagacaccctctttatagttcacataaccatccgtatgtcttcaagccttcctgtgtggtcctttagacagtatatttcaagtttcatgctntatctacaagaaactgataccatccacatgtttgtatgcacttagtgcagcaagccgataccaatcagatctatggtgagatccatcacactagcggccgctcaattnnnnnngcccagtgca

SEQ ID NO: 54070 - DNA, 18176 bp, Oryza sativa
  unsure (1)..(18176): unsure at all n locations
ngtcttgtcaaaataagccctaaaggtgaaactctcgggtttaattgtcaaatatttcnaccgtgatccatgatgaatgtaagtanttgagtncatatcnattccaatccaganagttcatgcgtgaggnaagtatnttcgactttctttacaaattttagaggnacttntcaggctnccgtaatgtgtaaagattgcctnctatgtatnccaaggggatgacttacgtgcatcaaattancattgtccccaggactttaagcactgctatctttcttatgaatgacaagtactttgactgccaatctggttntcttgtcgtgtttgcaacatatgtgcaantcaggtccccacatcttgaatataatggatcacttgaatcttaggcttgtagcataagctattatttctgataccctgatcctgttgagatacttttaaataagatcgaagatggtcaaactcagtatctgttgtttcttatatgtttgcaaagaggccacttgcccatttgtcttttttttgtttttccttcttcctgccccttgctgttgactagtgccacaactgagccactatactgctaacacagggacgtacatactggacttagggcaacgcctgtaagtaaagattgagtcaagctgcataattgattagtgattatcttgaatctgtaatgtctaatgtgacacttcttgttgggcatgaattagcatgcatctatgctttaataaagaagaggtatttaattcccctcataatttgcaggttgtcaaggttgcagactttggagtagccagagttaaagaccagtcaggagttatgactgcagaaacaggaacctatagatggatggctcctgaggttaccttttgtcattttctttgaagaatctttgtgaattttcatttcattgcttgtagtttatcacaaatcggtgagctatatactgaacgcgaggactgcagaatcccttctgcaatctgcttgctcacactaccgagaggtttttgaacgttttggttcaagtggcaaagtcattgggggcttatcatatataattagattgaaagagcaatgactaacctactctgttctctggggtacttttatgctagcacataaccctaacctaagccttttgtgatcaatcccttcccactgctactttgcttgttgtacaacaagacagactcctataatgtgcttgaatatagcttgtttactgactgcaccatgtgttgctgttcgatgttgtgtttttaaggatagtagaatcaaatcctcatactatcagaagtacgaaaaattctaagagacttttgtgggtttgcacccctggaacttttaaaagagacttttgttagagtaactagtgcattgcctattgaaaagaaactagattggcagttcgcacataacctatgttcagaaatatatcattaattttgcaattgaaaatattatcataaagtagcaaatttataacttactgatatatatatatataacaatagaggtctgtgttgcatgttggagacttggaaaaagtttcttaagatattgggatgagaagtccgttaatttgatggcacatatatcttcttaaagctgtacatacatgtgtcatcttcattatgcagtttacattttgcctcttaatctcttatggagcaactccttgttattgttgttgtttttgagatatgttttaatagaaatcattgcaggtcatcgagcacttgccctacgatcagagagcagatgttttcagtttcgggatagttatttgggagctgctgactggaaaggttctgttacacatgccaagcggttatgtttagattctctgcacttgacatctgtgctgaacttttgcttttctgttttctgctacttttttctcagcttccttatgaagatatgacgcctcttcaagcagccgttgccgttgtccaaaaggtacgagataacaaaccttacttttgccatcttatagttctcccaagaaagaaactgtgctgagttgggacctggcaactaaatatgcactctgcaatacacgagtcactaattgctgtaagtttagagaagaggaatctggggattgaacagttgattcattgaaggcccaaaggaagcatatatacatatatatacacacacagtagatgagaaatgatccttgatattgcactttcatgtttgcaggatctgagacctatcattcctgctgatactcatcctatgcttgctggtctacttcagaaatgctggcagaaagatccagctctaagaccaactttttcagagattcttgatatactaaattctataaaggaggtttgtatatttgatgggatgtctataaaatttctcagttcgatttgtgttttcctttcatttgatttttttttcattttgtgcaatcagcaggctgttcgaagttctggacatcagaagagacactcaggtcgatcttattccaggcagagacgaagcggttgatgcagcaattttcctttttttttaaaaaaaaaatcttgtttcggtttagtttctgaaatgcggcaggttttgtttagcgttccacaccctcccttttgttatggtcatttccacggcgagcaatttttacttggttgtatctcagcggtaacgttggaatataatctggtgagtttcttgtatttttttttcatgtcgtgagctggtgtaaacgattgttgattataatcctttcagttcaaccacgagatgtcatgacttctttttttttaaaatcatccttttaactctctcaggtcttttgatgtgtgactttgaccataattttgtattaggataaatctgataagtttaagagataataatatttatcaaggcaagcctatagttttcttaaaaaaaagaggcaaacctatagcatttttacgtcttgaaattaagtattttattaaaagttattgatgattaaagtttcgaaggtttgtttccagaacgttaagaggagaggtcttatgaaccttcttttcgagaacgaaaccacgtatgtctaacaaatggcataccaaaaagggaaaagaaaaaaggtaggaagagtggctttttctgatggtacaaaaagtccaaatcgattcaagtgcctgtttcaaatttcaaattcaaatgctgcgtttgttcattcgtgaggtccatgctccacctgtttgtaatcttgtttaggaataagttgtcgtcccttaacttggtttgattgacatttctaatttcaaatatcagaaatcttcaactctaaactatacaaaatcgtacaattagagtcccatggtagtatagaccccatttcctcctatttttgtttacgtggcagatatctgagcccacatgtcaacatgctgagtcacccatgccgtttcaacgtgctctcgttggctgtttggcaggatgtcctcctacgcctgcagcgcgtccactgacatcgattgatagagacaccgacgctgtgatgatggtgtgcatgaactgcatctccctcagctcatcaaggtcaaatcaaatcattcacgtcgtaacgagcgggctagagccggattgcaccattcacgctgtaacgagagggctagtgctgggccgtcactctacctctagggccatcaccactacgctcaaggccatgccgccacatgcatccaagccgcctaagccggcgtgccattgttgcgccttgagggcaggccactgctacgcgttgggcccgcccagacgcgactgtgcctcaatgctatccgattctacgtgtcggggccaaccaaccgatgcgctgttgctccatctaaaggctgcaccgtggctcgaccatgaggctggggctgcccagccaccactccggcttgagatggcgaacttggcgctagcggtggagtcatcatcaacctctatgcaaacgctgctgccgtcaggagctagcaaacaggcaacgagagagctcactccgttgacacggcattggtgataacatgctgataagtgggcccaaatatctaccacgtaagtgaaaacaaggaaaaatatgatctatactgctatggacctaaggtgcatggttttatacagtttagggtatagacttctggtatttgggagtatggatgtcgatcaaactcgacataaagttgagagttggccggtggacttatccctcctgtttataccaccgtgttgttgtgacccatggtcagcccggcccaataaacacacgaaggcccaatagcccaaacaatctaaaaccctagaaatccaatatacaaaggtagtgtgctcctgcctccgcgtggtttccatccccgcgcgcgccgcccctctccgctgccggcctccgctcctcctccggcgccgtcgccgtcccatcggcctccgcttgccgcccgctccgcgctattcaccccggccggcaggtgagcatcggtttccctctccccgttttccccccatggtttgggtttctccgaggcaaggggaaccgcgtgcgtgtttgttcttgccgttcggagtcgccgttgatgccgccgcgagtatatagacataatcactgagatgcatgtaatgaagtatctggagcgagcgaatggataaaccctaatctctcccggctcctcctttgaaggagtgaagaaaaactagactgttattatcattcaattgtgactatcattttcttagcttcgtgctgcatgattgttttgattgacttatctgtatgtattgcattctgtggtgcctatcatttatgggattgtgctgattgatttatcaatcctgcagtgacaatggcaaggcttgcagctgaagacccattggttcgcgatgaagccatattggatgatgatgatgatgatgttgataccgacgaggaagagtccgagtcggaagatgattcaggggaggaattccatgccgagccttccaagaaagctgtctacaacaaggaggggatcctggagaagctcgaggacattgcgtggccggagaatgtggactggaggcacaagctcactatcgaacatgaccagggggagaaagtcgatgtgaacgacgatcttgctcgtgagcttgcgttctacacgcaggctttggatggtacgaggcaggcctttgagaagttgcagtctatgaaggtccggtttctcaggccggctgattactatgctgagatggttaagaccgacgctcacatgcacaagatcaaggggaggctcttgtctgagaagaagaagattgaggaggctgaggagaggaagaaggcgagagaggccaagaagagggcgaaggaggtgcatgcacagaaagaaaaggagagggccaagcagaagaaagaacagattgagtccgtcaagaagtggaggaagcagaggcagcaagggggctttgccaagggaaatgatgatgggccagatctgaattttgaaggtgacgaagggttcaagcaatcaaagaaaaagaggcctggtgtttctcctggtgataggtctggtggtcttgctaagaagggtaaacaaggaaagaacaggaaatcaagggattccaagtttgggcatggtggtcggaaagggctgaagaagcaaaacactgcggagacgacaaatgacttcagaggattcaaccagatggacaagtcacaaaacaagaggagaaaaatgggttgacgcgatattgtaagaatctgcgtctgcttccttgagctgtattactagttgtttttggtaactttattttactgcagtacatcgttgctagatgcgaacgttagttgagatagattgtaggaggcagttaaaacaaaagaccattttatgttttaactatgctgttctccacaagatatttgcatgtatctggtgatggccctttttcgttgtgtgatgtggaagaatcaatcttaccctggaattatcctaagagtgtcttaaggatgcttggtgcacttcctgttttgatatgttatctttctgaccgttattttatattgatgcaacaaaactgaaacgtaaacaacactttcctattgtgttgtaaatttgtttattggtgagtcaagtctccctctcttctatcttagattatactccaatcagcataactcatttggttaccttgtttctttccctgtagtttctagtgaatgatatcatttgtgagtttcctcactgcattagttgtgatggaatttcagaaagagcttgcttttgtactgcatttgattgtgatgcttccttgctcttcatggtggatgtgcatgtccatgtggagtggataccatttcccattaagatcgtgaatatggtagtagtacttttgcattatagctacagtgtccttttggtctttacctcgattagcttggaatgagctatactgatagtgatttgatgcatggaagcccatgcttatgttgcttctttgctggtgatggttgtctatgatttgaaagcaattgcctactacatgttacaacatatcctctgaaaatatctgctagtattatataacctcttgcagctgcactagtgcgttaagaagctgctactataattcttgtgatgtgtttttttcttgtatattatctgtccgatcatgttgatagaaatttttacgcgaactagcaaagtgcccatgctttgcttcgcagccgaacagaccttataggtaaaagaaaatatacaataatatgtcatagataaaaaatatttcttattagtattgcttgtttacttatttaaatacatggtatttatttgatttaaacaaatattagagtattgcataatatcaaaaaaaaaatattagggactaatttgtaaaaagtgctaagtagtggtggtggcaggaccatcaccgctagtggcttttatagtagtatagattatgaagtgggggaatgttttgatagtccttgaccgtacatttgaggtggaggaaatttctatcctatgtcatctcagtcatttatttgtttgtatccaagtctgtcacttatatgtgatgaagactagattgcatcatgcatgccatggcttgttattattatgatacagctacttctttggatgctttaaacctattttctcatgagtaaacctgtaagtgtttaaaagaaatgccagtatccactatccagtcatcgatcatctgttttaacagtgagtgaaactattttactaaccttaacggtgagtagttttgaagtcaggagataaggatgatatatgtggcgtatctgttatatattttccatcttgagtgtttgcttattcagtagagtgttttttcattagagtttgagtcgatgctcctggaatcatggttaattgttatcaagcattgggagggtgacttgcctaaagtcctatatgtagaattgggagtcaatttattattctagaggatgctttattctactctccattttaaatatacggtgtatttttgtttattaggagtaggacaggacttttaccaataattattttattagtaataatttttatgaagcaaaattgatgctattagatttgtctccaaaagtatttttgtatgaatatatatttatatcgcataaatgatattttaggggagtaattgttagtcaaattcttttcctaacaaaataagaacaacctatattttgaaatagagcgagtataattttggcgagtaatctggtggcactgtgcattagataacttgccacttgcctggatgcacacttggcaattattattttttggtcacgccaacttctttaaggatccgaccaaacaaaataattgagctccctgtgccttgtccacatagacttcaaatttttttctgacttttttcatcaagttccaacagtgcacctgatccattataatcttcttgatttatgagcaaggaaaagattgctattgttattgttatacatgctttctggcaagaactatgaagtgtgtttggttgcatatgttagacccatttgtcagttaatgctgggagaaattccctttgacagattcctttcacttcaagtcttcaacagtctacactctacagaactatgcgcaccggtaaggtatactctcaaataaattgtaggttgtaacgggacataatctaatacagcgaattcgaaccggtcaaaccaacctagattatgatgggacataatctaatctaatacaaaacgaatctgacagcctactattttgggaccaagagtataaatctgttccatatcaagaatcagttatagaacagtaatgctatgttgtgttccaggcgttttgctttgacatgcacgttcacataataaaactgaaactaatgaactggttctcgcatatattttcgttccacattgcgttattatactatatggttcaaagttctgtgccttggtctcgatcattctgtttggtttgattgtctattatgtatttcactgatatctgaaggtaactcaatgctgatacatctgcacaccgtcaatagtctagtattcgcatggaatttgttctatttctgatgatcaggtggggaagtttagattcttttgtttgaacaaaggaatataacttctgatgaactggcctatgcattaactaaaaatacacccaaccatttatatttgtatacgccaggatttatactttgatgaatagagtcatgcattcacgactataccatacttataccatatttatgaaggtctaagggtaattgatcacttgatccgattctatgtacgtagtacgatttatttggtacgagaaacagagtgagttcttctatattgccatttcattgatcaatgatacatacttgtaaaaagagagagaggtaaaggtatcgggaggtaccacacactttatagtgtaaaatttggtaagtgtgaaatttggtatctccagatacttaaaaaaaaatacgtaccttgagatcttttttaagggactataaaatttctctttaaaaaaagaagagggtcatccatcccaaaccccaaatttgagggataatttgtgatatggatgaactcatttaaataatataaatggtctaatccctaaagggaatcaacaagggtagctgtatttatccatcaaaaatgatgatgggatttgagaatcagagtagtcgaataaagccggtttgctaggcttttccagatggaccacgcgtacggttcgctttcttctacgccccctagcgttggcctaaccaaatcatgagtccattttcttcttctcgatcttcaagatccaggcaaagctgtcattgcaccttgctaattcgtacgttgaacatgtccttgcatgcacgtactctatctgatcgtaatattatgcatatacaaggtgactttgcagtggtgtttttgtgcgcgtgcacgtcctctatataattgatatttttaaatgtttataacaagatgtttgttcaattttttttaaaaaatatactataccattaataactgctcaaatatttagttaaaaacatatgtgagacttatgagattttaatttataaacttttataatacaaagttagtgatcaaatttcaaaagtctaattgaatctaaccctaaacataaaaagatgaccagaaggagaaaataatcatatatagtattttaggtccgaaaatttggttttccggaagtatctttaatcgggaacacatacctgtcttctttatgaaaagaactagcatattacccttgtgttgcaatgaatctattaccgcattattaccataattttgtacatatattacatcttaatttttacatatatttgttactaatatagactctttgcccatattatccttttcccttacaaaaaaaaagggagttgatgaagggggttgacatgcatgtgagccctgtagccccatagtacttttccttttcaacaaaagtaagaagttgatgggatggatggtggcatattcactactcgctactaccacactttttaagggaaaatttgaaccatgccacacaaattttgcaaaatttgtgatatgccaccctgacccatatgtcattgactcatgtgggtcctacatgtcattgagatacggaaatagatataaatgttttagaaaagcgtggagttaaaattctaatatgttactacaaacaataaacatacaacttaagggcccctttgaatcgcagggtagaaaaaacggaggaataggaaaacacaggattctgacaggaattgaagtgtaaaacagaggattgcaaaacacaggaaaaatacaggaatggtcgtttgattggagcgcaggaaaaacgcaggaatcggataagagagatagactcaaaggaaattttccaagaggttagagctcttgctaaatttcctccaaaatccacatgcaatgtgccattccataggaattttataggatttggaaagcttcaatcctttgaatcaaaggaccaaataggaaaatttcctataggatttgaatcctataaaattcctatataaattctttgattcaaaggggccctaaacatgttgggcgcaccagaacagaacatttgatggtttctgaatttccaccaaattcagacagatagtactgctgtcctgacaagttggagcttggaagcaaaaaacaaaaacaaaaaggagagaaaggggaaaaaatagatatgatacgaagaagaagaagaagaagaagaagaagaagaagagcagatgaaacaaatggccctaagcaatgcacgtcgccattagggagcgagcacatgctacccttgtgatggagtcgccatcgatcatattcataattttcctttccctctcccaagaacgatatatatcgatcaaggatcacgacaatgtgtcacctttcatgttccagctgccaattccgttagataacaatttgcaaattaatacagagtacctttcttccaaaaaaaaaaagattgtgacgctcctgactgatctccaagctcgatcgatcgatctctgcatacatatgcatgcccacacaaggaaaggggctaaggtatgggttcccaaatgcttgtcatgacggctaaaggtgtaggtgagcaacttaacttagcccctgctagggtttgaagcaggccttgattaatttgatattgatgtccatccatttgaatatggcacaatcgcattcacctttagggcatatatatgtacaatactacaacatgctctcttagatctagtatgatttaggatctaaaaatgcaggattaattggagtgtcatggcatgttgattactataggaattactgctttcaatggctcgaagaaaaaatacaagaattttagattatatattaatatatatatatatatatatagagagagagagagagagagttgcattagacttctcgaacgaaagaaaaacgccgaggttagatgacatgccataaatcttatggaattgaggtataggaatgcattccattggaatttgacaagtttaaatcccatcatccaaaagaccccaattggaaaaaaacataaggatcaaaggccttcatttttctatataaatcatgcatgtccaaaggagcattaagagagtatctcaaaacatctatgcaagagtctaatcctctaatactccacctgttcctaaatacttgacaccaaatattatttatatttaaaatctgactattagtatatttggaaaaaaacatacttaataatttatggatgcccattctccaaaaagatcttctatgtatgataatttcaaacaacatctaggggcatgctatcgtgttttggagtactgacaagcttttacggaacacatcactaaggaggtgtcctggcgtagtgatagtcgtgtttgctaggtacgtgcaacaaattataatgtaccaaaatacatgcttggtacaaagtatatatcactatcgttctataaaatggagcaacaatgtgactattaatgtaccccacatccatctacactttgattacaagaattaccacgatatagtcccaagttggatatgtcgatgtagtgatacatatgtgccctgttttgtcccaacatagttcctctcctgaatggtgaaggtgggcccggcacaggcagaagctaacgacaatgttcaattacaaatctgaaaggaaagccacaccaacaacaatcttaaagggtatctcactctcaccacattcctagctgagccccataagtctctctctctctacccatcatgcatccatttcagaaaaaaagaaaagaagaggaggaaatatgatccacttaggatagtgacattctacagaaaattcgccttaaataatgtacatatatgggaagcaggtcatatatattgatatatatgtgtggatgatgttgataaactatagactagcttgggctttgattttgggttagtttgttggtcagtcagagtaggcagctcccatgtgctctgctccaggatgaaggcaatgtatcacctgaaatcttgctagctagctatagttgacatctgcacgcatatcctccttacgaaaatacaaattaataatgatatattattgttataatgcatatcttgatcttaggtttatatatgtacatgcgtattaatatctacaagcttgtttgatacggctttagctcataaagttaactccaggaacagagtttagagtgaagcaggccaaaccgtattcaccagttcattctgattctggctggaatacgtagccaaatataccattccatcacaaaaaatgacatagagaatgttgacgtatccattccagccccaggtttctttagaagacaccaatagagaaaaaaaaatcataaaacttagttgcattctctgtaaaattcctcaaaaggtctaaatattgtctgctacgtaccgaatattaaagccatcttacatatgtagataccaggtaaattataggttataccttttatatatgattccatttatcgaatattattaaatgtaatgcatttttgaagtaatgcatccatttcaaaataaaagaagctttaggctttgacacggatattaattaaaatactaggtggaactaaataggagaggattgtgactggttgagaagaaaaaatagatgaagaatttgaataggggaatattgtgattagttgagaaaagaatgtagccggataagttattatattttggaaaatgctaaaagttagtataggacgtagagagtacatataaatgtcatacttattattaatatatcgactgcaacagtaagcctagctagccaaacctaaatgatgtctggaatgggatcgacaagtaatcatatatatgtatatggtccatggttcatctgccagatggttggaccttaattgcatattcattaaacttactaagtatgtttctacaatataataatgataaagctgagaactataaagctgagagatacttatcagaaaatgattgaaatactaaaatttcacaatctagtacagctggagataaactgtacttgttagtgctactagctagtagcttagccaacaaagagaaatacaactaatattccctccaaatcaatcaattaaggcctcatttccatttgcactgtctcatcttataaacacaaaagaaggaaatgtgccacacatattacagagatcatacattgcaaacataattacacactgatgatattacaaagtacgtactcacatctagaaaattcaaagccggatataaagctaattaagaagatatgttacatcatggcagccagtacatgccctcctgaaaacatgcaacattacgcatgtaacgtgcacatacaggcacgcgttaaactcaccaggagggcatacaaaaaaattaatgaacatcgatcaatagcaacaaatcaaacatcaccaattctcccaagaatcaagtcatgcatggatcaccaatccgaacacaaatacctagattaattagatcatcaatgatcagcttcattctcctccatctccaaaaggatcatcaatccatcatcagagagagagagagagagagagagagagttcagactttcagagctatatatatgtgtactaccaaatcttggtcctgccgccggcgcggccgccggagccggacggcggcgagcacttgttcttgccggaggcggagcggaaggcggcgaggatctggtggaggcggtcggcggagcaagggagcacgatggggcggccgccgggggagccgaactcctcctccgccgtgctgaggagctcccggaaggtgtcgctggcgaggcaggcgatggggacgaagaaccggctgccgtcccgggtgtacgccgcgaagtgcccccgcgggcacgccgccgccgccgccgtcggcgacgtcaccttgctcgaccctgacccgctccacttcctggagatctcggctagcctcagtgagctcaccatgatcgatcgatatatatatatagaaatgacagagaaattgttgctaagctaagctaagcttcttggagcttggagaagctaagcttggagtagcttgtggctggtgatgtgtgtgagagagcagtggagctcaaggggggtataaatagaggagagaagctagctatggtctatggtgtgtgtggggctaggttgctaggtatgtggggttgttgcatttgcatggagaggatagggatggatatagctatatggagagagagagagagagagagagagagagagagagagagtactagcttagctacagggtgaaatgaaatgaagatgaaagaagaagaagaagaggaatgcattgatcattgctaattaagttgccagtatatctgtattttgcatgttaggatgtgtaggccagtcaagtgggtcctgctcatgtcaatcatgcatgagagttgagaggagtggtgctcgtctgctgttgtcccaaaataaaacaatgttgatcctatacctaaaaagattgccttttatttcccccctgtggttcgtaaagagaaactggttttgcttcgtactgcacatgtgatctaagttatatatatttaaattcgtgcaaatttttatgtggatatcgtgacttagtgggtttagctacagagcacagcgaaatgcctctggccccgcttgtcagattcttccttgtagaggcagtggtgcatccattgcgtgacaatgacctccccatggtacacagccaaggagtgtggcggcattagccacacgcccaatcttcgcggtgaagtcggtgaggaagtggtcatacggatgagcgcgggttgttggggagggaagccaggatgtggaagaagcataccactttcagccgacacatggtgtccaggtcagggcagagcactagggaagtaagccccctccttatactgcactagagatacatcgattatgcactatggtgagcggacggagccccattgttgatagatagactagacatgatgtcacaacgcatccctcaggtgatgacccaataaaggacgcaaattcagtgatcttcggtaacagggccctcgcttttgacacctcgtccatggcccacagccttggcacatataatcaacagattagccgcacccccatgtgtctatcgccaggtcctgctcctcctccgctgccactacacaccacaacataaatgtatagaagcacttagtttgttggaagaaacaattgttagcagtgaattggtgaaatattttacctacttttgccactagaaaattttcacctcacgtactttttttatgctttccgtcggttggtcctgctcatatggtatcaattttgactgacgcctcttaatataccgacaagcagtgagtgcttaccggcatatagtatgccatgttttttttgagaaaattcgatccatagcacagaaaaaaaaatgcagtaccaaaaaatagcacaagaagtttccgctttcgattcatagcacagaccaccggtttttcttcgtcccgtagcacttccgtcgcattttgaagtaacggtgttagattggagtggagaaatttttcatcggactcatttgcccttcgtctcatctccaacgacggccgctcaacacaaccgtccgcctcttcatgctgtccggcccaggcatcagcgtcgacgacggccgcggccgtggcaggttgtcgctgatgctgtacttccacggcggccacaggtggggaaaggaagcgacccatcggtggctccccccatccgcaagagctccagcatggggaacctttccctcatatcctcttctccgccgccgaatctaaaggccaagaatgatgttcagttcctattagaagaattgagcaattctctgttaaagaaactgacctgagctcggcaatgcaaatcaatggtgtccttggagttcggaatttaatttttgcaaatcattgattaagcagtacacaacaaactagttcatcaagagttactagccaccaccgccgagcaagccgtgacattgattccgctggctgccgagcaagccgccgccgagtatcctgccagccgctgccgttgtcgccattttcgccccgtcccatgcgccgcctagccggctgctctcacgacagaacaatgatgaacaggcaatggtccagcccaaagtcatgtgtgaatacgggaggactaagggcaaatttgtcattttttattcctgctcacgaccaaacgcttaaccctcacggcagatctgacggaaataccatggatcgaaaaaaaacaagtgtgttgtgctaccagttgaaagtgaaatttttttttactattttttggtaccagcttaacttatgtgctatagatcgaattttctcatgtttttttgccgccagatagtctgacgaagcattatttttttaggaaaatgtctgaattacgccctgaactattattgtggtagtacggatcccctcaattcaaaaagcaaatattctttactcttaactttttataccggacgaattacccccttgatagactctagagcggttttggttttacgtagcgcacaccttggtggttttcatgctatcaaaacaagttttctacaagtttatgtactgaattatacccatataatttacgctttttcggatgtctaacgggtttgcagcaactaccgaattgaaataagtcaaccctgcagtctctcctctccctcaaatgacaaatgaaacgatacccatttaatcaatttctttggacaacttatttcatacctcattttcattgaaaccaaatctatacatgcatatgtactcctacatgttacaccaaccatgacgcatacctgtaacctgcttccacgggtagagaaacaatctttagtcggttgacccaaatccacaatagtcccggttccattaaaaaccgggactaaaaatgattttttagtcccagttaataagaggaaaatctttagtcctggttgttgttacgaaccgggactaaaaatcatctttagtcccggttggtaactctaaccgggactaaagttcataccaaccgggactaaagatcatttttagtcccggttgattccatgtcaggccgtgtcagggccctaggatctttagtcccggttaataacaccaaccggaactaaaaataggtttttagtcccggttttcctctctaacttcttatctctttccttatctctaactcccctcctctccctccttttcttcctttttttccttcaccccacagcaccctcgtctccttccttttttcccgaagaagcgtgcaggctgccggcgccgcggcggaggctcggggggcggcgcacaggctgcggcgcggggggccacgcggaggcggcctgcgcggccgcttgggtgggtggcccgcgcggcggcgcttggggcccggcggcggcggcctgcgcggcggctcggggggccaccccgcggcggccgcgcggangggaggaagggagaccgcaatgaccgcccggcccgattttttttagatgggaatctgggattaatttttgctgaaagtgaatctgtgatgaatttttagaactatgtgatgaaattttttaagagtttgtgatgatttgc

SEQ ID NO: 54071 - DNA, 4664 bp, Oryza sativa
  unsure (1)..(4664): unsure at all n locations
cagcttgaccgctgtctagctatatgatggacctattggatttataaaatttagtgaggtccacggcaatggcagagcttgacttaaaaaagattaattaaggaagcaagacatatatcactaaactacacaaatacatatattgaaggagcaatttgagaattgagagcttaatcaatgctaaaataactaataatcactaaactacttaatagggactgtttaataactaatgatccactttaatctacatgatgtttcactcctgtccatagatttatagttggtctccacctgttgaaacatgtgttgaaaacacacttatcggggaaaaaaaattatgatggttttatgcacggtagtaatgtggttgcatgaatgttggtgcgtgggatattaattttctcggcataattcatccatgttggttactagaaataaactctctccgttcaaaaataattataattttaatatttaaattttatccataaagaatgcatctttcccttcaaccgcctttattcaaaagttctcatcatcttatccctaaccagcatccgctctcccaatcatcaatcgtttaatgaggacatacaagtcatttttttatactaacctttttcaatactacctccgttttttaatagttttttaatagatgacgccgttgactttttatcacacgtttgaccattcgtcttattcaaaaaatttacgtgattataatttattttattgtgaggttttttatcactcaaagtactttaagcatgatttatatctatacatttacataattttttttaataagacgaatgatcaaacatatgttcaaaaatcaacggcgtcatctattaaaaaacggagcggagcgagtatattacaaatgtaatttttatactgagggagtatgatcctaaatccacaaataatatagagtatataataatatatcttcggtccaagtggccacagaggcagcaacaaggccagcggccaggagaagcagagtctgcaactctgcatgtgtggcttgcttgctactccacggatttgaaatatctgaaaatattccatgaaaagtacaaatgatgagaatacgactcccgcgcggtgtaatttaccaggttaaaaaatgccaccttaattacaatgttccaaacttttggtgctacaaaatgatcgtccttttttcttcagataaaaaggattttaaattagacttaccacgaaaaaaagtaccctagagatgtaccctctttatattattatcaatttagcattgaggtggatagtgataatcttattttgtggaataacttttagatattgtggggtttgtcaagtgtttttttaataaatgttgcgaatgataatgttagccattataaaaatatgaaacagttaggagagacatgataattgcataaaatatttatctaaccttaatttgatatgtgattaaactataaagattatataatcttttacaatactaaaaaaaaagaacaacacaatataactttacttcaaacgggaccttagtgtgatagcaaacaataagactatagggtggtcactacgggtgtctcgtaaagaataactgacatatcttggattgaccaagtgaatggaagaaaccacgaaacctttcaacaaaagaagctttcgccgagcagcttgctgacaaaaatcaacggggaggccaagacatgggccttagtgggcgtgagacagctgagatggcttataccttaactaactcggaccaaaggtcttgagttttgccttttctttttatactgtacagtttactccttccctattctatgaaattggcgactcaccgattcgctaaaaaaaaaccacggacatcttatgatcaatggatacgacgtccactgctaaaaagatatagtacttgaatccatgtgtgaacaaattttatcacataagaaacctaaccagttaaagtatgatcattccataacaatttaacactataacatgacatatatatatataacaaccataaactacttcctccatttcacaatataattcattctaacatttcccatattcatattgatgttaatgtataaatgtgaaaaatgttagaatgacttacattgtgaaacggagggagtaagtattaatgtgaaagctcccttgcatgtgattcggtttcacatcacagctagctacatatattcctatttgcgaattgaatggttacaatttttaggatggaggagtgtgcactggccaccacacacccttacacgtacgcatgttagctagcgtatcgtgatcgacagtgaaacgcagagccacatacatacatatggagacaattccacagccactactactggtatacagggcaaatccaaatccatggtatacgtactgcacgcgtatatacgtacaagagagaatgatgtatagtaaggctgcgtttgtttgtgtgatatagggtgagaaagcatctcgtttttcatgtacacgctttctaaactactaaacggtatgttttttgcaaaaattttctatagtaaagttactttaaaaagtcatattaatctatttttaaaatttaaaatatttaatactcaattaatcatgcgctaatgattcacctcgttttacgtatcttcccaatctctctaatctccttcttctcaaacacaccctaaatcgctgagaggcggatacgtacgtacgagagtgcagtactagatagcacgaattgtgcgtacgaaattgaagtggctgatctatctgatgatcccctggccggatagagaccggccggcagcagccaatgcgacccatggagcccatatgggtacgatcagcagcacaatccatcatggcgatccagtactgtcaggtaggcagtcccagctagtgtcatctgggcactccatgtgtgcctgcctacatggacatcacaagtgtcaatggtggtggtccacgtcatcaagcctggcaaatcttgttttcatggatagctacctttgtaaaaagattatatatatttacatgacatgtatgagatttgctccagtaaaaaaaaaagtaccttgatgtaccggtacctcacggtacgtatcaaattgtgtaagatccaacgatcaaaaacgatttggtaccgtgaggtaccgatacctcgagatactttttgttggaccagagcaaatctcatagtacaaacatatgcgctcatatcactggtggagaaaccatttttggtcggtcggccgaaattcacaatagtcccgattccactaaaaaccggaactaaagatgatctttagtcccgattggtggctacaatggtcatatttgatctttagtcccggttggtaacaccaaccgggactcccggttctagacctgtcagaccttgtcaagccccctgggatctttactcccggttggtgttaccaagcgagactaaagatcctaactttactcccggttggtgttatcaaccgggactagagatctagaagatttttagtcccgcttggtattaaaattcaacgcttaatatataatccttcttccctatcctctcctccacaaccgcctcgcacttatcctctagaagatttttagtcccggttggtattaaaattcaacgcttaatatataatccttcttccctatcctctcctccacaaccgcctcgcacttatcctctcagatctcgatctccctctcctccctctcagatcgatctccttctcctcctccccctccgcctcctccccttccttctcccatccctggccctctcctccccgtcctcccttcccatccgcttagatcgatctccctctcctcctcccctcctcttctcagatcgatctctctcctcctccccctccgcctcctccccttccccacccatccccggccctcttccttcccctcttcctttccacgcaggccttttcttccccttcttccttcccacccaagaagcgggcggctaggccccgcaccggcccaatggcgaaccgcggcaggccgcaaccgctaccggcattttttttttttttacaatttgtgattcactaagatgtttaattttatgatttggtgcatgacctgagatgtataatctgtgatgtatttggtttgtgtgtaatttttttaagatttgggatgctattgatttgtgtgtataagcaacttaagatttgtaatgtgaatgttttgggatgttactttgatttgaggtttgaattgggatatgtatcccacttgatttgggagaaaattaaggattaaactcttgctaaaaaacaatgaaaaaaaaagaactaatgggactgccgctaccctctctttagagcccgttgtnnnnnnnnnnnnnnaanntntaancantttttttntnntaacaatatantaataaaactttatttaaaaaacattttaataacaaatatttttctnacccatcattatccccttttttacccccccatacatacctcttcctaatctaacacaccttccactattaaatcatcctnctctactcccaccccataaaactttctcctcccttaataccatttnctccaccatctttctcatctccccccccctaatccatatttcatatccccccctcttcctcc

SEQ ID NO: 54072 - DNA, 4814 bp, Oryza sativa
  unsure (1)..(4814): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaatggtttctcctccggtatacatcttaaccatcgtgtctcttgtttttattgctacctatttattatatgatagtcgagaaatatatatagggtacatttcctgacatgtgcatacaggagcatataagttatatatatactgcctccttttcctttttaaatgtatgacgtcattaatttttctcacaacgtttgaccatttatattattcaagaatttaatataagtatataaaagtataagttaagattatattttatttgataataaattaagccataacaaaataaataatacttatatatatttttaataaaacgaatgttcaaacgttatcaaaaagctagcagtatcatacattttgaaatggagggagcataatgttgtaatagttacttagttgtatgcaggggtggagttggaatgaaatagaggggagtgcctctcatttgttttactttgctttattccgagtttatgcaattatgggtgtccgagtttagattaaggagggtgcaaatgtggtaaaaatagataaactatgactaaaaagctttccgaattctttttcgaaaaatcacctctcctatatagctcggtcgtttctaattctatgtgcgtgtacgttatccatataatcgaaaaaaaaagaatgattctatggataaatgtgcatggataacctaataggataatctcttggccaggcagaagaaaaccagagcattgcatcctgtagaggcagaggctgtaagttactgcttcatccgtttcacaatataagttattttaacatttctcacatttatattgttgtctaatccttcatttcacaatgtaagtcattctaacatttttcatatttatattattgttaatgaatctagataacaatataaatatgggaaatgatagaacgacttacaccgtgaaacggagaaagtagtaaccaaccagaggggtagtgattgtgcggcggtggggcgtggaaggacgaatggatggatggctccggtggcgcagggcgtctttctcgacggatcgcatgggcgcggccatgggcgtttgccccctccgccggcgtgcagcggcagcggcatgtgcgcgcgcgcgcgccatcggcagccactcgttgctgcgccggggccatgtggcacccgcgtgggcatgggccctgtttccatctcgtggccggcccgcttgctctgctccggccctccgcccagccagccatccagatctctctctcccgcactcggcgcgcggcaggcaggggccccgttgccgtacgtacgaaccccctggatcgcgtggacgagggcttaattagcgtctccatcgctcactcgcatcgcaggcgtgtcttgtgttacaaggagtgaaaatgggtcatgaaatacgaggatacggatatgtgatataaggatataatatttttctaagaaacaaagatacgtggatacgtctatatataaaataagaataatatataataatatacatagaaaattaaatgtgtagaatagtagaaaactagacttgtttggcatacatcatgttcaactcagccagaacgagtagattgctactctctccgtattttaatgtatgacgccgttgacttttcgaccaacgtttaaccattcgttttattcaaaaattttgtgcaaatataaaaatatttatgtcatacttaaagaacatttgatgatgaatcaagtcacaataaaataaataaaaattatataatttttttaaataagacgaatggtcaaacattggacaaaaagtcgacgacgtcatacattaaaatatggagatagtactgtacaagataagtttggttgtttcttgcatctactgatacagaagtggaatcttcagttcgctgaagaaaatcagcaatctagcacaaccatgaaacactcaaagctatctcctccaattcaccccccccccccccctcgcgcgcattagaagccacactagcactaagaaggctagatgcctagatgcattacaactcaagcttccatcaaaatcaatcgcatctaactaaatatggatggcacttgtagtctctttgttcttaaaaaaaaatagcaaaaggaacatattgaagataaggctatgtttagttccacgtcaaaattggaagtttgaagaaattgaaataatgtgatagaaaagtcgaaagtttatgtgtgtagaaaagttcgatgtgatggaaaaattggagtctaaacagggcctaagcctggattggaagggaccaagtactaggtagcgcgggctatgcctggttcggagctgtggcaaccggcagccagcgatcaggcgacgcccctgcgtcagacggcggcgctaccggcggacggcggaggcactgcgacatacggttgcacagcataatgcccgtagacagtgaagacgctgcggcatacagcggcgcagcaacgcccgcggatagcggaggcgctgctgcatacgacggcgctgcgatgccccgcgggcggcggatgctcttccctcggtgtccagcatcatcgttactgcacttcgtgagatggttgtggccgcgtcgaggccagggggaatggcggtggcgcatcggacgtatcgagagcgtatccttaattattttgtttatttgaaaatggtgttaatcggagatacgtgtgggatacatatcaaagcgtatccgatataaatccgtatccgaggatgtatctgatacggacacgtgaggtgtttgccgtatctgtggaatgtaggttatggaaattcccaatcaacctagtgacgtccgtatgagggataccatttctggtggttatcatttttggctgtaaataaattttgttttttctttaatttatttctgcattgtattaatgttgagactaagtagtttaaatgataaatatggtcaattaccggtcgatcgagcgatatttcagaagagatgctactaattccgactgttttctcccctaattgtgtacagggtgagctcctgattatcccgtattgttaccgtcaactcgttatatgtctacttcaagggatgaaaacggtgcaggaattcttttttacgttccgatggtgttttcggaaaaaataatagtagatgatattattttcaatcactataaataacaactttttaatattcccttatttttacaaatgggctataaagagagccatctgtcaaaatgtacaaatatacaagaaatgttcaatcgaggcccttcataggtagacctgtcaagaagcctgtttacaaaaataagctattttcacatatggtggtttttcttgtccgcctcgaccacatcggtcgtaatcgttggtacctctcattttttttctctcctcgtctcccccacctctactttttcctctcctgcttcccactactctctcccattctaggccgccctccctgaccaactctctcgcctcgatctctctagtcttctttccctttcctatccccactcaatcgcctctccaaatccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtttaaccttcttcaaag

SEQ ID NO: 54073 - DNA, 1432 bp, Oryza sativa
  unsure (1)..(1432): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtttgcctgttagatctagccttcgcactcttatgttcatttgtattacttttgctatttatcttcactagaaataaaaattttagatgctctggtgcaaagttgccttattttgtcttttcctggctgtagggacaccctcaatctgccatagaacggaagagacgagcctggtcagaatctgaggatgatgagccagtgcagaggccagtgcaacctagcgcaggcgagaacgatctgagtgattgaattagacggtgaagattatggccgaatttgggatcacttcatatatttgtgacgaagaatggctcctgggatgcggaatcaactatagggcgtgctcatatgcacttgtggataattcgatgttgaaatggagctcagacagatggttgaaccagaagtgttaaaaaaatttatctgggagcagagcagtcactgatattcaacaattaatctcgcgtcattctagacatgccatgggttggtggagctaacataaggcaatttgtaatttatgtctagtttacgcttaatcagccagacttttgtccttggagcttctaacgctgtaccaattttagctcacttacatctcaagatagctgatctcctactttgttctttgctgctaggcaagcgtgccaagaaaagattttcaaaagtagctgatctcctaccttgcaccctaattttttagacacttcngntttgcaggcaactgtacgtgctcattggcaatcgcttataatggcctgctctcgtccaaacaaagtaatggatatatagatctaaagtaacgaatttttcatgcgatttgtttcaaggtgcaccttttggggccaaagattttttgaggactgcatatatggtgcattcatggatttaattgagaacctttgtggtgagttagggagggagaaagagaatggccttcaagcttcaa

SEQ ID NO: 54074 - DNA, 10945 bp, Oryza sativa
  unsure (1)..(10945): unsure at all n locations
tgaatggggnnnnnnnnattgagcgcccgtcgtgtgatggatctcacctagatctgattggtatcggcttgcggcactaagtgcagacaaaacatgtggatggtatcagttnnnttgaacctctgccgacatgtgggaccactacaccggcgcaccccgccggccagccttcgcacgtcgaagaccgcgccacacgcaccggcagctcctcctcgcaccgtagtcgcctcctccaccaccagtcgcgcctcttgcgccgcgctggtcagatgtggccgtctgccacacccttggctagccgtccgagtctgccatgcttcctcccaccacaaccacggtctccacagcgctgccactggctcgagctcgccctccgtgtttcctctcacagacgccgtcgccagcctcagccatcgccgccatcagccaccgccgctgccaccacgggcgctgcctcagccgctgccgccgtcgtccatcaccagccgcgcctccagccgctcgtaccaacggccggccaccgttgtctccgcaagcctcgcgtcgtcgtcgctcgccccgctgccgctgactcgtcgctgcgagctccaccgccaccaccgccgccagctcgccccgcctagccagatccgcctctgacgcaccactgccttccccgccgccgtcgccatccccgctgccttcgatccagccgcccggcacagctcgcccctaccgtcgccgtcgccatcccagccgccagatccggccggagcgacgcggatctggcggtcaccgccgccaccacccagagtggttccccaggccacccgggcaaggtctgacggcgagaaacgaggagccccgccgccgccgtccttgcaaccgcgtggctttgccggcgcccgctcagccggcggcgaggcgttgaagaaagatggggggagggggtggccggcgctcatcgcctcccgtgccacctctgataaggaagggcgaagcgagagcgtgctcgttcctgccttgtatatttataaaaaaggaaaatagaaagtgttacgatgtacaagcatgtggtgccaaaaaccatctctatgaacttatgaatgttagaaagtataactcgctgatggtatcttttgttctagaatcgtgattatacaactgatttagtatttttaatttctaatgctgataacgagcatatatacatgtaagctaatctggaaatatacaaagtgaagaaaaaccaaagccaaagtccaaactgctgcatgcctctatcttcttgcaacaaggacgtcctgtggggtgtaaccttgtaaatgtgtgatcatccatcaaagtcgtcatgatactgtccaagcacacacgttcataatcacaattttactaacatgaagatgatataaaaaaaagtatccattggtagctgatgaaaaagcaagataatattatcctcgatagtctactaatgatcaaaatataacatcttggttagaactaccattgtcggtgaaatgaaaaacaaaatcctcatcgctagcgactcagggcatgtctgcccccagggtgctatcctcatgggttgtgctcgaggcacttcactcctcgggacgaccccttgtgggttgtgctcagggcacaactgtgctttgcccccaagtgctcggaagagcaacagcgcattgttaactctcgcaagctcagacttcctcacgtgtgtattctatcaagcctcacactcagtgcgcaaggtgtatatgccaacctggtgtgcgaccggacaacacgcaataggacgaagcacacctatcccctgtagcacgtgtcaccctggaaaaacttttgacttcttcacttcactcgttaatcggcatgtgaaacagtcacctccgctaggcctaagggatatcgacaagaccaagcatgccgaacttaaggagtagggcccactctcatatgtacatattggtaccgtggacccccccccctccccgtttataaaaggaggatccacaccacctgtaagggggcttgcttttttcgatgtcagattaggcggagttaattagactgattcaagccaagttagaataaactcacacttcaagagaagaagagttcatcatctcctacttagaacaacatccacccaatctacattgtaaactttatcaccctcattcataacaagaacacaagagtagggtgatacgcttccgagcagcctaaacttgtctaaaaagaccatatgttcttatttgcatgattcgattgcctcgtttccgctcacccattccatagccaaatcttccttggggggtgccactcctccccgctgaaggagctccatacaaccattgatatacataaataaggcttgccaccaatgcaacaaaacactaaagtgattctctatctatttgtagcctgccaatagataactatttttttcatatatccctattaaaataaaacaaatcatagagacgtgtgaaagatatatgtgatataataggaggtcaattatcagaatccttagagataatttgagatgaaccgtctcatattatgccattgcaactacaagtgctcaattatcacaaaacaaaatttaaatcattttgtgaatgttgctataatatatttattgaaactacagggaccatctaacatccatgatgatcggttatttcataattttacaagtagggatatttaggatttgatactcataaaggtggcatttcaggatcccaaaaaaaaacctccgtgcctatgacatggtggttgttctgatcccacaataacagatgcgtgagtggtacatcctaaattgtaactatttatagatcaaaaaattcaaaatccctcttttaagtaaggaactagttgtgataatacatcacaatggattgagaaatttttcacgccttaagggtgtctcatcattgattcattgtatcaaaatacatgccaatactagttatgaaaaaaaactggtagcattggtataataaatatatgtctactatccgaagatttgaggactaattaagttcgactcacaatgagaaacataaatgacaaattcaaattgtaaatattgcactattcatgggtatatatattttgccttctttttcccccatttagttggttgagagtcgtagtagatgcaatatagtactctatattgttgattttttttcagaatttttatcactatttgtcttgtttttaagaagcagagctacaacagggctgggatagggggtaaaaatccactacctggtggaataaccttcacaacaaaatctggggtgacccaattgatgttcttgatcacaataaatcaaaaatatccaagtttacatgcatgcatgaactcaataccagcccccaattctccaaaagttgaaaaaacaaattctgaccatgactataaattaaatgtggggggaaaaaatcagggcttgtgctagctaccaacaaaccatgaatatatatttctagaagggaaaaaaacaagacaggaatattgacaaggcgagaaaccaacaaaagtgcatgggcaaaataatcagtcccccccaacttgaaaaatctcagctgcttgaaaccccccagccacaaacccaatcctgaactagtggctgtgtggatgaactctgattggattccagctactatttgccatccatttcttgctgaattctctcttctttaattcatcctctcttctcctcttctccttcatcactaggcagtagccacagtagccagtagctagctagcttgtcaagctaggagctagcagctgtgtgtcgtcgatggcatccaccgccgccttcctgtccacgctcgccggctcgaccagcctgggcggcgccacgccggccagcggcggcgggagcgggaggagcaagacggcgaggttcttgaggaggcggcggcgcggcggcgcggtgagggcggcggtgtccggcacggagcaggcgccggagacgacgaagaagaagggcggcggcggcggcggcggggacgagcgggtggtgcaggtgcacagcgcggaggagctcgacggcgcgctgcgggcggcgaaggagcggctggtggtggtggagttcgcggcgagccacagcgtgaacagcagccgcatctacccgtgcatggtggagctgagccgcacctgcggcgacgtcgacttcctcctcgtcatgggcgacgagtcggacgccacccgggagctgtgccgccgggaggggatcaccgccgtgccccacttcaccttctacaagggcgccgagaaggtccacgaggaggaggggatcggccccgaccagctcgccggcgacgtcctctactacggcgaccaccactccgccgtcgtccagctccactcccgcgccgacgtcgagtccctcatctccgaccaccgcggcgagggcggcaagctggtggtgctcgacgtggggctcaagcgatgcgggccctgcgtgaaggtgtaccccaccgtcgtgaagctgtcgcgcaccatggccgacaccaccgtcttcgcccgcatgaacggcgacgagaacgacagctgcatggagttcctccgcgacatggacgtcgtcgaggtgcccaccttcctcttcatcagggacggcgacatcgtcggccgctacgtcggctccggcaggggggagctcatcggcgagatcctcagatacaacggcgtcaaggtcacctagacatatacagattcatcactacgcagctcagctgcatgcagcaaccgtaattaaattaattactgtactactctcttgatcatgattgtaattttacaccaccacactagcttgagaagatcaagcttgttttatactggggacgatttgatcaaacctatctcgttgatttggtcccgtgtaatactagaattttggaacgtcaattgcaagttcgagacttgattttgcctatgattgtatctgtatccatccatctatcataggtggtgttcttatctctgaagatgaagattaagtttttttacgcaaaacaaggtggtattaacatatgattgattgagttttgattgttacaaacttaaaaaatagattaatatgatattttagagcaactttcatatagaaagttgatcatcactactgatcgatgtttttacacttaatggggacgatttgatcacactatctcgttgatttggtcccgtgtaataatactagaattttggaacgtcaattgcaagttcgagacttgattttgcctatgattgtatctgtatccatccatctttctatctatatgattgcccagttaatttatcttctgattaccttctttcttaattaattaccccatgtctcaaaaagaagataacaatgatctgctcaccaagagcaatggaagccacaagatgaccaaacaagaactgctcacaggtttgccaaacatttgtcaaatgcccaaactgaatctgaagatatttacaggcttccattttcagacggaaagaaacagagggtagcgtagggaagctgcctacgccgtaaagaaaagatcaacagcaatggcagcttgtcctccacaagttcacatcatctcacagcaagttgctttcacttccagatcttatgcactacttgcaggtggtaatgtcggtcaaaaactggacaaaattgccttccttggtttgctctgctgactgctggtcctgggatgtcatcacaaggaagcaatccagatcactagatttacatagttgacacaaaagggttcagttcagaaactgctcaattagtgcatgccctaacgtaaaaaaaatgatcttctgttcattggtactgttataaattagcggctgtcagcatcagttatgtcacagcaacggaacaggctcctaacagaagatgaccaagttgcagataccacagaatataaattactgacattctagctaaaaaatcctataaatctcttactgcacaaaaacagcaaactagagaaaggagtagcttgggactattcctctgcctcggcctcggcctctccttcctcttcatctgcagcccaccaagcaagaagaccaagaccgtctcctttaatgcttccctgcgaaagcattagtcagcctagttactcatcaaaggacactaagccagaattcaaataattgagcataattctcaaggcatacaataatttgcattggagcaaatgccctgtcagtctccttttgctcgactgggataggcgggtattttatgctagataccaagaatcgtatctgcgtagcaatcaagttgatcatgagcatacagagaatggtaattgctttgatttttttttagaaaaaaaacagattttgtatacctcatcatctaaatcaagatagagctcatcaccatcttcagtcttcagcatccacctaccatctagcgccctgggggaaatgagcagcaaagaaaataaagcaacataaatttatgtagaaagtactttcctcatgacaaacagaacaaggtagcagtgtgtactcagcagtctcaggtgacatccactgtcctcagcagttgtagagtttgtttttaaacacagataaagtaatccagaacgtatttaagccattgcaaagattctgtatttctgattctgttttagttcctgactgaactaaatttcaatagtatttttttttcataataaccaatctggttgaagtacatgccaagcagatgcaaacataacaagttaatctaagaggaatcaaaatcaaaatgtatgatataactccagagaagagtaagaacctcaagttttcaaattatagtagttactgctgtacaggaacaacaaaacaaaacattacctagccgtgccatactgcatcaagtgcccgggaatgcttatatcactgaagaaatcaagtgaaactgccaaacagatgtagccatatcagctcaaccaattgtttgtgaatgaggcttttcctactaactagtaccagaagaggaaggggccatttgtaacttttatacacatgtgaggcacaaatagtccaacagtaaagaacaggaattagttaagagtacacgcttgtcaaagataaaatttacatattcagtttaacaggatactatgttgaaaacagataactatagttcagaactaccctccagatatttagctagcaatggtttgtgtaccccaagaaatgtaatcactcttatgcaattgaggatgctgattccaggttagtaatcaggtctacagtggcaaagaagcatactatgatattaatcaacatctatttcattcaaacaaaaggatatatgagaaagtaaactagtccattgtttcgaacagcatgacctcaggataaaatagtgcaacagatacagagttaaacatcatatacaaatttcgtagcttattcttagaagacataagacatactatgacatggaaatatgaacataaaaattccatacagtacaaaatgttatccgatgttatagacaactgctacaaaaggaatggaatattccaacaggcaagataactagataagagattgccagcaaaccagctctttaaatgtcaataagaaaataagcaactcaccatgcagacccttttcatcatatccactgatcttcccgacaagaacctccccaacgaagggcctgaacatcagcaacctaaaggaaacctatacaggatggggaaaataaggaaatctaagagtgatttgcaaattgtaggaatcctcagaactaaatgcataagttcactgagacgacgtgttgcacacaccacactaacagaaatactgtaagaaagagcactgatgttaatagacacaactctaatcacaatgggtcattgagaacatgctatgttgtcatcaagtcgatcgcaactagtacataggctcgaaatacactaccaacatgagtaacagaattaatcaacttagagcttaaataagtctccaattgtgctgaaatatttttcaggcattcacctcctacagaatcttatgagacaagtacaccaccaagcagacatgtatcatacatatatcgcaattccatcaccaaaacaaaagggtaaaagcaatgggagcacaaattactttgtaagtggagcagccctctcctggaaagatgaagcctccttcgacggagcggatgtcgtagacggagacgcagagcccgaggttcgcgacgacctacatacagcacaggtggggggggggggcagaagcatgcaacacatcatcataatctcttgtacacaaccgtccgtgagcgagacaagcatcaacaacaggggtgactgagctcgtggtagttgattaccttgtcgaggaagagcctctcaagctcagccttgatggcgtcgacgagtggccggctcagcaggtgcggcggcatcggcaggttgtgttcgatctggctgagcacgaacatctctgcgctaaagtggcggacctaggatttagaagctgtgtattcaaaataacatgggttttttttctacacgtctacacccaaaatcctaataattagcttgtataatatcacgtactagtaattatatagtatatagtatatgcaccgtaacattgagcataggttcgtatagtatattgataaaattggtcataataacatactaatacacaaaatgaacattaaattctctgaattccaaacgattgtgtctcatataaaaaatatagtgaattactgatatacacttagccacacttaaccatatgctagttgaatccccttagctaactagataagcaagtgttaaagttgaataacaataagcggttaaatgaatcctcgattcctgatggctaactaggctaatcattcagtcgaatcggtaaaatagaacttcagataaaatcagcaaagcaaatactaagagcaaagcagcaagcctctatacagactatactaagtgctaaccacaagcgaatgcgccgaaagcgggaagccaagagcaggactaccgctgccgtgcggccgtgccgccgcgcgcctgcaccgcccctgctgcgccgccggagcagaggagcgcacagccccaccggcggcgaggccgagccgacgggggtgggggcggcggcgtcgcggcgaggtttgagaggcgagggcgaagggaggaggggtgtggtttggggtgtaatgggctgggatgggccgcggggcgactaatagctctgatgggaaaaaaaaaggaataagtacatctgaggtcccttaacttgtcaacgaatccgattttcgtccctcaactatcaaaaccggtacaaattagatccctcggcggttttggctgatgtggcacttatatggctaatttgactcgtcttcaactgacatggcactcacgtggcgctgatgtggcaattcgattcgaaaaaataataaaacccgtggggcccacaagtcagttcacacagaaaataatttaaaaatggtagggcccacgcgggccccacatgtcagcctcactcctcccttcatccctctccctcggcttcctcgacaccattgacctcaacggcggccgcgccgtctccctcggcacctccaacatctacggcttcctcgccaccatcgcccccgccgcagcgcacaccaccccacgcccgccgccgcgcctaccaccaccaccccaaatgcggcggcacggcggcggccaccccgtctcctcctccttctccccaatgttgggatccatgtcacggcggccggaagggcgacacgacgagcaatggccggcggggaaaaaggacaaagcgcgccgacctggaagatgccgccgccgccgctgccgcttggtgccaagatctggaggctggccgcccgtcgccattgggagcctggaggcctgctgcctggtgccctctgttcggcggacctcgctcctggggaagacgccaccgtgagccgatggtggggagcgagcaggcaacatcgggagtggaagatggctggcgggatggtgagctcgagctcgccggctcccctcccctcttcctcacctccgtcttcctcatcggccgccacctaccgcgaccccctcctcggcaaccgcctcccacctgcctgtcgacgggatggtaagctcgagctccgcctctgctcctgcggcgcgggggcctcggccgagttggagccgcacatgggcaggaactcggcgccactccccgccgacgacgaggctggcgccctccgcttggctccgccgccccatcggcttcgggtgcaaccacttcgccctcgcgtccaccgccgctgcccactctgccccgtcggcttcacaccgtcgttcgcccgccgccaccccccactcgaccccgctgctctaccacccacgcgaagataggggagaagaagggtgagagaggagaaataaattgctactgactgacgtggggcctatgtgggccccaccatatttatttgttgtgtagctgacatgtgggccccacttttttattattatttttatgtagctgacatgtgggcccacggtttttattatttttcctatatataattgccacgtaagcgccacatcaatgccacgtgggacagccctaatcaaattagccacgtaagcgccacatcagccaaaaccgccctcaaaaccgccgagggacctaatctatactggttttgatagttgaggatctatgtctcaatatcaccctgaatttggtaaaagtttgattgagggttataaacaagagtagcaaccaaaaaaatccaaggtttcaacagagagaacaagtaaaagaataaccaaatagtcccgtgggtgtatgaacagagctatatcaccatgtaatttggtccgatctggctcagtgatagaaagcatgtatttcaggagatgccatctcacagcggcgctcatt

SEQ ID NO: 54075 - DNA, 2109 bp, Oryza sativa
  unsure (1)..(2109): unsure at all n locations
gaggcctcattctttatgtggcttggagccatgaaattcgaaatagaatccatgcatgtcaatcaagttcggaactaggtagatccacctgatggtgtaaaagccattgagtgcaaatgggtctttaagaaaaagacagatgtagatggaaatgttcacatctacaaggcacgattggtggcaaaaggtttcagacaaattcaaggtattgattatgatgaaactttctcgccagtcgccatgctaaaatctattcggattgttttagcgattgctgcttatttcgattatgagatatggcaaatggatgtcaaaacagttttcctcaatggaaatcttgatgaggatgtgtacatgacacaacccaagagatttgttgatccacaattagctaaaaagatatgcaaattgcagaaatctatttatgggttgaagcaagcatctcggagttggaatattcgttttaacgaagtagtcaaggcgttgggctttgtcaaaaacgaagaagagccttgtgtatacaagaagattagtgggaacgcactggtatttctaatcctatatgtagatgatatattattgatcgggaatgatattcctatgcttgaatccgttaagacatctttgaaaaacagtttttcaatgtaggacttaggggaagcagcatatattctgggcataaggatctatagagatagatcaaagaggctaattggattaagctagagtacatacattgacaaggtgttgaaaatgttcaacatgcaagattctaagaaaggtttcttaccgatgtcacatggcattaatcttggcaagaatcagtgtcctcaaacgactgatgagcgaaacaagatgagtgtgattccatatgcctcggcaatcggatccatcatgtatgctatgctatgtacacatccagatgtttcatatgcacttagtgcaacaagccgataccaatcagatctaggtgagagtcactggatagctgtaaagaatatcctgaactacttgagaagaactaaggatatgttcctagtctatggaggacaggaagagctcattgtaaatggttacactgacgcaagcttccaaaccgacaaagatgattttagatcgcagtctggatttgtgttctgcctgaatggaggcgctgtgagttggaagagttccaagcaagatacagtggctgattctacaacagaagttgaatacattgccgcttctgaagcagcaaaggaggctgtttggataaagaaattcgtttctcagctaggtgtgatgactagtgcttctagccctatggacctctattgcgataatagtggtgccattgcgcaagccaaggaacctagatcgcatcaaaagttcaaacacatcttacggcggtattacctcattcgcgagatagtgggtagaggagatgtgaagatatgcaaaatacatacggatttgaatgttgcagatccgttgacaaagccactccctcagcctaagcatgaggcacacactagggcaatgggtataagatacgttcatgattgactctagtgcaagtgggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtgtgccagaggtattattggcacccccggccaaggatgggaaaccccttggccatgcacactttgtgttaaaaaaaaggttcccgagactttttcccgggggcctttttgggatataagaggggcctaataacacccttattgccacgtgcccggtttcctttttgggagaaaggtgttttatcccccccgaaaatcatttaaaaacccttatacctggtttggggaaattaaagtcggctcctaggggaagagcccccctt

SEQ ID NO: 54076 - DNA, 1165 bp, Oryza sativa
  unsure (1)..(1165): unsure at all n locations
cgcgtcnttgattcctctggaaacnncnnncnanaacanngagcaattcaatgggtattttctctcctgccttctttaggagattccgagcctgtgaactgttaggtaagatttcatattttcaaactgaagcaagacccacgttaattggatcaaaaaacaaagcagtacacatttgtatcaacaacaaattaaataaacaaaatttatacaatttctttggacaacttatttcatacctcattttcattgaaaccaaatctatacatgcatatgtactcctacatgttacaccaaccatgacgcatacctgtaacctgcttccacgggtagagaaacaatctttagtcggttgacccaaatccacaatagtcccggttccattaaaaaccgggactaaaaatgattttttagtcccagttaataagaggaaaatctttagtcctggttgttgttacgaaccgggactaaaaatcatctttagtcccggttggtaactctaaccgggacctaagttcataccaacccgggactaaagatcatttttagtccccgttgattccatgttaggccgtgtcagggccctaggatctttagtcccgggtaataacacccacccggactaaaaaatgggttttagggcccgggtttcctctctaactttctaaatctcttgcctaatatttaactgcccttcctttccctccttttctttccttttttttccttaaccccaaagaacccttgggttccttttttttttccccaaaaacctttcaaggcggccggtccggcggcgaaagcttcgagggccgcgccaaaggccgccgggcccgggggccaccccgaaggcgccttttgcgcaggattttgttggtgggcccgccccgcagcccttagagccctctccgggggaggccttctccgcttgtttcgggggccacccccctggtcgtctcccccggaggggaggagggaaaaccccttttaccccccccccgattttcttttaaaatggagactcgggatcatttttggcgctggagaagggaaattctgggtgaatcttttttacacacttcggcgcggaattctttcaaaaatttgtggatatatatgtggagaaaaatctttttttataaagaagtgtggggttctttgggat

SEQ ID NO: 54077 - DNA, 2321 bp, Oryza sativa
gagatcaacccatatttatgcagttagttgtttgacacgaacttaatcatcagtagtatagtgcactactgatttgtgctgaggtgaaacaaaattaaatctttttgaaggtgcaaccggctcatatttctctgtacggtccagtagtaggttatattatttgcaatcgcttcaactgcagttataattcaatactccggcatgatccactagataatctatcagctcaagatatatatagaaaaaaaattaagacgcaaagacgtcttagttcctccttataatgtcaacaacccatggctagtcagaatcattatactgtcgacaacaggacaatgttcttattcccatgtcctttgatttcaacatgtacagaggtacacaaggactatatgctactacagccaaggatgcagaagaggggggaaaaaaagaggtggcattggggtaaggcaatgataacattacaagttaactcgagcaacaaacagctgacaaataaacctgaactggtttcagtacacaatttaattacacgatggaggacgaaagtagggcggccgctgctcctgaagggagaagaggaaaaaacccgactggttttggccggccaagtcgcgaagcgcttgccaagaggggtggtatagcgactgtacaatatcaatatggcagggtcttaatctctctcacatgttatgatggaatcgctctcacatgaagtagctcagtgctttcttcttcctcgaaccgccctcgccatataggtcgttccattgaagaagttcattcatgtttgctgaatcagatgaaacgcttgcacaaacctgtggtaaataaattgatcagattatgaactttcaagtaaagagctcaaaataaatataaaatgtgctggtctcacctgctcatgggcagatttgaaatcatctaaggtcagaggacgaatgtcctcactaccatacaatgcaggctcaggcctgccttctgcttttgccacatttttctcctgaatagaaaggaagcgaaccccatattagcatataaaataaaaagcgttgtcacttaacagtataattgtagtagaagaataaggagtgcatctaaagacagcataaacccaaaaaacaaactttatctaggtcttcagttgacagcaaggtacaagcaatgccaaccttcttttccttctcaaggatttctcgaatggggtaatgagctgcggtcacgcatagattctgggaacacaagcaagtcagtgaaaattgtgcaaccatttccaatcacttgtgttatttgggaagcgcatcattatcaagcataccttcaggtcacttcctgaatatccatcggtcatagtggcaagagaatccatatcaatacctggagccaactcttcctttgccaatattactttcagaatcttttctctattcgatgcgtcaggtaagttaaccattaacctacagtagtaattaacgaccaaatggttagaaatcaacaaacagcaatttttcattatcccaaccccaacacaagggtatagctgtcacctgcgcgggaacctcctaatgacagcctcatccaggtcgaaaggcctatttgtggcaccaagaaccagtacacgttctttatctttagtgcgtaatccatcccaattcaccataaattcgtttttcatcttgcgcatcgcttcatgctcccctggattctctctccttcctagcatactatcaacctgccaaatgttgcattttgtatggatcataccgtgaccaaataaatcactaatgacaataaaaccaacccacatgctcaagcatacctcatcaatgaatataacgcttggagctattttacttgctaatgagaaaacagcttttacatatttctctccttcgccaaaccactgaaagtagaaaaaacagcatttagctttgagaatcacatagtacactgtacacctcattaatgcaaaatttggatgccatcataccttcgatgtaatgcttgacattgatatgttaatgaagttagcacctgcttcagttgctactgccttagcaagcatggttttcccagtaccaggaggtccaaacagcaatattcccttgcaaggctgcaagtaacagatttaccagaggcaatttttaagataggacttaaatagagaaaattaggtagccaacatataatactccatccgtcccaaaatatagcaacctagtactaccctgggatggaggaagtactgacaaccaaatttcccacatgtctaattaacttaaatttacccattcaccactaaaaaattgaacaagaaa

SEQ ID NO: 54078 - DNA, 952 bp, Oryza sativa
ttatgagataccggtttataggaaacaaagttttgatcaggtagaatctgagttcatgcttgtttatggtttgcagggttcagaggctcagaaatttcaggctgcctctttttaaagcagcataaaaccagtgagttgctatcgattaaaggccgctatatcactgaaatgtgttggatttatgatcttttggtttgtaaacctatctgcacaatgtttcgctcgatttgggttctgttacaggtaaagaactccaattacccttcgtatagcccatgtttcggggaaagaagaaaaaaaggttatcccaattgtaacatgcaaataagttgtgaaattgctcaggcaaatctagtaacagctttggcgacgatacacagtggagtagcaggtgagaaggatatcctggcgacgatacgcatgcatagatctcctgcatctggagaggttgcttctcaaaggtttgcatcaggctcatcatccatagatgtcaaacctccatggcctcacagaacacaacaaaggcatgtattcaagttaagctacatagctaataaccacaacaaattcaccattatctttctccagccatcacaaagcaaattaaggagctcatgaatccaataatccggaggttttttttaaaaaaaaggactcatctcagcatccataacaggcaaacgatagttgtttccgacaccaacattggaccataacgagtcaactgacaaccatagactagaccaaaaatacggcggactgcatagataaaacatcagtgtcgagcagaaggaacagctcggcacttgacccccttcagcccatgagagaagtaaaggaaggttgggtcggtggctccgtccttgtagtaggcaaacaccaagccgccatcatcatgcatgctctcaccaaaaaaactgaaacagatcataagacacagcataagaagcag

SEQ ID NO: 54079 - DNA, 1330 bp, Oryza sativa
atatttttggatcttacggctatactgaaatatgtaaatttatggacagttaactcaattttgttgtcatctcaaatcttttgaagacatttgcaatttgttcgacagtctggttttgagcctgtgtgatttagatgtcttttgctttcaagttgggataggataaagaacttgttgaagaagcacatgcagttagattcgttggagtgaattgaactgatttgtagtaatgtcataaggtgctgatagatagaaatgtcagtgtaaggagcagggtttctggccgcttagaatctggttagaaactatccggaatgaaccattttagaaaggagcctttcatagaaaaagtattggccatttttatgaataaatatatatttcttaactcttcaatctgacagaggatttgctagaatacatcggtttctgttgctttttcctatatacatctgtacaaattagggcccctttgaatcacaggaatagaaaaacggaggaataggaaaaacatatgattctgacaggaatgtagtgtaaaacagagaattgcaaaacacaggaaaaacgtaggaatgatcatttgattggaccacaggaaaaacataggaatttgaggagaaataaagactcaaaggatttttttccacaaggttcacctcttgttaaaattccttcaaaacttatatgggaagaggcattccataggaatttcataggattccatagggttcattcatttgattcaaagggctttataggaaaaattcctataagactgaaatcatctaaaattcctatgaatttcctttgaatcaaagggggcctaagttgagtttaattgacaatggcattcaaaatataggttgatcaacttatgcttccagcaaaaatcttttatgggttgtttgattcgaggttattgtaatcaaatccatccatgaagcatgttttggttttgaatttctttgacctttacacaacattattaaaatactttggtagtgtacgtgattcttcattcagaaaatttatcattttaagtattgtaacaactgttgtagtgaaatatgagatattttggaggttttgggtctgcataaatgggaggaatatagagtaagacactgctgataatttatgttgttctgcctatgcaaaactcagattcatgttgcttcgctcaggtcttgtagctgtcagcatgtcacctgtagcttcttgaggctacaggtttaatctccatcattgggcatatttaatctccatctttcattattagcatgaaaaatcagtgtgctattgggtgtgtttaggaagtattatggtt

SEQ ID NO: 54080 - DNA, 1846 bp, Oryza sativa
aatacaaattaaacaatcaaaagaatacaatatatgttttctcaaacatacataatagaaggtttaatattaaacacgagttattatatggttaattacaaagccattctagtaaaaataacatcgcaactgtttcattgtttcgaaacattatgagatttatttatccctcgtctagatccattgacatgcatacgaatttggatatatataaatcgtctcttagcggggatacaaagcccttcttaaaaaagataaatgtattcaaaacccaaaacgtcttatagtgggatacaaaggaaggtattcctaatgtacgccttcagaatcaaagcatagacataaaaaatcaaatcatccatcaacatctaatgtttaatctatatctcattttagatagttcattatctactatcggtttcttataaaccataaaaaaatagctattcctatacatatgtcaccaaatagaattttccttctattttatcttgttcacatggcccaaatattattaggaggagcaacaccattattcattgtgcaaatcaacgatcagcagttaattacctggaatattatcctaatcaacaccattaagcttatgaggtatgcaccactatttctggaatactatcataatcaatttgcacacttcttaaatgaagttgattgttgaatcgataatcatgaggcaaacaattcccagaaaatctgtccactcaggaccttggctctgaaaaaaaccagtgaatgaacggatattgaagaaaaccattatgggtttctttggatgaatttagcattgttaacaatcatcgatgtttacatcctatattccaaagaacacaaatcagatcacttacaccaccatttgctaagaccaatgccatcactgttgctgcccaaatcacttaggacaaaggattccacataaagctgaggaacttgatgctcttgttctattccaaaaggaagtaaaaaatatgaggatttcagaacaggaatgtaggtaaacaatgatcagaaaaaggcagataaacttctccaatctgcttgcaccggacagctgcaagcgttctactgcatcttctgatgaaagccccacgtgaaatgtattcagctcctcaaaaaatgtctacaaggagcagattcacctgttattatatatccttacaaagcacagcattaagactatatgtttcagaacccgtcaaagtctacgatatgccaaattatacaaaagtctacaccttgcgtatgtactggtgtctggtcacctgaaatatagatattacatgaagaatattgccagttcagacccatggcaaagtctcagatgcaattaaaaagtttaccctgagatagaaagtagaaaattgttagcacaccgcatcattctgaattttaagtcgaccaaacatatatatgtgacaggaaaaaattgcaaccagttgctatagaaaaatataaatttcgcttaaaatatcttaaaaataatcaaatccaaccaaaggtgcagttgttccaacctatcttttcgaattctcaaagacaagatcacaaaacacatgaggtgcttcaatctgaatgttttggttcaagatacctttcggcggcggaggaacggcggcgtggctccgtataggcggcggttgaggcggaggccgaggaggaggtcgccaaagcagtttgtcggaggagaccggcgatgcgtgacgatttgagtggcggagggacggcggtgatgccggttgagacagtccgaggagacttcagcggccgagggacaacgacgggagaccggatcggcgatgtcggttgaggcggcggcggcaggcagtcg

SEQ ID NO: 54081 - DNA, 702 bp, Oryza sativa
catgtttgaaagccttctgactgaccagatgtaagactaatgacaatatcaacatttctgatggtcagatcagaatctctagaaaataattgcaagtactacataaaatggttccctaacaaccaccatataaaaggataaagccaaattatttttctctaaacaatgaataaaagggacaagaattaccacctcaaggatccacccaatatatttaacattgttcacatgctgattgacatcgaggtcaccccatctaggctgttgcagtaaacaagagtccatcaaagatcatttaaaataaatgaggggtgagatcaaatattactatttttcttagataaatgattgcagttgaggcataatgataatttagtatgtaactatgtctagctgacttacagtgagcccctttcttatgaattgctctgtagcatcatcaccaactttatttcctgtcttggctaacttttcactctgctcctctgttatagctgaacggtcattgaaatatgggcctatttcagctctaacttcatctggcatttttgaaagtcttctagttttcttgtgcatcatcacccaaacactgcaagaaaggattggaaaaggagcacaattagcaattatcaatgatgtgatcaagcagaaataccaagattggatatcctcataaaaaaaacgatacagatgattcttgca

SEQ ID NO: 54082 - DNA, 1450 bp, Oryza sativa
  unsure (1)..(1450): unsure at all n locations
tttgtaaatgtaaataaatcacttgctaatttatttttaaaacggagcttatcgctggaaaacgaaagtacatgcccgttctggcattcccactcaacataattcaagatccaaggaagcacagagaagacatcatttaatgaggcagctttgggcaatgaataaggcgtaacaaatgaagttgctcttggatctaaattactactccactaataactgacgtctaaaggagagattactgttcttctttgtttttaactgatgttgtgtcttttgaggacaacatagagcaaggatagctacagacttacagtgctgtaccaaaaaggccttggggcatcagaacttttatgttgcatgtactaaagctagattatgtctttaatgaggattactcaagatgcaaatcctgtttctaaatgcaaagaaataacttgatagtttgtgttataatcagggctcgacaattggaaacaaagtgcatgctcctccccacttaagtaggaatatattcatttcttcctaattggaaaatttagtttgccacaaactctatccttgatccaacaaaactggagctgatattactacacatttcttagtcaaccaatgaggaataacagcacctcctaaacatgaggcctatcacgggaaatcaaagaaaaacatggccttctatagcagtaaaaatttcaacccatattcttgcaaaccagcagcagcgaaatatacgaccaagtaaaagattcacttgattttcatcaaccaaccagtatatggagaaatcagaccagagatccacncacatttatgataacccatgtaaaagtaaatattgagctaaatactactgttgcctgagtaagatcttcttttaacgaaatagaaacaatatgcccaggacacgcagctataaagtagtacataaaacgatatctgtaaaagaagcaaaacaaatatgaagtaatttaaaatgtgacaaaaatgaaaacttacggtaaggaattgatagaaagcaaccaaagatacatatattaagaggagcaaaggtttgcaaagaagtaccatgcggggtattgctcaacaagaagctggattttgctgacaacccatatcaagttccgtttgctcatctccggtgtagccccaaaaccatctccaagaagaccagcagtcctcacatggttaagagctgtttcctgcaaaattttaaataattgccagcttgaaagagacatatgaatctataacaaaatgctgaaatgagaaataaaactaaaaacagaatgtgcaaccacttacctgtaaatgattcatcaatgtctctatagaagctgtacgatcagcaccaatctcgtaggaccgaatcatgaagttttgcctaaacaccataccgtcctggataatcctaccaaagccaaatgtgtcaacaagcatgtcaggtttcttt

SEQ ID NO: 54083 - DNA, 993 bp, Oryza sativa
catgcatgttttaatttttgttatgaactaagctagaaatatatcatatggtgaagcgtgcaaatggaatgataagtgatggcagaaacaaagattaattgagctgtggacacgcaatgaaatataagttaaattaatctgattgtacatatattagttattttagtcaatgaggagaagccaatatttgagatatgaagatattctctgttcagccctttggagttcatgtgtcgttacagatgggtagtagatgacagaacagccagcaacatgcaaagaaacaaatggaccatgagaggcccaatgataagggaggtacaatagacttggggaatggtaagtgacttggtgcaattagttgttttaatctgggggagggccagaccacggcagctcacatgaccggtaaggtgttcgacgaaatgtttatctccatgccatttcagtttcctttcctcatcttttgcccttcgttgaatcgcatccatcaactgcaaaatactagattatagcaccttgccccaacttctcctttcttcttcttcctcccttttatttctctctcgcaggcaaaggtcgcacgcagctgcgggaggccagcactgattgggccgcgtgcggcggttgggcggtggtctccggtcgcgctgatgaaatatgcagtttgaccaagggcaaaagatgatggaggcaaagtcccaaagttttcaactatatgatttaatttgttaaatgttatatattataaaaaaacaaccaagattccatgccatatcaacatttgcaaacagctagtaacattttctttttgcacgtgcagtatttttcgttgaattatccgtggctggacatatcatcaattgatcaatttcctaaccattgcgattttctcatttttctgaatttttttttggctattcggttgattaacacgtcgccgtcttctgattatcgctcctcgtgagcgcgtttgcaacaggcaaaacgtgg

SEQ ID NO: 54084 - DNA, 1355 bp, Oryza sativa
ctctgaaaaaaagagaagacaaaaaggaaaagagggccatggtgaagaggcctccgtgggccgtggcggcccagataagagttctccttctcactgacatgtggggccaaattaacggccgttgccgcgtcgcctttctcaggctcaaagaagctcgccgccgccgccgcgacagctcgcctcgccgacgagcggcgtcacccgccactccgcatcgatccggccggcgtcggtgagatccgttccaccgggccggcgccgccgatgtgtgtggccggcggcgagacgccgggtggagatatcgccgacaggcaatgggggaacgagggttagtattctttggtggactgagcggcgagctatttattctcgatcgatcaagcagagatcctacaatgcaaatggatgctctttttctggtcactgaatctttaaatgttgcgagtcgcaactgcattctaacctgcaaaaggaggctctctgttcatcaaagtttatgtaaaataatatactccctccgattcatatcataaatcgctttgactttttcttttaaattaaacttttttaagtttgatcaaatatataaaaagtatagcaacatttctagcagaaaataaacatattatcaattattatacttaatgaaactaatttgatattgtagatgttgctaaattttctataaatttgatcaaaacttaagaagtttgattaaaaaaacaacacgatttataatatgaaacggaggctactagcatcagatgcagtttcatttcatacatctttgagttttatacaatgactagtaccactcactatattttagagttcacctcaaaacgtgcactggttcaaacttcacattcaaaaccaacatcgataatttctcttccaacaaaagaaaaacacttctccaaaaaactcttccaaaagagaaatcagacgtagttgttagtctcatcatcaaatgctgtcattccagtcatccagggtacatacacacatcatccaaatccagccattctttttaccaacttaacgtccctgtatatttaactgaacttgcttggataaaacttactccctgtatatataactgaacttgcatggacaaaacttctcaaaagatttcaccaccaccacactggtgaaaaacagttaaaacttgcagtaaaatctactccctgacagtacgtccaagcaaccaacatgctgaaatatagcacccctggcttctctgtccaactccaagtttccaacaaccaaagttgccagatcaactgtgatcagaagcatatttacctgaactggcttggacaaaacttgtcacaagattggtgaaaaaacagtgg

SEQ ID NO: 54085 - DNA, 1008 bp, Oryza sativa
cgctcattcaggttgcatagattgtacttttgcttcattaaatgtatccactcacattattttattagtatatattctatatattcctgcctaaacctgcttcatggatttctttttcctacttggccttattttgttggtttaaaagcagagcagcgcacttgtcatggtctccttttttactgggggtttgatctcttttgtcagcacaggctctgattttacctcctagacattcaaaataggaactctcttcaattccagttccagatactgttcctcaagaacacaggtactaattgatgaagtatcctctaaaagatacgttgaatatagtgctttttcatgttgccgttcctattttattcattccttgctatgttgtgttctctaggtccaaattccacttaaggttgtgactctctgtgcaagtagagatgtgatttgtcaaatttggaacggcactagtaattgtcttatctcatcatgtttttctgagtgtccaaatttttaaccttttcttttccttcagaaggtaacagactttgcttgtatccaggttaatgtcaaacttcgattccctgttgtattgaattaattcatggaacctacaaatcttccacctgaagattttttgcctgcctggaattctggaaagcattagctgctcagtctctgaaagtttaagatgtggtaaggtttcagttctgttgtggataactagtgagttgtgaaggaatacatttttttcatgaaatgtagaattggataatcttccctcatggttttgcttgttttttcttggtactgatgatttagtgtgtcttgttagattgttactattgccttctagcataatggatatagcaagtatgtttagctggatagtaatgttgtgctctattaaaaacaaaggaacaatggagcggattgcccttaagtttctggtttctccacgtggtcgaggctctgattggcgactttggtgggcaaagcccttctctaata

SEQ ID NO: 54086 - DNA, 2999 bp, Oryza sativa
  unsure (1)..(2999): unsure at all n locations
atatatgaaaggtttgatggtgcaagtttgagatgcagaataattaatgacctatagacgcgaactttctagttttgctacacagtttgagttcacattttataggtgctagctaggcgttaaacggtttgtaggaagttgttgagcggtatagctatagctcttttgttagtctagcggtggtcgataatgcttagtgacagctagtcggattgtagtggtggtgttttctttttccatagcttttcatggttataatgccataatttttttttcttgctatatgtgataaaatatcgcacatatgttattcatttgttttaaaaaaatatgtttttattgagtaccttctaatgcgtgccaccctgaaatcattaaagtgataatgtgttaattttcgctttattctcaatttgcatttggctgtcgtgatcagtcaccagctagctgcagtgtcgttgcatttgctcaaattagccttatcaaggctacatgcatccttcgattctccaacgtgatcaaatctcttctcgatctgcattcctacacaagccattctatgcttagctagctagcttgttcagtgtaccaaggttgttacatctcaggtaccaattcaaagacaaagggattatatatatcactcgtacatagacagcaattgcttaattcactgacagtttctattctgtagtagtgtacacaaatgtcgtcctcttctatcgatgtggtacatcagatggttctagaagaaaccgaaatggccatacacatacacagtacttaacttgtcgtgctcgatcgcacaacactgcaccaattaatctttttttctccgttaattgtgatcaacaaaacatggaatatgcttcacatgcaagagagctacgtgaatatgatttttttttgcccctgtttgtgatgtgctagggaccaaaaaagaagcatgaaaggagtggtcataatacaatgttactgcttgtggaaatgtcatagcctcctagacgaatcacgtctcttgtccctacgtactgattattttgggtcacatcgagatttatgaatgaagtatattatgtggggttatatctatcgcatcagaagattattttgattaaaaaaatggaagttcttgaatatatgtaatcaaagagttttatttgaaaaaacagagactatttaatataagtacattggtggtgtttgaaactcatgaagatgaagattaagttttagcgcacgtaaaatgagaaagctattaatattcctcgcaaaaaaaaagagaaagctattaatatataattaattaagttttaattattataaactcaccagataaatatatttgatatttgaaagcaactttcatatagaaagtttttaaacaaaacacggtgcatgagcccgcggtggcatagacagcgtcgggcggcggctccctccccttcgacaacgacgacacaaactgtgtaggcggcaggcagtccgcgatggaagacggtagggcggaattggccgccgcggtgcacgagtccgtggcggtgcagacgacggctccctccccttcgacgacggcgacancggtggagtagtcggtaggtcggccgtggcggcagacgacggcctcgcctccgccagattcagcgagaggggaagccgggcggtggcccgacgtaaggagggaggccgggcggccggcggccaatggattttttttatcttgtgaatgatttgtatattttttttagatttttgttgatttggggatgattttgtgattgatttgtggattgtggatggacatttattgtggatgatgatttgtggatgatttctagggatttgggtgtgacggcgtttgtggtcgaaatcagtagatgcaagcagctaaaaaacaattaaagaaaaagaaaaaagaaaaaaatatggtagcgccagccacgtggcgctatcatctttagtcccggatttggggtcctagtttgcaacctggaattaagggggttgcaaaccgggagtaaagataggtttttccagcagtgcgagctagttcattaagataataaaccaagcttggcacattagttcaccctattatcatgtagagtcttcacttacggtgctctctactggtagtagaaagtaatataaatcgttgatctcatttgatcgaagggttcacatttatttataataccatcttagttagcggcaatagaaacgtggaggggtattattgtctgaaaaataggtgcggaggggaatcatcatttagtagtgggtaaaccttgttttgatatttttcatggaatatgagtgatgccagtgcgatggatgatcatagatcaattatatttaaccaggaaaaaaaaatgatagttcctcctaatcatggtattatagtaaattactaaattatgcctaattgtggtattaaataaattactaattaatctctaataatattggtagcttattaataccggtagagagcaccggaatatcgctcaccaaaatataaaaatgaacaaataagttaagcaacatactttaacacaaattgcccgacaagatatatgtactatagttagcgtgacagcaacatagtatatggcactgcgatgctctaacgcggtcattggctagtacggagtacgttgtaagcgcaatttcagattcaaaatatcaagcttttggcacgggcatataacaagcctcatgcatgcatgcatgcatgcatgcatgcatgttcatcctaaaagccaaagtggccgattaggtactagcaaatattctttgtgtcctatattatctattgcaagacctacaacgtatgtcaacaaattaagataagcaaaccaaaggccatcaactttaacttttctaacattttaaaggggtgtttttccatgaataaaatcatattagtcaagtactagaaatttccatgcgtcctcttttcatgcatgcatgccgccttcatttatatatactttttg

SEQ ID NO: 54087 - DNA, 5256 bp, Oryza sativa
catgagggtgagttaagagccccgcacgtgaaaatacccttattttcacgtgtggatattttaagtggttcacttggaaaaattgatttttttgcatacgcgtctcttgaggagctgtatgggaaaatatgggtcgatttatagacgcggacacttataacccgtttgcaacctattgatgtgttcgtacagaaaaatcatttttagtagtgtatatctcttcctattcgttagttagacttggatttatgttttttttttcaaatagaggaacttgaattgaatagtacttgattcaagcttagcaattacatctacagtttattacattataaagcataataaattatcattcctcacatcattttcataatattttaacccaaaccaaatgtgtccttcatttctataatatttagcatatattcatttccatatatccaccaagttttatctagttaaatgagatctgaaatcctgaacagtttggtccgtgtatatatgcatgtgcatgtattctacacgtgtagggagagtcaactgcaacttgagctttcgactgtatggcttccctgaatactctgtcgtactcgtaaacgtaaacaaagtcgtttaggaaaaggtttaagtcaaactttggaaatataaattataaataactttcaagttgttgagtttaaaaatataaaaattatatgaataaatttgtcatgataaatagtttcataaaaatatacatatatcacttttcaataaatatttttatagaaataagaagtcaaagttgtgttttggagaccgtgtcgctgtccaaaatgactttctacgagtatggagggagtacactccactgcattcttctttttcttctttctctttctgcaatgcaccgtatgtactcacataggtcgcagtctataaaacgtttgagcgagaccaaaaaatgagtgtgatatgcacgccaaaatttactatttcttcatgtatacgccccgtgatattagagtgcatgtaacatcaaacagaaccactaaacagtagtatggtaaaaaaaatcaataattatttatgtgtagccatcggaatgatgctctcactagggtctgtttagttcgcaaaataaaatttttttttatcacatcggacgtttgaccggatgtcggaaggcgtttttggatacgaataaaaaaactaatttcataactcgcttgtaaaccgcgtgacgaatcttttgagcctaattaatccgccattagcacatgtgggttactgtagcacttatggctaatcatagactaattaggctcaaaagattcgtctcgcgatttcttccctaactgtgcaatcagtttttcttttaatctacatttaatgcttcatacatgtgtccaaagattcaatgtgatatttttgagaaaaactttttaggaactaaacggcccgttcactactagatagcgaagaacagctagctagctatatatatatatatatatatatatatatatatatatacacgcgcacggcttggacttggcttatgctaattcaagtccaaatggttgatattctgacgttttgaataaattgtaaataataatccacattttatttgcaaaaagatctggatcgatgtcatgatcatatacgtgtccatatgtttgccgttctttccactaaattaatttaattttgcaagtcaactctcgctccggtttttataaatacgtacaaacattttgtatttacgtattgtttcgtttatatcaatataaatagaatttgtatttttagtaaacaaatcgatcaacctagctatggtcattttagaccccacaccatgataaagatgcaaatatatattcttctacgtggcatttttcagtcctccatgtaaagatatatttatgacctctattagtaacacgatacaattaattagtgcagacttttgcactacgttccgatgactttgtatacgtgtgacgtgtagtctgcagaggacttccagatagctgggaaaattatactgtatatgcgtactgtactctgtaagctgtcgctgtactctaatgtgttttataaaaagaaatacgttaattcatgttactccatccatttcgtattatatataagttattttgttttttaatcaaatttgtttaaatttgatcaagtttgtaaaaatatatactaatattttcaatacaaaacaaacatattaccaaaatatattcaatattaaattcaatgaaactaatttagtggtgtagatgatgctaattgttttaataaatttagtcaaacaaaaagatctttgataaagaaaaaagtcaaacgacttataagagcaagtataatatagtagactataagccagctaaatgctgaggtggaggagagaagacaggagaagcgggcacaataaccaataaactctgtgagagagacaagtgggccctatattaattataaatagctaactatcatataggtagactgagagaaagctacaaagaaccttatagccaacaggtcgactgtattattagccttgctctaatatgaaatggatggagtactagtaatactatttacattagcacttttgttgaacagttaaatgatgtgttttataaaaaaaaatatgtataatttttttcttaaaaaattaaataatttatatttaaatttgtaatatttaatacttacttaattacacactaatgagttgttcgttttacgtgtcactaatatgctacttcaatatagagtttcgaacagcccaagatttgttatatatttaattgctataacttaacggtcgagtataatacgtcggtggtatcataaattgcaagatgggtgcagtttagttattcatcttataaattgctcaaatatgtcactcattttgcttcgatggtgcaaatcttaccgaatacattgtcacatggattgtttgttttcaaattggaggtcgtattgacctaacatcgtgcattttttagctatgtgagcagggcaagcattacaattacaaattaatacacatattttttatgtatatcctaatactcatgtttttaatgaacgccaccatattatgcttaataatcaataacaaaattcatctttaattggattttaataccggtagtattgcacgttggcttatttatagatcgtgtgatcatgtttacaaaacaaatcaacacaacacgtaacttcattgcgaacaccctacacaacatatgttttatgtgatttgcaccctaaaaacaagataagatgagtaacttattcgagcattttacaagatgggtgactaaattacacccacctcacgagttgagttactagcggtgcattttagattagttcgtaagtgttgatcttgtttactgcacccacccacacgtaccattaatgcatcaagaaatcataatatgcggtggtcctcgataatataataataatagaaactaataccagtgatcgtctgggtgtgcattggaaaatctatatacttcacttatactatactacgatgtaaaccagattgttcataagtgttgaccttaatgcaatgcacgttcaagggcgggtaagctggttaagaaatcatggcagctgtcaacacaattccagagttttggggagggtcgttgacttctggagtatcttaatttattgagcaggaatcgaaaatttttctttgtatatttctaaatgggctttgaagtcaggtaatcctcaacacagagcaagatcttcgtatggactatggatgatgatatataatttttgagtacgagccaagtcgttaattaattagtcagtgtattcgcatgggctattattaattgaacatgaccgcacactacataactatttctgtatggaaacattgtttcgaataaatgttagtgactactatggatttcagaataacaattttgaatttcagaataaatctatctatctatctatctatctatctatctatctatctatctatctatctatctattatatactaaaagtccattaaacttcctacaatcgctcctaaactgccacatggcatctctacaaacgcttctaggctgccaagtggcatttaaaacatctaaccattgattttcatttaatccggtgaactcatatttttaaccgttagatctaaaataccaaatatatttaattcatctttaaaattcagaaagccacacatccatgtcgatcactcacgtacgtgtacgttcacgtatgtacatacttcgttagtgtacgtccttccccttccttcctttctttttattttttctttttctttttcactcaaatgagataaaaactaaataaataattttagccaaataaattaaatagggagtagctaatcttaaaagcactttacaacattattattgtcttaaatttattacttagatattaaaaacttaatatgtagtatacaatataatttgtcaatcctagcctaaaatatcaattgtatatcctcaatgatccccatatatataagttttatatataagtcaccatttactaatcaccaagtcatattacttatgaggtattcgtgcacaacgcacctaacagccgggtagctgatatataatgagcatgtatgtcatcaaacaccgatgataaagggcatataagtgtgcaacgatcaacaaattataggtaagtagaggatgcaactaatccaccgcaaacaatagttgactaaaggtagattgtgactatgagtaatagcatttctatactcatacaaacgcttctaagatatcatgtgatgctctaattagaaataatctaagaaaaactgtaaaataaaataaaaataatattcatcgatttacacacaaaatcggtgatccattatttttcaaccattaaattagatctatgataataatccctctgtctaaaaaccatctaatcacttcttacgtacatacacatctcctatacacatctcctatgtacatacctacgcaagatatataaaaaggaaaaaaagaagaagagtgtgtatatgatttgtcccatatagttgttttctctttctttctagatccaagcatatacgtagtgatcactccttgccacgccgctgtctcatgccacctgttgctccaccctcttcctgtcaagtttttaaggaaaaaaaagaagagtgtgtatatgatttgtcccatatggttgttttatctttatttctag

SEQ ID NO: 54088 - DNA, 2744 bp, Oryza sativa
tgcctgcaggtcgactctagaggatcccccaatgcattacaggttggctacactcttgcttaaatagcaagatagtactactactcatgtgcacacaatgcttatagacaacacatgtcaaattctttaaataaaaaaatatagaccacatcctaattgcactaggatgtctaagacaccctctcaaaggatccgacgttcccgtcggtccaacttatcttcatagtcacatatgcatatagacaaatatccaaaaacatgtcacctcttaatgcacgtccgtacgtctagtgatcgaaacaagcttccaaaacaatcccaaaaaatattgataaacacagatttagaagagtaaaaaaataatttttttttgaaaaaaaatcttatacataaatattcatcacaaaatttcaaacatcattaaataaggtgcccgcgcatttgcacgggctaccttcctagttgatttaaattccataactgggtaggcgttgtttagcataagtaacactcctcagtcaccaacccgctcctgttccccttctaatttaagaaaaaaaaaactctcacctttgttctatcgctaggatcttcacctatcacccaccctcccccgcgtcctctctactgtctcactcgcctctcatcccctctactctcccacttccttggtagcctcacccttttctttttttactttgggagagcaagaaactagtgagagaaccaattttcgggtaaataaattgtcgagatatttttttcttgaggttaacttttttatcacgagagagcctaccaagataattgattgatgcttcatacgccaagaggggtgagagttttttttttctttattaggaagatgagagggattagggaagggagttaccaatataaaaaaatttaactagaagggtgtgagcaatttttcttcatcaggaggagaggaagtggggtagagtataaagataaatgccttaagcgactctaaagggtcccctgatagttttttttcccattagggtatgggtcgagagcttagaaatagaacatgtacatgtgagaggagaggagcaggataggtgtggctacgaggcgtgtagtttcgaacaaccattcaatttcaataatatttctaaaatccaactctatagttagtactatcttcgtccataaatctaactaattttcagcatttaaatttatctcacgatatacctacttctccacttatcttcttatctgaatcaattacaaccatgtaaatatagctacttccctacctattttctcatctcaactaatcagaactatctctaatttaatttattcatctactttctcatcccaaccaacctcaaccataccatttctcacttaaccttaattccacgaaatactgagggaactatgttattccattttcttatagtttaatagttttagaagtcctaactggcgacgggagttataagttacttttttataatttaatattttgaaattttgaaattaataaatacgagtattgagctgtacctgtctcaatgtctcaatctattattccttaatttaataatttttaaatttgatattaattatcacaaagttgtactccctccatccacaaaagttatatctatttcacatttgagtttttccaaataagttgttcctatctgtagtctttatgtatttaaaacttaaatgaagagataaattaaatgttttattagaacccaaggagtcatctaaatactcattggttgcatgcttgcattcactctttgattttataacatctaagatgatttaatttctccttggttttggtgtcagaagtaatatgtgtaacttttatagatgtagggagtaactgccttggacgtcaacaaattaaagaggcagaaactgtagcgtgtctcaggggtcaagatcgatggatcatcaagacgggaaaaatgtacaacccaaacgtgacagatcgatgcagatatctccttatccttttctttttcctttgtcttctttttttttcttcttctctttcagaagaagaagaagaagataatttgcatcgagatatttagcagcagctagctttacatcgaccctgacctgacgattctgctgctgagacggccagtcaaattattcctctcccatctctagctttttaaccacacaaattaaaagctggcgagacacaaagacatgacacacttaaagcaaagtaacagtactgaatcagatgtgtacgttaagaatagttatagactcgacaggagatctgctcatctccaaattaatccggcagctagtactagctgcgtactccctccgtactccgtactcataaaggtaatcgtttggaacaatgtttaaattaaatcttaggaatataaatcatgaataactctcaagttgttgggtttaaaatgtaaaaaatatatgaatagatgtgtcttaaaaaaatactatcatacacttttcaatatttttatagaaacaagaagtcaaagttgtgtttcagagaccgagtcagctgtccaaaattgacttcctttacgagtagggggagtagttaactaagctgtgttccctcctccgacacgtaaaatgaagctcgtattactgcatgattaattaagtattaactattttttaaaaaaataaattaatataattttttaaaacaatatttatatagaaagtttttttataaatcacaccatttagta

SEQ ID NO: 54089 - DNA, 7216 bp, Oryza sativa
ttagtcccgggtaaaataaccgggagtaaaaatcaaattttagtcacggttggtgttactaaccgggaataaagatagagccgggctaggccgggtgctcctttatttttttttcttcattgattttaatatatagatttcactccatccctgtccccggatcgtcaaatcccaaatcaatcatccctgaatcgtaaaatctcaaatcgatcatctccaaatacatcacaaaatcttaaaaaaaattacatcacaagttttgcaaaattcatcaaaaatacatcacatattcacatcacatacatatcaaatacatctcagatccaaaccacaaattctcaaaaaataacatatctagccgctgctgcgccgccgccggcggcaggcgagcagagcggccgccggtgcgccgcccgccgccgcgcaggccgccgccgagtaggccgcctccttccgcgagctgcccggccctccgccgccgcgtgcaaaaaagtggggtgtgggaaggagggggaatgggaggagaaggagaaggaagagatagaggagttaaaggagaaatagatctttagttccaggactaaagaaaatataggggtctaacactgcctgccctcttttgaaccgggactaaaaatgttctttagtcccagttgatgttaccaaccgagactaaagatcaaaaagtacccctaagcttttaaaccggaactaaagatatttttagtcctggtttttaatacaaccgggactattatgaaatttggccaaccgatcaaagatggtttctctagccgtgcctgtttttgttgagactggataggacatccataagatagcttaactactaaattagggtaaaggaaaattttaaatgtgcataaattgtgcacactactgtttattaatgtttcctgagagtattcctataatactttagtactaattataattacttcacatatataataagcaaaacaaacactaatattcattaaaaaggctaattttctaaccaaagctaatttgactataaggagaatatttccctaaatgtgacaagccgctatcatgcatgctacgttattcttgttcgtcccaccaaccaaatatatggacaaaacctagtcatgagacgttcctttcctattcccttggtcgcactaaccaaagactagctataattgtgcaagtagtgattcgtgtacgtacacataagaacctcatggtgcttgattttgtctgttaacgtaacggtgtggtacgttaaatttttttttgccaagatttaattagtttatctaattaatgtatcgattactcttaaatttaaccatttcatcgacacctaacgatccatttttttaaaatttgtgtgaaacaaatattgttctaatttaaaacaaaattgtacgtactttcgtgaacccacagtccatatacgcaataatatcaaatatatattgaaaaaacatatctaagaaatttcagccgactaccaaaaatgctatttttcataggaatgttggaccaggaatcagccactgcaagttggattaatggcagccaacaagaagccaatcactaacgtagctgtttcccagaggatcaaggctccattttgtgctcggaatattaaacatatagctaggtaactggtaagcgcgcactgccaagtaaaaaatgtcgataaaaactgcaagcattctccacgtggaattaaccgtcaaaattgctagaaattaattaccaaaagttaagctggaaattgaccgtgcatttgtttgcttttatcaccgcgttagtccatgttgtcctcttcaggcgttctaatttgattgtttttttcaggagttctttaattaattatttccagttgcatgcattttttaataaaggaatatattattccggcctctacataagacatgcactcaaccattcattattacaaggatttccaatttcaaaataaataacactaacaaaatagcacgtttataaaatttgagcttgaatgagaatgcttaagcacaaaacctactagtaaacatccacccatgcttgcacatatttacagttgcatgtatatataaaattacaaattaaatttgcaatgttgcatgacacgtttttccaaggaccgttatttctccacatcattgcgataagaacaagcaaaaaactttcgcactaagtgttcatatgcatgatagtgggttagctgcaaagaatgatccgtttaaattctctttgatttcaaggttgatctggtcgctgccgtgacaatttgctgcatgactccatgaggattgaggatggtcgcaccgtcctttgatgttgcttttctctgtaccgggtatcgattccgtatagaccatcttgtcaattaaaattcggtggcaccacaaaaaactaccaacagcgataccttctgcatttgtcgtagtccaacttgtaaagtgtgttattggtcgtgattcgaatactgacagaacttggttcctccaaagcacatgaaagctctgaggaatttcccaatgcaagtttatatctcttccaatcagcggcggattgatagctcccgggcaggttgggcgcgcggccgcccgacctccgccgctgctatctccatcgccgttagccattgacgtgtataaaaatcagtcggtcaccgaaaaatcactattactcgtccgggtttcacggtggtgctggttccgccactgcttccaaacgtatacagcttgatcgattgtttcgaacatatccgctctacaatttatatgaacttctgtacgtatggataggccgttccaagtggtggaaaaaaaagaacaaacaattagttaaacacaagtacctttatgacagtctctattgagtacatagtattactagtaggtactttcaatattattacaagtatattatatcttaattgtttaatcatgaattctactactagtataaaaaaattattctactaccgtacaattagtatatatgtaaaacgtctatttgaaaaagtgaaagcaaataattagtatacatgtataaaagtattcggtgatcagaacattggatttgcccttcttttcctatacttacgagagtagaatgatacggggcgccatttggctcgagataaagttttgtttcgccagggcatccacaatgtggcgtaaaagtagtccataagcaatagaatattctattcagccacctattctcattgtgcaactagtccatataaaaaaaatagcaaaagacacccatatgcatatagactaccaatatggaataaattatattatctatctctactcctctctcttcttctaatgatatcttgtatctatatacattgtgaacattgtcatagggataaactatttatgtgggttccatctatatggattactttgccatatacattggtgatgccctaaagatgctttaacattttttttgttttagttagtgtttatccacctatatatatcatcctatctttattttttaataaataatgctgttaactttttatcacacatttgatcattcgtgttattaaaaaaaattacgtaattataatttgttttgttggatcgagttgtttcgttacttaaagtactttaatcatgatttatatctcacatattttcatagaatttttgaataagacgaatagttaaatatatgttaaaagtcaacggtattctctattaaaaaacagagggaatatatgactaaattttaatacttagtaaccttagctagctagttgacaaattaatcattctacatctccgtacgtgcatatatatatatatataacggaaatatcgcctagctagttccccctagtgtaggcaatcttgtctaagatccacatatctaactaaactcaattagattttagaacactggagaaacatggatcttgttcccactgtccatacataggaggaatataatctctctccttcttttcgggaagcctgtaaatggaacgcataggagcatgcggttctattcccacatatactactcttttattaaggattgacatccacatacagagatgtggcttactcctgcagataaataattagaccatgtggaggcctcctcctgcctagactttctttttgcctatccatcatattcatatactccttccgtttcaaaatgtttgataccgttgactttctagcacatgtttaaccgttcgtcttattcaaaaacttttgtgaaatatgtaaaattatatgcctacataaaaatatatttaacaatgaatcaaatgatagaaaaataattaataattacttaatttttttaataaaacgaatggtcaaacatgttttaaaaaatcaacggcgtcaatcattttaaaacggagggagtatattgaaccaaccttactaccaccttgcctcacctaggtcattcttttaaccaattatgtatatagtgtaatatatatagtccttttagtttagtttattaccacttaatcagttttggatatgaatgttctgtgacttatcgatcgcgattatatgcatttggataaaagttttagttagtgtaactggcaataattcaactaatttctcgactaaaacaaatgatccctaaagggaaaaaaaatactctgttgggtcaccattttcacgggagaaaaattcaatacaaatggaagaattgtggactatactactatttgaagtgaaaaaaaatgtgattagtatgaatattggctgattttggctacggtaactgagctgcataaaaaactcctatcttttaattgtccgatgaattatatataataaaaaatagacttaaccgggatattttataataatctttactggtagtagaaatcagtctaaaccgtttattgtttctaatccaatgtaccgtttctgtttttactaccatatcaactaccgatattacaatagatttttctattgttacaagtcataaataaattattggaacttgtactgtgataatgctaatagtacgttctactacttgtagagatcaacttccggttgttataacagattatttaatcttgtatggaatctaatctctgtcgtttataagagaatcttgtgttctgattcttatttggtcactatccatggggtcaccgtcttttcttgtttgttcaagtggaatatctcttatgaattattgtaagaatatattgctaatgccttttcttccactgatcgattcactttattttttgacatccttttaactgtcttgtggtcgaaaacttctacagactgcaggcaatttgaacttgaggtcgcttgtcgatcgtccataatttatagccgcattttaaccatgttaattagccaccagcaattgtcggggaattcttcaacacatcatttggatcactaatcttttatataactttgttttaacccattattaattgcaagcagcttgctagccacaacaatatgacacagtaggatagtacttcctaatttggtagcaggacagagcaaggatgaactagtgatagttttttgtcctacatctgaactgcgaattccctttggaataaacaaacgtaaaggctgttcttgggagaggcaggccaaccaagctacgattgttagtggcatccaatgtacacacaacaagatctctcctcgaattgctttcgtgagcattagaagtgtggagaagcattgctttttatgctattggctgcaagaacttaacgaagaagtttcagaaatcatgttgagatgttttctttctttatcttgaaagcaatggcgaggctttatcaaagatctcaatcggttgtggtgacaaaaactagtacagatgacagttgtttgtttctgtgcttaaaaaaaaattgtaccaaacatatgatttgttatgcgatgtgttcgaattatgtaactgaagaaagaagttgactgatgtatagtttaagtgacgagcttccatcatgtcgcaaaataaaatatgagaccttgtaaaaaaagtacaggtacgatgagatgatcctcctctcaaacttggttgtatatgtttcaatctgatcatgactttaaactatctgttaattttttattagtaattttataatgatcgatcatgttcaggacggctccagaaatttaggtcgcctgaactaactgcagcacatgatagtgattagtgtgtaacctacttcagagctgcatcatgtcaaggaaacataagaaaatcaaaggacaagactaatacctagagcatccaagagcacatcaagtggttgactttagatttaatgaacttattaatacgcttactttgtctatcaatgaagttagcagccacaataataaagacctggtcccagatcaggagtacgatgcatcagaagaaaatttgctctgctttgctggttcattctgattccaccagctgtttgctatgatgaaacctctctagtattttctgaaacttcacatgtcagaccgtttactttggagtaacataagaattaagaaacgcagagtatgaaattgaaagcgagattaaagaaaaggaagaaacaatataatacttttagtggtccaatcgtcggttaattaagttattatccatgttcagccatgttatgggcgaaattcagacgtttttaattaaccccataaaagttgatagattctgcaagagcgatatgacattacacgtatctttcacacgcaggcagggctgcgcacacgtgtgatcgctctctagcctattttgctgaattgaagaaagatagtactccctccgttacgaaatgtttgacgccgttgactttttaacacatgtttgaccgttcgtcttattcaaaaattttaagtaattattaattcttttcctatcatttgattcattgttaaatatatttttatgtaggcatataattttacatatttcacaaaaatttttgaataagacgaacggtcaaatgtgtgctaaaaagtcaacggtgtcaaatattttgaaacggagggagtacatagtcatgcttcgtcggcagggtagctcgatcgatgtctgcaggctgcaatgtcgtcagctagctcagcggctatatatgcgtctccttccttatctgatctacacaagatagcccaagattggaacgaaatgtcactcgatccatgcttatcttttt

SEQ ID NO: 54090 - DNA, 1025 bp, Oryza sativa
tcaaaatgtgctatctaatatatgatcggatattttctagtacaacaaatttaaactgaaacctattttgatttgttatactataaagtatctaatcattagctaggttagtagtaatatttcgggacgaatatagtacaatggatcagtgacgaaagcagcggtttcggatgcagataccttggccatcgcgacgagcaatcaatcgatcgatcgatcaaggcggatttttctgacggattgatggtgttgcggcggttgggtccatcactccgaggcgcgggcgtcgtacgtcagggcggctggcttggctgcggagattgggccgggtagccggccggccgaccaatttactgactctctccgccgtcgtctagccatttactgcagctgctgctgctgctgctgctgcggctgtcacggcgttgtgactgaacgccgaggcaaaaccgtcccggagctgacgaaatttgttcggtgatgagatgccagtggttcttgtctgcaaacgtcgtgacaatttacatcattgccggaggtctgcgagtcatttgatggaagagaagaaaaagatgtctcggctatgtttgaagcaaaggtttgagaaccgtttttcctcgacatgcaaaatggagggttgagttagcacatagttaattaagtattaacttaaaaaacttaaaaaataaattaatacgattctttaaagtaattttcctataatattttttttatttaaaaaaacaacagtttagtagtttgtggagaaagagtagtaaaagttaagggtggatcactgcctggtcttttaactgaccaagtggccatgtttggagagaaacattggagatgtataccttagtgaaattgtaaggttaattctatttggatttgaataattgggaatcatcacagtccgtatgccaacaattaatccaaagttttctgtagggaaaaaaattcattaactgcaatattcattcagtgaactgaggccaaaatcaggtggacatgatgtgtgttgc

SEQ ID NO: 54091 - DNA, 6942 bp, Oryza sativa
  unsure (1)..(6942): unsure at all n locations
attgggtgctagttactgccgcgaattttggtagtgctggctaatttcagatgtgctagttactgattgttagtcagctattgctttttttactaaagtagaccatttcaagcttttggatttttgttttaaatttaggcgtaatgattagcaaatgttgggagtcactagtactattttaagtattattccaatgttattgtctgtgacctgcacaatggtgctgcagaaagacaggaagtataggtagttctcgatggatgcaactttggataattaagtgcaccaattatgctctagacctctaggtttgtagtttgtgcccaaggctttgagagagtttgtatgttcttaacgaatgaactatgtgttgcatcagagtagggaggtcagaactattgtccaaaagcgccttaacttgaagttgtaatttttctctgtgtaggtggttggtggcaacactgattgatttttatgtcaatgtgactgcgatttcggtaattcatttatctctgtgctgtactttgcgccctcttcaccaactagttattttgttacgaaggaagtgtttacaagcagtatgattagaaggaattattttctggagcgtgaagtgaaagcggcagcagtcaattgtttgcatgcattgtacaaaagtgcaatatgttctaccattttttaaatctgttatttacgaataaattcaatgttgccaaaacatatttcataggagatataatgcttggagttagaccttttttttttctgtgtgtactcaattgataaaatgtttgctaaatttgcgaatctggtgaaattttgatttccaccaaacatagttcctgatctgtatgagggaatggtatctaactggttgaagctttaactaaattgcatgacgattgatctcagatatgaaatgatagtagagaagttttgttgtattatctctcttaacatgtattttttttttgtgtgtgtgtgtgtgaagtttggagcttttgctgatatttctgctccaactccaatctgtgtaccactgaaaaactaacagagaattcttttgtgtgtcttatcctaattagctcctttcccctgattaagacaaacaatttctagattccaccttaaatatatacacaaactaaaggatatttggatctgcaagggttgaccactcaaatgctttgctctacatgatataaataatgtaaaagaaaatcattatttatttgtccgcttcatgtatggagatacaattttaaatattatttcatcttgatgtgagctagagatgttcttgcatgttgcagacttgggttatctacaaggaagtaaattggattagttctttcttttgggtagttctgttgtactgttttggcaggtactcatttccttcttgataatatttgtggcttgtcaaactttcataattctgtttgaatggagatattcattttacctaatgtgatcatccttttttcctgttatcttttcagtattgctacatgtgcttatgttgttgtgaagctttttgaaataaaaacttccggaccttcacaagatccacttgatcttttattcctcaggtacagattcaaatttttcctagcgtatgcaggatgaaaagattttagtttgatgcttttgacagcataatttggcaaatcaagtaaaaaaaagttttttttttacatgctgatattgaaaacagaaatggatttggcaattttgttctttttctgggctgggggcactgatggtctggtggacatggactataagaagcttatattggttcatggttacgctatgttctctttcaactttggggggacctgtgaaatgtgttatcctgtagatttcaacacctacaacaagaaacttttgctttcacagtttttgcatcttttgggtctagatccctcatatgttgagtaatatacctaacactccaaattccatagttccatagtgcatgctctcaccaatgtggtgaccttgtgtcacattctggatgtctaaggaatattggtgttcatatatcaattgctattcttatcttctgtgttttgaggggtttctcaacttcttttcaggcaaggagatctatccgaaagaaagtcctcttttgtcataattgggagaattattttcagcattttgggggcaatgatggctgcagtcgtaatttatactgtcatcactgatggactacctttcaggaaggacttgttgaccccgtaagtgaaccatatttgctcagattatttaagaaaccttattttctttaagtacattctaagtccagttgaatgcagcaagcaaaatggataaatcccagtgattgaatgaaagatcacagaggcatagattgataatacagctaaaggaaattttgaaaataatatatttaataagcaagacaaatgtgtatttacaagtgctataagcaccctatgctgaatttacattcaagagttaaactagtaactgtcttgttaggagcacttagcacttaccatagttgtgtacaggcaaggagaacattttacttgtgttctggacttatcttctaaaaatttgactgcaaatagtcataaaaaattctgaaataacttagcagtatagatcattatctataaaaacaatgtgtaaaaattcaactgcaaatgtggcttgtattgggagaaacaaaaaaacaaatatcagtgaatagtagctttccctttttctttttgccattccactttccgttgaatttttcctttctatttcttcatgtccacatcaaatttagatttgaaattttctatcatgatagttgatagatttattttgtatcaccactaccaaattatttgagaaattttcatgactattttcaccataagagtaggaagcacaggaagtccatgcagagttaaaaaaagaattttggaggccagccctaagtaatgctctggaagtacattttcgattagtatagtgttgtatatgttttcacatgatttgttaaatttatcagtacatgcttcaaacatgctaactctgtagatgttgtctggcactttttattttcttttttccttattatacttgtgttatcaattagaaaaatatcaaatttaatattttcctttgcattcaggtggatggcggcaaccttaattgacttctatataaatgtcttcgcaatatcggtaaattacattctttggtttttagaaattgttccaagtaattttgtgcgacacactagtttgcctgcatgaatgcatctgcatcttggaaattgttgttcatatttttgtgcaaacggtgggaaacgatttttatttgctaaaactacttttgcatgactctattgttatttggaacagttgtcttaagctcagctctaatcatgccatggcacccacagttttctgctaatagttttttggtatttgttatgaaaatatattccattaaaatctacaacacattaatccttatgtccagtatattttatcatttttttctttcctctttgaaaatatgtgaagataatcttattttttaaaaataaaaacataagcgctaattagcaatgctagcacaacctcccacctactgaaaaggtgtttccatgaagtaattaatacgtcctgcaactataaaatggcagggcactgctggctggtagagtggtagcgtcctaggcactgcatgtagtggctatatcttctatcagtaaattaaaaagaaaaccatcatagtggctatatcttctatcagtaaatttttggtgatatgtctgcaggtatgggttgctcacaaggagtcaaactggatatctactgccatctggatatgcttgttaatatgctttggaaggtacacaattttttgttgaggattataaaggaaacatctcattggatatctactgccatctgggttgctttcgaaggattatattgctacattgcattggggttatatttgtccttgtgacttggattttactgcatgaactttgtagaatattttttgtttgcacttcttaatcataaggtgcaactagtagttactgccacctatcaaatactgtagataaaatattctacagattttggcaacaaattagtcaaattcccaagtatagataatatacaaaaattataccaatagattgacatttcaaagtgcgttcatacaatataagtttgataactactgatatatattttttgagaaatcaattatcgaagtttaatcttgaagacttttaaatcaagtatgccttataaaaatcaatgaaggttgtgccatgttagctgtatgatgcatacatttttcctgccacttgtattttctagtgcttctccttatgagtagtgtctagattatgtttatttgtatatgggaggcactttcctgctcaagaatagttagtcacgtaatatgaacatctatagtaaattcatcagtgagttatgcgcatcatgatgtatttatttgtaaggaacttattgaccctttccactttttttcatttgatctagcatcacgacatgtggctacattgtcatacaacttttccaagtgtcgtaccgagacccaatctatcatgtgctattgaactctcataacaagtatggcattgttccctcccactaatccctgatcttctccaagccttgttagcttgtggttgtctaaactttgcttgacatatggtcatttatctggtatttatatgtctgaaatgtaggaagatttgaaaatatcattgaagagttatgttattcttggtatacaataatattacctcaataaatggtgtatcgtctagacaaatagggaattctcggtgtaattacatatcattctcagtgtaatgacataactttggcaatttctctacaaaaggaccagactatatgcagtttgcagctcctttatctgtcgtgttttttaattaaccctttatttgtatatctgatttagtcgatttgcaaaagttttcttcattgtagttgttatcaaaattgtaaggtcatgtaacacaaagggttactaaagtgaagtaaagaaaatgtgactgtcttgtttaactgggaaattatttgaattgccaaataagtttgcagtcttgctgaaatcgggctcgcaagactcttttgatttgatacatctctatcttgagtgtgtgaaggagcctcaacgcagagcagggaagacttccaagcattataccccctagctctgccaaagtatgaagaatatgtaagccatcttttgccagttcttttgcagacagaattccaatatgcagggattcagatcattctcattttgttctttctgttggagttagaaaaatctttgcttcggcatactctcaaatataatagctttgaattctggacccctggaaccaattcttggtcacactgtcaatattttaacaaggtttcgatgtgtaacacttgtaaaactcacattctgtaggaaagctttgagatgcctattgttgatgtatcctgtaggttgaatagcttcacggcaaggttaccagaagcaaaccatgcttgccgtatgcgttgctgggccaatccatagtttcaactgatgcattcattcatgcgtgacaaagctcagcgtgatgtgctcgtgaaaagattttaggttgtttaaaatgcaaaaataacaaatatacctagttgaaagtaattaactagtgctccaaaatacaaaaataacgaatatatcagtagaaaccacatctcgccatcgtcttctcctgcttaaggcgcctgcgcgtgtcctgtcctcttaatcaagacgagaaagcgaaagcaaaaccaaattcgtaatcttagactacaaccagcctcaccagctgagctcaccatgaaatcacaccattgcttcctttcatctgtatctatccagcagccatgatgtcggatcgagtttggcctagacgatggcaagctaaagaacctcctctgggtagctcgagcgcacaccgccgctctcttccgctgccaagcccacaccaacacatatctcgatcccattctccgttctctgacttctcatcgcaacaactcgctggagcctatcatgaaagaagggaacgagaagatcgaattgatggctgggaagtgggaaccaatggatgagaaggataagaacccaattgggtagtagaacccaccaacggtcagtgaatgaggaatgaaaaaagtatactcccttcccaccgaaaggatgattctagatntaaattttatctcaaataaaatgtatntctaccatactatttgtaatatcattcatatatactagccacccagtcacgcttcgcatgactctgagcgccggcataacttgtgtataggagttgacgacggatcttgataattacgggataatttttgtgagactattatctctattttttaaatataaggatttccatattgtttaacaaagattatgtttaatcatataaaatttttatatccctttacggaggaatgataggagttgagaaaatagttaagagtaagataaaataaattgaatgggaggtgagattgaagataaatccttatattttttaataaattttaaacatttgtgatgcttatatttgcagttagagagtctacctttatgtttttttgaagggattagggagagggcaataaaattaaatgggagggttgtgttttatttttgtttctgatagaaagtatatgaagaaattaaatagaaaatggttgtagttggttgagatgatggaatagaagtaggataagttttatatattaaaagtagctatatttttagatgaagggagtaatataattggcactatggtggatggatttctgtagttgtgggtcaatgaggcgagctgctgctgctctccatctatac

SEQ ID NO: 54092 - DNA, 2750 bp, Oryza sativa
aattattacaaatgtggtatattattagagtggctactattatatgaaaaatataactattttttatcatagccgctgcaggtgtataacaaacagggctatacttttcaaaggcaaagacaaactttattttctaagaatactataaagcccatgagcatgaaaaacaaattaaagctattgtcttcaacagaatattgctattgaaaaacagagagtggttggtcatgaccactatactagggtttgatttctggtgtaataccagcaattactggcctttatatttttagcctatggttaggcaaaggtacatgcagctgtttggtgggtagtgatgtttgcacgtcttttgtatattaatcgagaaaaaaatatgaatggcctagcttttctgaaatgccagcaatttgttgggcttgagcagatgactcgagttgcgagcttgcaaaagtaccattgattcggcccattatcatggttcgttgccagcagatgaacagaacctagtttgaataagttcaccttatgtctctcatctcgacgtcagtttgaatcacattcttagatcacaatatcagatataacgtgtgttagtgatatgccctaaaggcaatcatagagatgattgaatcacacactatgtttacatatttatccgactttgtttcttgaaatagataaactcattattggttaatgaatatgtgattttttcatgagactctttatgttatgtgttgctatttctaaaggatccctgatcaaatatcatatgttgaacaatatgtttagataatcagcacatgtattaattgatgatcatgtctcatgtatcatggtatagagataccaaattaataatgtagacatatgttagtgaacatgttgttggatagacccaacatgagacactgcaagagccatatgtgttgtgtcatcagtgatctcatttagtattggtgttgaatcctcagacttgtgattatcatgattcccaacatgtgtagtagcttacttagggactgctaaactctactccgtaattgggtagttataaaagtagttttcggatatgctatgaaacatgtagtgggatatgaataatcaagatgggatttgcctctcctatggagagatatctctgggcccctcgatattgtagattatggaagtgcatggccatgccaaaggtgattgaggagtcaatcacaagttatataatctatcaatatgttcgagtgaatgattgagctattataggatggcgcatatctagccttgagctaaattgatatcgcgaggcgaaggagttcataccaatcttcacttgagattcacccgatatgatctctatttatgcccggagggtcaatacactctgctaagggcgcctgttgacgcgtggaccgaaaaggagttttcggcttatagctgagtatacatgaacctacatcatcgcacgcttaatgggccgaaataaggggattggatggagatccaatatgagcttgattcggatagggatccgaataggagttctacgggccttggaggcccgagtgatggatcctatatattcgtgaggggtgtgaccggcggaggcatcgcatcacgtgagaaaccctagccgtcacttccctccccgagcaaaaccctagccgcgcgcgggtgctagcacatctgcgcgtggcattccgtccctgtacgtgtggataccggtagaggcgtcgctggtttgtggtgctgatcggcgtgagagtaccgcgaggagaatgcacgaggaggagaaggtcgagccggtgcgatcgactacttcctctacatcgacgcacgctacttcgcgagagttccttcgacttctcagcgttttcttccgctgcgcagcgtgtcgagtggtaacgatttatgatctaatacttgcatggttcctggttgggatccaccgtagttgttagttgtgtagcggtggttttcagccggttttcctgtaataaaccatgcaattgtatggttttcgggcccggttttccttataaactgggtcaattctcttcttctaaatataaaagtggaacaaagttccgccttaggtttcaaaaaaaaaaatattatgctaagaacttaatttttcacctgaaagaaaaccataacaattcagttacataggtatatttgaccaacatggcaaactacttagatttttcaattcactttctcttatgacccaaacagggcaagcatacatgccttacgggggacaaacatgatcatggtacattgctccaactaaaaattcgttttcattattttacactaaagccataaattctgtatgccgcgagcacaaaacgctaaagctagtactatatagttgtttactgcattaattttactggtttcagaagaatcttcccttacggcgatggaattagggaacacaaaatgcactggtatccttatacagagaaattggaagttgcaaaacaaatgatctcttgttcatggatcatccactcagcaccatccattgtgagacgttggaggctatgagagaccacagggaagagagagataggtggccgtattgtacctgcttggagaaaggacctagggaggtgagggcgtcgtggatgaggtcgccggtgggttccgctaccgcctgctctcgccgaggcccgccaagcctctccgcgtccacggaggcctccaccgtcgtgcatgctctagtcccaggggaggatcgagcg

SEQ ID NO: 54093 - DNA, 3623 bp, Oryza sativa
aaaaaatggattagtcttatgttttacaacaactttcatatataaagtttttgcacaaaacgcaccacttagcagtttgaaaagcgtgccacttttatctaaaagtttatccagtatttgttggagaaaagaacatagcctaatcttataacatgaattttgtgcaacttaatccttggcacacgtccttactcacggaattggtctccacgcaaaatcatgggtatccatgtaaaatatttgaccgtccgtcttatttaaaaaattagtcatacataaagtattatttatgttttatcatctaataacaataaaaatactaatcataaaaaaattaaataagacaaacggttaaatgttggacatgcacagtacaaaactgcacttatttcggaacagagaggacaaatttaattgaaaatcaagacggtacataaacaagtaacaccaagaattttcctaccatgttgaaaaatatctagataaatacaaataagagaaataccattgccatgttcatatcttatatttatagaaaattgaaaccaattgctaggtagaaataaacaagttaacagtaaaacacaggtaatacacacggggctatcaatttattggcgtgccagcaggcacgctggctttctagttatggttaagggatgtggttcaatctataacaagagttgtgagaggcaaaatagacttattcatttctgtaatgccagcaattagttgggcctgagcaactgactcgagttgcgagcttgcaaaaggacccttgattcggcccattatcatggttcgttgccagcagatgagcagagaccctagtttgaattagtccactttaggtatctcattttaacgtctaatttgaatctagtcgttagatcacaatatcatatataacatgtccatcaactccgaaaataagtgtaaacaaggcacagtttgagcgacggtttcgattgacatagcacctacatagttggtttgtcatggtcctcattctacgtgatattgatgtggcactagaagcaagattcaaaatattcaaaattaaaataaaatacgtgagattcatatgtgaagataaaataaaatacgtgaggacccgtgtgttagtcgatcccacttcctcctcactctccctttagtggaaaagcaggagagaaaaagggagataggaggaaagggggagagaggagtgacgtagacggagaagggcaaggaggagagagggtgaggtggaggaactttgacccacttgctagtgggttccactatattttttatctttttattttactggtatataagtgtcgacaggggatacccgtagaccggatatagagggtgttggggtacgttggtacgagggtctacgtagtacgacatcaagtaaacaaaagacgagagttatactgattcaggccacttggtatgtaatagccctaatccagttggtatgggattatatgatggaaaccacatattacaaaaggaatagtagaactcgatgataccgacgagaccgtagtcgagttggttcgactagatcacccgccgacttggctcctgtaggctccgatttcgtaggctgtggtggatgtgttggcggtgagattttatgccttaggtcctgcccaggggctcccttttatactgcgggtcagttgatctctaagtaggactcggagatatcggacccctcacgatattgtaaagacccagtctcgtccgagtaggactccttccatccgtggattctgtttctatcacgtgatagatttccttaacgcatataggaactatccgtatacccctatacgcgtaggtataccatatcagtactcatcgtatatccaaggatagagggtgtaccttatccgtaaccctgacaataaggtcctacatattttgtttcaacttttttatttttaatctttgcttttagtgccacgttaacatcacgtggaacgatgactaaatcaaaccagccacgtagcgtcacgtcagctaaaaccatagtccaaaccacctagtgatctcacttacactggtttaaaatgttgaggaatacactatattctgtactgcgatttgagaacgtcttttaatctcgacgttttgatgagcgatctaaaatcaaacttattgcatatatattatgtactccgaataattagtttgggtttggcccaaactgttcctttgctgctaggccgtaagtcggcccaatctaaataactgaaaggtaaaacccttctcgcaaaattactttgccacgtcatcaactgaatatacaccattagattgtcactccggacattacagaccgttgggtctgtcgatttgcaaaatatcttcgtgatccttcacgaatcttctattaatttctggtccttccccttacatgaaaggattacgttatgttttcattttgtcccctccccttaccgcgcgagtgttcaacccctcagtcctcacagtgcaccgcaagcccacagcggacgcctcccactcccgcgccaccgaagccgagtaggtctttgtcaccgctgtcacccaaacatccttcctgctccgccgccgccaccgcaacctaaggttagggttaggggttagggattttctcctcggtggtgtgtggcgacgaaagtgatcgactccgtttcgaccgcacctagtcggtatagatggtgacacagggacaatctgggcattacgaaaaaattatcacaattttcaactgggaaatgataaaataatgggtccgatgtcctatggcaaatttcacaatttttgtacagtgtcctggggcaatatcacatttccgcggtgtcccttagctaattaattacacgatttttgcgttttctgtagcaaatttttcctaaaaaaataaggaatattgaaagacagatctaaagtccatataataatacaatttagaaatatctaaaatttgataaataattaataactatcacatatataccatacaatataaatattacacattggtagtttggttaagttggtataaaattaaaattatgttatcattttaatatattttaatgataaaattgagaaaatatatatgctattatatgagagaaaaatataatcatgctagccgcgtaatatgcgtaggccaccatgctagttcacatcagctcgatcactaggtgatcgtgtatagaccaaggtcagtttaatgttagcaactattaatgggtcgtaacaatataaaacagtgaaagataaactgaacttagtatgcattatcttcactatttttcttttccttcattgaacaccgatctatttatgaacaacttgcttaatcgctgcttcttttcattcatcggccacagccagccaaccaattccacacagcaatgagcatcctcaagaccaccaaattaacctccctcctttttttaccttgccagataattaaacagttaaccctgcattacagattgatcatcatcccttgatgaccccggcgtttctgtacttgtaccggatggcccagaacaagaagaagaggtagttgagcgtgctgagcacacacatcacccagtagaacctctccaggtggtagtggttca

SEQ ID NO: 54094 - DNA, 6257 bp, Oryza sativa
  unsure (1)..(6257): unsure at all n locations
nnnnnnnnnnnnnnnnnnnnnnnnnnnnnnnnnnnnnnnnnnnnnnnnnnnagaggacgagccccgtgccgatgcgctgcaggtgggtgatccccatctccgtgcccgtggcgcgtcgcgcgaacgggatgatgatgtggtcgtagaccggggcgaggaggatgatgaaggtgaccgggaacaccggcagcgacgccggcggcaccttgagccccccgacgcgggtgtccatcgtcgccgcctgctccacggagaaagtggacagctgcgccaggcagctgttgagcatgatggtggagaagaagatcgggagcaccatgagcacgatcttgacgttctccacctcctgcaccgtgcacgacagcgccccgcaccgcggttgacgctgcaccgcccggttcaggaacaccagctcctgcgacggctcggtagccacctcggcggcgccgtcggagacgccgcagatgtcgccgggcttgcagtactccttcatgtccgtgctccccgtggggctgggcgcgcggtcgatgacagcgccgttgctggcgctttgcgcgcccgccgccgaaagcgagcccggcggcgaggaccaccttggcgatggtggtgagcgggctccccgtgggcaccttgttgcggtacagcctcgagccggcgacgaacaccgggatgaagagcaggatggcgatggtgaagatgccgaacccccactgccaccccttgttgtcctccacccagacggcgaacgtgacggcgatgagcgcgccgacggagaggcagaagacgaagtagttgaagaaggtggagcgccccttccgcccccgcggcgcgtgctcgtcgaactgctcggcgccgtgcgacgggagggagcccttgatgccgccgatgcccagcgccgtcacgtacagccccgcgaacagcattgcctttttcggcccagacattggctcgcacgccgcgccggcaaccttggcgcaccccggcggcatcagagacggcgtcctcgcctggatcgtcaggaccaccagcccctgcaacacattcgcgccatgcttgacatcaacaaaagttcaaaaaaaaaaaaaagagagagaatcatatgcaggcccatataaaatcctaaaatctgcagacgagaaaagcttccaggcccatgtactgtccaggcccaaatacatgcaactacgtacactactagcatcaattttctgctgcaattttccgttgcaaatttgcactgccatgttgcaacagagcataccaacccgatcagaactgtgacgccaatgtctagtggtttggttggggggaaagagatatcaggtgacagcgagaaaagtttcgtggggggaggcaagtggtcggcgtgctgcatgtgccgccgcggccgcgcgcccgtgcgcgacgtcgctttggccttcgccgtggtccgtgagccggttaaagcggaggaggaggacgagaccgacaggggcccgtcgatgggttcgtagtaacttttgtcagcgctgaccggcaaacgtaaatacagttgggctaaaaaaactcgaggcagctttttgaagctggtaagtcaaacgtacggcgatcgtttttgtggcgctcaggtgagatcaccaaggtcagcaagcgacttggaagtactccctgcagattaatactacctccttgcacaaatgtacgacgttggttagttcaattttaagctaaccaacgtcaaacaaaaaaaattagagggagtaatacttatcgttttagataaaaacatgatcataaaaagtaactttgatcattattttctattataatatataaaaagcatcaacaaatatatgattttattaaagtagtttttaagactaatctatatatctagtctccaattttctaagataaatatttaaaaaattattcatagttaaagattttaatatttgatctcaccattatccaaaatgataagtactatcagtctagagatcagtctggaggctgtgtttagtttcttaaattggagagaagtttagggaaaactggtagtttgaaaaaaaaagttgggagtttacgtgagtaggaaagttttggatgtgatgtgatgtgatagaaagttgagagtttggaaaaagtttggtgtgaactaaacatggcctaacttagtagaacggacagccaactagcagtactactgtacttgtcatatcttaattagcccatcaaatcgggtgtgcagaaaagatgtttacaagtggtggtggtgctcctgtacttggtacgatcggtgcgtacataggagtaacattattgagtaccattgtgtatttgtgtattcagtggctattctatcaggatccacgtggcgcaatgtgcaacactccgaaagggaaacgaaggaaaacaacaaatgctcctacggtctatcctatccattcgtttccgatttccacaccatattgcaacttgtttggtggcgtacctatactatactctctatcaaaaaagtgttaaacttattacttttatcatcagtatcagaaaaaaataactcattctgtatgtaacgaataccaaaagagatatatatatatatatatatgcagtggcgaagccagaatttagagatggggggtgccatttacgagacgtggtaacttacttaaggttcggtgaacagtgatattgtagcgttgatgtatgatcactaactcgacatcatacatgttatagcgattagctagaagagagaatgagaacccatagatcataatttgccaatttaaacagtttgttccatgattttaattggagtcttgtaatcatttttaaaatgataaatcagttaactaagtcatttcataagtcatatatagctaggcagttatcctatatagttagtctcatctgcaactaatgatgtaattaatggctagattataagggctaattatccttgggagaagagatgggaggggaggtcacataagggttaggggggtgttggccctccctggcccctacggtggcttcgccactgtatatatgtgcatgtaagtgtaactaatgaatattaaaatgatcgtttgtgtttcagacaatcatctaagttatctattcgcttaagtcttagataaattgagactatgaataatgactattttatttggaaacacgataatctttccagaattatggctggactgaatagcttgcttccccggcctataaaattttacgcgcgaataactcaggtgctcacaagtcaaacaagtgggtaagaagaaaaaaaaatacgagtaccaccaaaacgatgattaatattctccgggagggaatagcaaaagcaagctaagcacaggcacagccaaagaatgaaagaaaccctgcaggcaaatcccgaaaccaaataaactccccacttgatccacttgcaccgccccagcggcgcgctagctagcagccgcaggtttcgttacgccgaggaggcaggagtagggcaacgcgaattgacgcggcgcgcgcgcacgcacgcacgcacggtcgccttttctccagggctgcgcactcgcggctttagccgcccgtgaccgcgccgcgcgcgcgcgcggttgccccacccccacccacacccaccctgggaggctgcgacaacacgcgtcggtccgtacgtctctctcgacgtacgcgagaaaggccgcgcgccgcgcgggcggtggccaagattggttttgtgcgactctctcgtcgcgcgcgttgacaacgagtgtgtggtgtgatgtggtgtgtggcggtgtgcggtttgcacgtacgcacgctagtggacaccgtacgtcgtacgtgtgtgttggtggaatgggagaactggctggatcacagtgatgagttgtgtgattcgatctggggctaggggggtggggataagataagagatggtggtcggtctcggatcggatcggatcgcgggaggtggtgagagaaatgcctcgagaatgttccacagtggctcttgttcctgcacgttgataagatccgtgcctatccgtaattccgtgtcctacatggtactgtattcgacgatcactaatccatcgtaaatttccagccgtctctcttaatcataatagcccgttcttcgcttttttagggtgatggaccaactcataataaattaaccaatcgacgacttatcgatcgatccatcaaccgatcgttcatgtaggggcgacccagaaaggtcaccgtgtaccagatcaaaaaagatcgatcccgaccggtcaggatatatccaggggtgcgcgcgtcgtaaacacgtacatttcgtgcgagcgactgcgcgagaggagtggtggtgacccgggcgagcgcgtgacggggcggccagggcgccgggctccgcgacggttttggccgcgcgcgccgatggaattggcggtggatatatgaatggattattattgccccatcccgaagggtactcacactcacacactgacactactcaggcggcggcgacggcgaccgtaatacggccctgtcccactcgtggtgtgaccgtatgagatgtagcatttggtatagctaaggtcgtgtctagtccatcctcaactaccccaaattttcaactttccattatatcatatcatattcaaaacttttctacacacataaactttcaactttttttttaactcccaacttttctcaaatttttaacttttttcatgaactaaacacagcctaagatgtaggctacctatgataggatgggcgctataccataccagaacgtacgctgcccatgcgcctgtcgacgacggtggcgacgtagtcatgtcaagtaactagctgattgatctgaatttgggttatcgtccgttccttccatatatgtctctgagcccgacgatatgagccctacagtacacgactgttgatgtgcacagtaactgtatttttttggtcaagaacaatcatgttcacctcgccggtatggcactcgacagatatataccgttactgcgcccacgtgatccaccgcaaccgcaccgcacacgtctttatacccttatacgccgtatacatccacttccatcctacgtacgtactcatcctacgactagctctagtgctctacgtacccacacaatcataaaaatacacgacatttttgggctaaaaatacagcgcacacataaaaaaaactcatactaaccactctaaatttgaatgtataatgttgctgatttctaagtgatgtttaaccatttgttttatgtaaaaatttagtgcaaatatgaaaataaatataagttacgctaaaatacttttaacaagtgaaaaaaataatatttacataattattttttctaaaaaatgagctaccaaacgttatgttcagaaatcaataatatttatatatctaaaaaatgaaggcagtatgaacaaagcagaacacttcaacgcgcaattggttgcaaacacatatttatccaaatatctcgtagaaatagaaagataaagtatttcaaagaaagtctaaaagctaaaagcttgttgttgttttctccccatcgctaaaagcgagcagtagccatctatgatccatcagtggaccatcacagttgcaatccaaccaagctagcctagccaggccaaacttgaggaccatgaatcgatcgatcgattgtcccaagcccatgcataaaagcatgcctttgtgatagatactcctacttagatagatatcctagcacctagctagtgcagtcacgatacataggggccgtgatcagtagttcagtacagggttccctttgacccaggctatctctgcttgcttctagcgaataaagtgatggttacaatttaatcattggcctaattaatctctagatgtgaatatgtatgtgatctcatgtaacccaaatcacagggaattgcgagctccgtttagccaattaattccaggcaattgtcagatggaacccgtggagaaaaagaggtttcagtgtagggccgggatcacaaaatctttggtcaaatagtggtggtcatctagcgggaactagagccgttcgatcctgcctcgagattagcatcctgtttggctaatctttgacaggtgtcattttttgaccttgtccacgaatcttgtggggtctgttctaattggacggtcaggatgccatcatgggagcggctctgattactgacaggtcactttacgacatgcagctaaattttagagaccggtcaacaaaaca

SEQ ID NO: 54095 - DNA, 1568 bp, Oryza sativa
  unsure (1)..(1568): unsure at all n locations
ccgtgtgccactgaaaaacttcagatggagatgtaaagttgtattttaatcggaggcgtttgaaaaattggaagtactagcatgcatgtgcgggggtaactgatataaccgccccagcataatgtgtgcggttcccagtgcatgccggccaattttctttgttctccctgaccgtttcggccttgcgattcgtgcccgaattcaatgctcgcgtagcgacaattttggacagggtcaaattataatggcaaatttttctccccaaaatccatggctggttctctctctaacactcacaaccgtcagggcaaaaaaaaaaaggaaaaaaaaaagtccttcacacatgcaaagaaagcaaaagcaagtcattttccacctgaacattcgggatcggatcaacgggagagatatcgaaaccgaagccgccatggtgcccaccagtcaaccaccaccaccatcagcagcagcagcgcaagattgcaagaagaggtcgccgtcgatcgagagcagggacaccgtctttttctcaggtggatgcaatgcatttgatggagggaaggtacagaggacactcaaggaaggacgccaatgtttggatcgtacaaaagcttctccccactgatgataacgacgacgatgcgcaattgcaagaggggggggtcaagttggggaacccaacccaacttgcaagaacaggggggagaggagagatgggagattaacctcgttggaagagaagagcacagtggtgtactggtgtgaaagggaaaggaagaaacaggggagagagagatagagagaaatggagcccaacggcgaccagtggggaggagggcgaaaaaaaggggagaaaaggcaacttgtttcgcgagcgaaagcggccaaatccggcgggaaaagggtgcggtctgatcaggaaaaggaggaggaggcgtaaagggtggtgatgatggccgatcgatctgaccacggtgctgtgcctttcagtctccagaaaagagagagaggagaggtgcagggaacgggaggaggaagaagaagaaggtggaggaggagatggtccatggctgagtatcctattcgagctttctttctttcgtgcttgcatgctgctgctgctggtgatagctagctagctgcaacagtgcaatgatatgatcgatcttaattaattctgggcttatccatcgtccctgtgggttccagaagaatctagaaagaaagaaagcaagaaagcaagaaagaaagggaacaggaggtgcgtgtgtacttaccaagaacgaagaaggcggcgagcatgccgccgtgccggccgcgcacagccggccggttcctccagtagacgtacccctcccacctttccgcctcccgcgccgccgcaccgtccttcttgcaacgccgccatggaaaaacaaaacccattcatcaccgtcaacacaagaaccgctccagggacagagacagagaagaacccgcgccacacgacgactactcggcactcaccatggnnnnnnnnnnnnnnnnnnnnnnnnnnnnnnnnnnnnnnnnnnnnnnnnnnnnnnnnnnng

SEQ ID NO: 54096 - DNA, 1100 bp, Oryza sativa
cgaggccaaatcacatccactctaatgatggatcggctactcaatctaccaggacctcctctgggcagtattgagaacattgagttagccgggttcagaagcaaaaacttcgacagatggtggggtgaatggaagctacatctgtttcaccaattggccacaatgtatatgacagatcttttccctgacgtcataccccaggtaaatattgtcatcattaagtttgtatagtcaattgatcaatttattacttaaccaatcttttttccccactttacagacgacagaatcttcccctcctcatcaaagtaacagcggtaaagacatcgaatacgctgcaggcttgattccaaacggaggtggattagctccccctgtcatcggctaccatgcccctaagacatcaactctcctccatggcctcactagagaaccggccgatgcaggccaaaaaaggaagaccagagcttcaaccacaagcatctcaatcctggctccaaagaaaaagaccagagtcaagagagccaaaccagatgacaagccagccgatgatctgcctgacttagatccatccatcgaacaagccttagacgaagaagccatcggagatgaagtcgatcaagccgcagccgaagtaagcgatactgaaagaacaccatcggcatcacccaagcaaacccttccaactccatctgctccagtccactccatcttcactaattcctttttgaacccttttaccttatagccgatcacccccgagtcttataattgcagaaaaagaagaccgcagtgaaaaagagaccggctgcaacaacatctaaaccagtttcaccagtaagataacttaaactttcaattttagctggctctacttaacgcttgctttcttttcagctttcacctcctccttcttcctcggcccaacaatcatcgagtgatcagaccccttcggccgtgggaagtcaccacattgaggaagaagaacaaccagccgctcctgctatcccagtaagtttcccctagcgagcatccaaatcgactacaattgtttggtttctaaccattttcatattatcaccacaggtcctagccgatct

SEQ ID NO: 54097 - DNA, 1203 bp, Oryza sativa
  unsure (1)..(1203): unsure at all n locations
acgctggtgctcgttgaattgctccaaacttctgacaatcctgacaacccttataataccggaaacaatcctccaacatcgtcggccaaaaatatcctgcacgtcgaatcaaccacttcatcttgtgagccgattgatgagtaccacagatcccctcatgaacttcaccgattgcaaccttagcctgatcggcactcaaacacttaagtaataccccatcaattgtccgataatagagctcatcatccagcaatgtatacttcaatgccttatatcgtaattttctagaagccgattgggaaggattgctcaaatactgatgcacatcatacctccaatcattggctgatattgctgcaatctcaaccttcacatccttgatcatcggcttataccccgatgccccttgagtcaaatcgttagcgtcaagattttgatctcgagatacatgcttcaaagtaaccagccgaaactctttcattaactctaagcacttctcattataaaccagcaatgtatcattcttgcattcatattcgcccaccaactggctgattactagcaaagaatcccccatgatttcaatagtatcggcttcaacttccttgagtaactgcaacctcttgagcactgcctcatattcagcttgattattagttgcatatggtttaatagtataagcaaactcaaaacatgccccctaggggaaattataaccaagccgatgccacaaccatgggtgcagaccgatccatcaaagaataaagtctatggcactatttcaaccgagccgatcgaattatcacgatgttcaacaatgaaatcggctatagcttgtcccttaattgccttcggtgattcgtaccgaagatcaaactcggttaaagaaaatatccattttccaactcgcccctttaatatcggagccgatagcatgtatttgattacatcggctttgcatataacagtgcactcattagataatagataatgcctcaaccttgtacacgaaaaataaaggcacaagcataactctctacaggagaataccgagtctcagcatccaagagccgtcgactaagataaaacacaactcgctccttcccttcaagctcttgaaccagaaccgagccgattgacttctcnnnnnnnnnnnnnnnnnnnnnnnnnnnnnnnnnnnnnnnnnnnnnnnnnnnnnnnnnn

SEQ ID NO: 54098 - DNA, 1759 bp, Oryza sativa
  unsure (1)..(1759): unsure at all n locations
nnnnnnnnnnnnnnnnnnnnnnnnnnnnnnnnnnnnnnctattaattagattatttatgtaaattccttatagataagtgtgggcaagagtctgccgcaaagactcgtgatattttagagtttgttagagataatggtcgtggccggtacgggcatatcttgtaatcctcgggtataaatagaccccgaaccctatgtaacgaaatacacacattcaatacaattccggcgcatcgccacctttcgtttttgttttatttcgacgagttcttgcttccgggttgagctgcatcggtttcgatcttcaacaagaggtaaagctcgttatgacgaattatgttcttagggattagtgcttacatcttcatgatactctaatctcatttatataattcgccgagttatcacatatcttacataatcttcaacaatatctctatctaatctattatcggctaacatttgcatgcaaaagacagccgattaggttagatctcgatgttgatttggattatataagatatctaccattctatgaatcttccagtggcttgattgtctagatattgttcttcttttcatacttaatgctgcatcagttgagtttgatccattaagtcatgcttagaatagcaatctctagcctgctttctggttgttaattaggatagtatcggggtttcagccgatcttatctgatttaactatattcgctttatatgtcgcactgatatgttaaatctgcctttcatgtcaagatattattgcatttacatacattaagcttttgtttggtatattctgcttgttataatatcttaacatagaattgcatcggagtattagccgatgcatgctagatttatttgatccgctatgctgtaaacgtatatagttctgttattaacatatctttcagtacaagtgatttatactgtctcggcatgatggccgatctatcccaatcacttaacttaagtatatgtcgatataagaattatgtattgttaatatctacatccgatcgaatagatttagttctttattatctattttccatttccgatcgatctatatatgacatcggctcaaacgtaaatgatatgtcatcggcacctggccgatcggatatcatttatagatttaaccacggttcttttgtctctatttcttgttgattgtaggatcaaatcaactggcacgctcacgtatccgaaggcgagttttggacctgcactggagttaagcagatctcccaggcctcgtgttttctgtcaacatggtgtccaagaggtgaagcgcaaagtgagagcataaagccataagcaggcctgtggtaaaaatggaagggggggagagaagccggaacccggggtggggttatataacctcatcgcgacggttcagcttccatccaaccatatcatgacacgtgttcggggctagacgaaatggtaaattcccatcggaccggaccggggcagaacagttaaaggcagaatgcaaggatgggaaggcccacggggcccattactattcatagtagtttaaagaataagccaaccttttcaccacttgctggcgaacatagcaaggaaatcccccccaagaattttttgtatgaacatggaagcgaattatatatatattctacaggtgtgcagcataggtttcgacaggaacatcggccaaaagggggcgcctcgtggtacacccttcaatttgacagtctcggccgaggctcctactcacccttgcc

SEQ ID NO: 54099 - DNA, 1095 bp, Oryza sativa
aaaaagatagtatatgtcttttctgtaaaataatttgcatgtttcttctgactgtgttttattctgatttgctcttataaactcctttctttcaagttttatgagttcattttttttgtcatattaattataaactgcgttgcagaatatggcttcgggagtaaaatatcaacagagggtgatgtttacagctatggggttatcatcttagaaatgttgacagggaagcgtccaacagatgagatgtttaatgatggcttgaaccttcaccaatttgccaaggaggcatttcctctgaagattggtcaaattctagatccgagcatcatgccagattatgagaacgaagacaatgatgcaaacaatgatctagaccatgataattgtttgatggatggaatgctgaactgtgtcacgaagctggttaagcttggcctcttgtgctctgcagtggcacctaaagatcggccgacaatgcaaagcgtttacaaggaagtcgctgcaatcaaagaagaattttcagcactgcatggttaagccaaaggattatttcttttatgtcgcacatgctactagtacatttttcttgtttgagcttgtgatatgtcattttctcctcttcagtcttactagtgaatatttatgtgtgtaataatgtctgataactatgccagtttgtaacaaataattaaaattcagtattgagctcttctatctgtctcgtttacttttctgtcgtgtggaatgaatcaatgaattattatatagggtactacttcgtcatctagtattaaccacacaatttaaactggtgaaggaaaaaagtattgagaaatctgccaattctggtacctaccggtaggcatgatcagtagtatcacagcaggcacttcactagcaggctagcagcagggagaccccccccccccccccccccattactctggagctgcgaccgcatgacgggggcagagagcgatttcggggaggccgggagagagcatagcccgcggacgacgcgaatcgcccgatggaacaaacgacgccccagaggagacagtgaatcagacctggcggaaactacccccctggtgg

SEQ ID NO: 54100 - DNA, 1635 bp, Oryza sativa
  unsure (1)..(1635): unsure at all n locations
tggattttgattggccggcgacgaagaaggggattcgacaacgagccgcttcttcgtccctacgagttcacatgcctccgcatactaatgatcccacaccgcttctgccatcggcgtcgtcctccccaattttcctccggggcaactggtgtgtaatactgaaacacaactgaatgcaaattcttgaagatctggaaatttgatatggaggaaagagttgaagccccggaagtaaaagatggatctttaatcccggttattttaaccgattcgtagggggttcccaattgggagtacaaagcctttctccagcagtgtttctgagccactacagaaattctatttgtattaactttagtgaaaattttgaaactgacattaagtaaataaataggcctatattgttgaattttcaaagcctgtttgcgcttgggcagtaaaataaaaataccaaagttaagagagtaattaaagaggtaaattaccactataaaaattattaaataaatcaactaaattgggcctaataacattccagaaaacctaataaaactcataagtgaatacatcccgacccagagctttattatattccgtttaaaaaatagcatcttgaatttccttctactaaattttctaattgagaaacctagagaatattacttatttggctttgatctaacgtgtggcatctggctggggtgcttttacgaaacaccaaccccataatttgtcgagccaaacgagcttcttgccagtctgcttatactcggctcgtttcactcacgagctgtattgtaggcttgggctcgctcgttccatacatgccgagctaagcctatgcaaagactgagtgaaacgagcgagcccacattacttggttaatatgttcaggaatgttttctactctattttgaatttcgtctcagttgtctagttagggcgggttaattagtcaggtactagatcctggtccaaatgttcatccctctctcaaccatgaacaaacaatttcgagttcgaacaaggcagcagccacgtacaagcattgctgaagaaaccatctttagtcccggttggtaacccttttagtcttgggttttcaaccgggagatgaaattcgggaccccggttaaaataatcgggactaaagatggacctttagtcccggttgataacatgaaccgggactaaaaatgtggtcccggttgttattaccaaccggaactaaagatttgtttttctattcctttcatccggttggtctttttccttttttattgatcttttgctctatgcatatcacccaaatcgtcatggatcggatcgaaggaataaaatcaacaacaaagcccaaatcatagatcgaatgaataaaatcaacaacaaagcatccatattctttacacttattcacatatacaacatcttcagaacaacaagcattcatcacagagaatagagaaaagaaaaaaaagttcacatctacaacatcttcagcattcatcaaagagcacagataagagaagaaaaaaaaatgtttgttcgacaggcgcccgcttccgaccggggttgggcgaccccgacgtagccgggcgncgtctttccgaccagcgccagtcacccctgacgcag

SEQ ID NO: 54101 - DNA, 3500 bp, Oryza sativa
  unsure (1)..(3500): unsure at all n locations
agatggagaagataagatgtggagaaaaaactgagaggggaggaggagatgtggagatcgaggactttatcgcgcgggaggacgaggcggtagggcatgtgacgcgagggattttttttcccggttgttgtaatcaaccgggactaaaaatagatctttagtcccaccaacgggactaaaaataacattggtctgacaacgtctgccatttattgaaccgggactaataatgatctttagtcccggttggtgccaaaaacttttaaaccgggatttttagtcttagtttgttagactattgtaaaatttttaatcgggactattgtaaaatttgatcgaccgataaagatggggtctccataagcgaagtttggcttcatggcgcgtgcaaaccacctttagctatgccgtgtatccaaaaggtactaatttgtatagtttcatacgcagaaattgagttttttttttctaaaacagagtagtcgtagccaccggttttctcctttagttacctcgctcatggtctgagattaagcgaaccaattaaaggtactggaagttgtactggaattgacaatgtgttgtgaattgacaagacagcctgagattaagcagaccatgccatgtgcaaaatatcaatgtcgggcaaatgataggccattagaaggtctaaatgcaaaatagtactccctccattcaaaanaacaagggattttaacattttatttgtactatttgaccattcgtattatttaaaaaattttagaattattatttattttatttgtgacttactttattatccaaaatactttaagcataacttttcgttttttatatttgcataaattttttgaataacacgaatagttaaacagtgcaaacaaaatgttaaaatcctttatagtagagggcgaaggcagtattacctccatcataaaatataatatttttttgaatgaaatatatctaactactataaatttgaatgattctttgtctagatttatatagtataatatgttccacctatctaaaaattgttctactttaggataaaaaaagtatggatgttagaatttatggctatggtgagaaaggaaaatttccgaggtgtgtgtgtgcgcgtgttggggcttgggagagggaaatatatatattatatgcacacaaattttccgtgcatactccatatacatcaactagcaaatgttattaaaaattctagaaaaaaatggacacatagttccaataatattacacttacctgtgaaatcttatcttcaaaatcattatattttagcccgtaacaaaaaagacaaaattctgatacatttttatccttaaaactgtcagatttttcattttttgttatggctaaaatataatgattttgaatatgacactttgtaaatatgtgtaatactgttatgagtaaatgttcaatttttgtggaatttttgtgatattttgtagttagtgtgtacgccgtacggtagaccagaagcttgtttgtataggagagagataacatacatgacaattcggacataattattacaacgatggtcgtagattcccggaaagaaaagaacaaacaagtatgacttaatgtttgtcttttccaatcatacatgttttaccgcgtccggaattgtgccagattacaaaagatttatatttaatgaaatgcttggatgagcgacgcgccatggatatgctttggtatatcttgagttcttgggtcagtcgtccctcgctcttcgacgtgcttaggagggcaagttttcatttagagctcgtgtacaattcttctttttttttttttgaagaaaagggttgtggacaattctaggtatagcgataatatagtagtgtaattgcgcagataatattgtagagaaagtgcttttttttccagaatataataatttttaggattgaacatgaatgttaatttaataagtaggtagaatttaatgggagaaaactgttattggttgggaagtaaaggcaagtagaaaatttaatggtggatgattataattgattagcaagaatatattgatggattaaattttaggacaaatttgaagtctagaagttattatattttggaacggagagattacatcctatatgactaagtaggtgaaatagcaaaagaaatcttgccatggatttaagcattaacaaagttcttaacgtaagactccaagaacaaactaataatacttaaagtttgattttgaagaataatttaggtagatttcttttacttttctggttagaatttattaaaaaagatcaggcaacaaaggtgaaaagaaagcacttaagtcaaatttatagtgtgttaaaatctgctctagattaatttttttttaagaattacacagtacaacgcagacactcacccctataaacgcacacacgcaaaccctaccccaaaccctaaccctatgagcatatttaaagacttgggtggcaaatccttgagaaagtcaccacagacgcctcgctgtcgaggggtacgtcgcctaccactgaaagcacgaagccgttaaatcctgaaaaatttgctcccgtgaggagtcgaacccaagacctaaggttctactcaccactaggctagaggccctttcgcaaatctgctctagattatgactcaatgagaaacatagttggttcgtagttctactaatgaaattttgtcttactttttttaaaaaaaatacataaaacttcaaacaaatttaaatgcaaaacaaatagctagttaagtaacttattcgaatgaatatgttaccgtgctcagcctgtccagtcttgatgaacccatcccagccctcccaggccccagccgttgataccttatctatcacgggaggtttgtgaccgcacgagctgtttctctccgtatctatttttctttattttcttttaacctttttgattgttattttcgaagataaactctctcctaaaccgatttccaagtcattcttttagccttaacactactacacaaaagctaatatgtgctggttgggagccggcactaggtgctggttttcccaacggacaccaccgagaccgcactaatcactgaaagtcataaaccggcacatttaaggctgcaggaacgaaaaaaaagccggcttgatgcatcgagcaatttcacttcaagaacatcaagaacatgagatgaacacacaagatgaacacaataacacacatgaacactcctgagtccccctcccgccgggccatcgccttccctcccgccatcgcccaccgctgccatccccgcctccccttctgccaggtcatcgctcccagccagatctggcagaggggaggcgccgccgctacctctgctgtcgggccggcgtcttccctccaaccatcgcccgccaccgccatcccccgcttcccttttgccaggtcatcgctcccagccagatctggcagaggggaggcgccgccgctacctatgc

SEQ ID NO: 54102 - DNA, 1145 bp, Oryza sativa
caagtgtctagtcgagctagcacctgagctggccaggatttgggcggccacccaacctccatcattagaaccaccactgttgaatgactttggtgtaagtggcccatcaccggaaaaacctactctctccgtttcacaatgtaagactttctaacattgctcacatatatatagatattaatgaatataaacacatgcatatgtctagattcattaacatttaaatgaatgtgagcaatgctagaaagtcttacattttgaaacggagggagtattagatggtgactttggaaccgtcacttcctaccatcgcggttctcttcttccatgtctgctcctctcctctcctctcactctttctggttagggtttagcatgttgttttttttccctctactgtctttcaacgacctcaactgtccttccacttcatcttctcacccaactatttataaaccgtactttctctttcttttcttaacttctttaacatgatgagatctctgtgaatggagctaaggtgccaaaacagtcccaacaataaataggggtaaatatgtacaataaatattatcctactagacccttttcccgttgcaacgcacgggcaattcttctagtatataattagatataataaaaataaatttaacaaataacatacaatctaaacaatgatgtagaaacggaatagaataatcttttaaaaaatatatattttaaaaaaaacatggaggaaataatccgttccaatacttcggcgaataagaaaaaaaaaaaagaacagggcaggtcccgctaagaacgtttgataggtactccacgaccgtaggagtgcagagcgcagaagaattcaaacatgtccacatttgacatcttgtctggtgttattggaagatgaaaccatttttaagtggcgagtgttgcttcccggcacggacggtaaaacagacaggttgtatcgtttgttcgtgagctcacaaagcagctagctggcctgctgaacaaagcatgtcgcccactctgagcagcttccgtcttcttctgattcgacttgttttgctggctctcctgataggcagcggcgtccccatgccctcggctcagcaaggcagcgcacgagtccgtgagtatcatctgtatat

SEQ ID NO: 54103 - DNA, 3577 bp, Oryza sativa
  unsure (1)..(3577): unsure at all n locations
nnnnnnnnnnnnnnnnnnnnnnnnnnnnnnnnnnnnnnnnnnnnnnnnnnnnnnnnnnnnnnnnnnaaaagaaaacgccgtccctgatatagagccataaggcctgaggcccgaaggcccggcccacggcacggctttttggcccggcccaagcacggcacggaccgacttgggtcgggcccgtgccggcccggcctgaccgccgggctgtgcctgggcctctccaccggcacgctgggttggcccggcacgatgggccggtaggccaggcccggcacacaaagtatagagactaaaaatagacatataaatgttactgtccaaataatagggaccttaaatagacttatttcagctattcatataccacagcccaaagataagggacgtaaaatagactttttagctatatatatgtcacagcccaataggagggagggaaattagacttattctgaggaaatgcacaatggcccatcgtgccttcggaccggcccggcacggcccgagacgtgttgggccgtgcctgggccgtgagtacgacacggcccggtgcgtcggtcgggccgtgccggcccaacatgcctcggcccaggcacggccgggcctaggccgtaccgtgccgggcagtccacatggccatctatagtccctgagaaaacggccaaaaaaaaacaaaaaagacgccggaaaaaaaaaagaggcaaaactccgttcaaagaaaatggctaaaaaaacgcgtctattaaaaagcccacaaatagggcgaaaaaccaaaaaaaaaaagccaaaacaccgtgagaaagaaaagacagctaaaaacgcaaaaagggaaaaaacgccatcccatgaaagcccccaaaagggaaaaaaactgtccgactactatatgttttatagattactagcaaaagtgcccgtgcgttgcaacgggaattgtaaagactaaaaaattgaggaaaagttgagaaatatttacattatgtaattcattgaaatacaaatttcgatattttttaagtaggtaggtgtataattaaattagtttacaagtaaagtaagtgcgagaaataaaatggtatagttaaaattaattttattaaattctccgtgattaattatgctagttggaattttattggaatttgcgtagcttaattgctaattttcataatactaacatccttgcaatatttatttgaatagaaatcttccactctctcgttggggcattttcagcccatttttatacagcccgcagccaagctggcccgctttcctcccttctnctctcctccgcctcaaccgcacacttgtccggcccaaaaataagtctaatgaactccccctacttcatctctcactgccgcgtgggccctaaccgaaagtctaagttaaatttttttgttcgaccggtcgacctgctgcggcccatgaagcgcacgcgacccaatagtgattcggnctaacgcgggatcgatctgagccattcgtttagagaattttttttatttataattttttttattaaaagttttacaaaaataattntccattttgaaaaatgacggaaatagtcgcctaccgccctctgggagggcgatttttaaaaatcgccctcccagagggcggcgaaaattacgtggcaacccgccgttcgctttcgggcgacggccgtcaacgaaatttgcaggtggcccccttgccgccctccgctagggcgattttatactgtgcggggggccgcctgcaaatgggcggcgagggggggcatggaattttgcaggcggaccccttgccgccctccgctagggcgattttctactgtggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataacttgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgacctgcctgtactggtgtgacctctggctgctcctgagtgtgcgcctctggagctcctccaagctgagaggagcctagtacgtcctggtggtctgcaccgtgcaagtcgtcgtcatagaactggctagtaggaccagtcctacaggcgtgagacgaagaggccccagtaccgaagatcccggctgcatatcctgctggacaaggaccatcagttttgtacaagtatttaacagtagtaataaaaagtaaagtaccgtgtgggcgagggatcgacgctccgtgagagaaagagctggcgaacgcgcccgaagaggtggcgaacgcccctgcggagctcgcggaagtgccggtcgtgcctgcgaacgcgctcgaaggcagacgaggtcctgcgatgaggaaacgtgcagttaaaacatggtgacacattcgtgcaaaagctgaaacaaaaatgaactaatatctgggctgaattgtaccgtgcgaaaccggtgctgtaggtcgcactgctccgaagctaggggcgctcgaaggcaaacgaggtcctgctccgacggtaggcgcgcgaggccgtgggtgtaccggaccagctggaggtacgacgtccacggcgctgcgacaggagaagacgcgcatgaccgcacgcatcttctcctgcatccggtcgaaggtcgccctctgctcaacgtcagtcaagtgcaaacctctgttcaacctcacctggactgcggtgatatcgacactgatatcccgtgcggcatcagnnnnnnnnnnnnnnnnnnnnnnnnnnnnnnnnnnnnnnnnnnnnnnnnnnnnnnn

SEQ ID NO: 54104 - DNA, 978 bp, Oryza sativa
  unsure (1)..(978): unsure at all n locations
cggcatcagcctatgcaagatggaaataaaaaattcagtagttgtcctatattatgcaagataaatgaaataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtagagcccaaagtgcgcctgctagctgtccccgtcgagtcaacctgtgaagagaggtaaattatatggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtgaccttacttgacattgtgcctgatgaaaacattaactgcgttaacctcgcatttctgtactacgccctaagttacattctctacaatattgtcctctaaatttctaaaagtacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaagtgagcgaaccagcagggcttcgccgctccccttttgctnnnnnnnnnnnnnnnnnnnnnnnnnnnnnnnnnnnnnnnnnnnnnnnnnnnnnnnnnnnnn

SEQ ID NO: 54105 - DNA, 1784 bp, Oryza sativa
ctgcatatctttataggtcacttgattctgatatttacataaggttcctgacggcatcgacatcccgaatcagaaggtagatcgtaacatgtattgtgttaagttgcaaaagtgactttatggcttaaaacaatcggtcaggatgtggtacaaccgattaagtgaattcctttcactaaaggaatacactaaaaatgatgattgcccgtgcgtcattatcaaaaagaccccacagaattttgtattatctcggtatatgtcgatgatctcaacattattggcaatacacaagatattaatgaagcacgtcatcatttaaagacggaatttgagatgaaggatttgggtcaaaccaaattttgcttaggtctacaacttgagcatttatcttctggaatccttgtgcaccaaggtgcatatacctagaaaattttgtagaaatttaatatggacaagtcatatccttccaaaacccctatggtgaggatgtgcttggaccagattttccatatcttagtgctattggtgcacttatgtaccttgcaaatagtacgaggccagatattgctttctcggtaaatctattggtaagatacagcgctgctcttaccaaacgccattggactggagttaagaatgtctttcgatatcttaatggcacaagagatcttggacttttctttaaaaagaaccaggattcaactttaattgggtatactgatgctggctatctatctgatccccacaacgccagatcacaaacagaattcgtatttttacaaggtggaactactatttcatggaagtcttctaaacagactctagtagccacttccacaaattattctgaaataattgcattatatgaggcatcacgtgaatgtgtatggcttcgcagaatggttaaccacatataacttcttgtggtattggttcattggaatcacctaccattatctatgaaaataatgccgcttgtgttgttcagatggaaactggttatattaagagcaacatcactaagcatattgctcccaaattattttatcctcatgagctttagcaacatggagagataaacatcttgcaaactaagtcatgtgataatcttgctgatttattcacaaaatctctaccatactccgcattctttaaatgtgtcgaaggaattggtatgagacgacttaaaaatttgcaggattcagggggagtatcttcctttggaaaataacctattttcgtcatattatactctttttcctttgtatgagttttaccctttaggttttctcatccaaagtttttaacgaggtaatatcaacataagcttatatgtcttatcatttggcttttcgccactgtgtttttactaaatgataactgtagacactatactattttggatcatactatgagctttactcatagagatctaaaaatagtcaataatatatcatggttctctccttatttttcccactgggtttttgaggagttttacgtgatgtatttaactataattatttctaagattatctttacagatatctgaacactaaatgagcaatgatcaaagctggattcgatcaagggggagtgttctgaaatatttggggggatctcatccatatatatggatagtgtaacaaccaactcagggacactacggttggtcatgccccacacctgttttcgcctcacggcgattctagcaacagacgtgatgggtcccaaaccatggcgcctacggttgctagctctgttcccaaatatattgtaacact

SEQ ID NO: 54106 - DNA, 1740 bp, Oryza sativa
taaccccccccccacgcccccctttgcccttttccccatgggcttgatgggccggctgcactgtagtggtggtgggccaaatcctattgatttcggcaccacccatttacccctttattttagtttttaattttattttagcagcaattttatattagtccctgtatttttatgtaatttagtgaaaacagttcattagttctacaaattttgtaatggtcctataggttagtcctcttgctaatattgtaaatttcagagaaggggattttcccacttcgattcgctgattcagctgcgaagctgcatttggtggtcgtggcttatatctctataatctttccccaccattgaagtttcccatgtaaaaaaaccggttccctataaaacccaccccacccaaaaagaaaatcagtgttttcacacaaaaaatcaagacaacaaaccggatagaaaagattaaaccgtataattctaattctgttgcaacgtacggacatgacattagttttctgagagcgagaatatacagtatagttggtagcgactaggtcgagcacaatagagtcgagggaggtaatggggagaggctttattcctgtgtattcctcttatgggtaccatgtggcatgtgggtatattaattgatccacaatatggaagttcagaaaaggcagaccaaagtaaaatcaaagggatacgatgagataagtggcaaattaaatgtacatactgctcaattatctgctaaatttataattgcagttaactttgtggtaaaacagagttgagcccttgcaattatatagccaaggagtaattttccgaaataatcaacggaacaaaagtcaaactgttatgaaatatttgggtgatctcatctatatatatggatagagtaacaaccaactcagggacacaacggttggtcgtgccccacacatgttctcgcctcacggcgattctagcgacggccgcgcctacagttgtgggctgtctccccctgtatatcgctacactgctatcaataaaggatccgctcattcattccctacattcttgtgttaaattctctctcaatctctctagatcaatcaattctatccacattcaacacgttatcagcactttcgcgatacaaccctgggttaaattctctctctcaatctctctcgctcaatcaattctatccacattcaacacgttatcagcactttcgctctcgcgaaggagatcgcgaagtgaaagaaggaaacatcgcttttgatttcaagaaaagcgaaagaaacagaagaaactaaggaaatcgcctaagtacgtctaccttgatttcatcctcgatgccgttctcggcctccatcgctgagaccgctttcatcaccttcttcacctcctccctcgattcgatggagtcaccaccatcgccatgtcgggcgccattctagggttggtggccaccgccaccatcctcggcgccgcatttgccgtcgctgacgcacctccgactccaccaccacaagcgcacaccacgagtgcaccggcgccccgctgcgtccaggtccaagctccatggatggactacggtgggacgcccgccggcgagcagtgctccctcccactggagatgcagtcgccgccggcaccgtttcccgttcgccgctcggcctccccactactttccgcaccattcatgtggctccccgagctacacgctcccgaacggagtgggggggagggggg

SEQ ID NO: 54107 - DNA, 2408 bp, Oryza sativa
attttgatcccggttgggataaataaccatgattaaagatgcatcgttagtccgggttggtaaaatagggtctaacatgtttttaactggaactacaaatgatatttagttccggttggtaacgataaaaaaagtacccgtgggttttcaaaccgggactaaagatatttttagtcacggttcttactcaaaccaggactaatgtgatttttgcgtgacccagcaaatttcatttatccagtagtatacttagcggggcatgccctatttttttaccttatttaccggattattgaatcaattacttacaccactaaaaataagttctttgttattttttttacgaattagaaagaaagcccgcgcagatgcgcgggcaacttatttataaaagattgttaaaaaatcatgcttcaccttataattagaaccacttatttattatttacaaaaatgatgctaaagaaatcctatctcaccatattaattaattataaggacagtatatcagcttataattaataaaaaaataaatatctagaccataaatttttatataccaaatgacaatagtatctttcatattcaaacagaaataacgttgttccggatatatgtaaacttgcttgtccccattatttattatcgttgcattatcagttatgatggaattacatccatacaagaaaacaaacttaatatgtcagtaatacaagaaaagatcatctctacttaatactaaattgttcatgtctcacttgtttttaaatatatgtataaatattttgaagtattgctcctaccaattcatgggataaaaccattaaaattatatataaatgcccctctaatagttgaagccgagtgttgtcacctaggctttcttctcttatgccttgaaatatgtgtccttaatctacatagttgtgctcctcaaaatcagcgtgcagcacaattttaacgcctaattcattatcagctaaagaatagcatcagaaagaaggttagttgaactttatttgcaaatagtagcctctcactacggtcacctttacttagtcatatgcatgccccctcccccccccccaaattcgtacagtagcagagcatactatgttatccatgcttggcgcccttcgtggaatgataattagataagatggaagtgataatttttttaaagttttgaatccatttatggaatagagttgacacttgtctatggcgttaattggtccattaaattttagcagtacaaatataattttctccctgaaaataagtagagttgatctcgagaagtaattattcacgaacatatgaggtaactaggtgaaaccccacacattgctgtgggagttcagtatgataacaataaataaaaataatatgtaagatagctgaacaatataaacttacataagcactaaaatcaattgacgtgatatggctcaaatagagaagagagagattacattaactaagtgaggatgaacttatgtatgtacataagatattataaaacataatgaagatatatattgaaatattatgtgaattatgtgggataataatttaacatgctttcattttaaaagctctaaaatgtaagaaattttaaattatagataatataacaagtttgcataatattaaatgtattgattgctagtggatgatgatgtgtcaacttgttagtggataatgatgtggcatctttgcatgctaagctttaaaagttagtgggttataactttatagtaactagatgataccccgtgtgttgccgcgggatattatataccgatatgtgtttgaaagaaagatccatgcaaaaattccagataacataacaacagcatgcagcatagatgtacccactttcgaagcgatgggttcaggtccttacagagataggagcttattcaagcatgatgattatatcaaccaaaagctcaggatacaacttatataaaccaaaagttaggttctaaatatataaatggagcaatgggaagaacaaagctggaaaatacttcgatacagttaataggcctatgatgaaacgaagctagcttattgcccagtcaccaatccgtaatttatagatgtatccagataatcggcacatctaaaagcaacaaacatgagtaacctaagatacatacaaattagggggaaaaagttccgcctattgactggcctaatgctaattcccatatgaaaaaatgggattcatgaattattgactgatttgtccataaaataaaattaggggactgattatgaagtttcctcagtacataagaaggaaaataaacatgataaatgaattcatcatattaactttgggttaacaaataataacttaattgtgacggttatcagaggaagatgtatagacagaa

SEQ ID NO: 54108 - DNA, 1811 bp, Oryza sativa
gaggaaaaatcaaatggtccgtattttaaagatgacatggacatgtaatcttgcaagaaagtttccacctttcacttatttagatttgcagtagtttgcataaacaaaacattgttcttggaagcacgttgttcatgagaatctaattaacaagataacctatctataactatagtcgtatatccgtacggcgattcaatatgacccagcagctatatttagaatatcactagagaccatgaactgttaatagagatcaggtctgagcttacatttctagtcaaggaggttaaatgcctcatggctggaaatagggaggtggtggtgtcgaaaatctatcgtgatcagaatcgcattagccatatcttagctaatagagggaggtgtgagtccttaacggccttttggcctgatgattcttgtaatttcatctcacaccttgtcggtgctgactctatagcttcgtaatatatctccctttccccgaaaaaaaatagatatggtgtgacataattaagttctgttttaaggatacaaccactctaatacgactcctgccattacctaagatgcacacaacctccactcacaaaaaaagaagaagaagaagaagaagaagaagaaccacacagcctagcattatttaagaaaaaacaaatatcatgccacaacaagctacagccacaaacaaacttcattctcatgctccaccaaagcgagcgacgcctcaactatgataaagactcgtaaaataacgcctccaaaaggtgaacaatgcatatgtacaccccgttgttatcaacttgccatgatccaatcagcaaagactagaccataagtcacttttagacacttttaagttttcatcctagagagattcttcgaactctagacaatgcattaaacaaggaagacaattttagacacttttctctaatacaccttttgttctttatgcaatcaattaaaaaatacttagttaaaatcaaatgcctacacgtgtctccaaaactgaaataagcacacaaatgaaaaaaaaaacagaaacaaataatataacgttattgtctttttaaactttatcacatgttatttatttaaataaatttcacaaaacgacatgtactttgaccaacttattgcaagactataaatttaaggatgcgtataacaaaattacagatacggcatcactaaatttattgtagaacaccttaaatctatggaagtatatgtaggtttgtaaaatttactcaatttattttaagaacttcaatacaagttctggcgtacactaatatagaaggccaactatttgtaggatagataagtagatccagatgtctgatgcttctattccattatggcaatgtatcaggtgcactcagcacatcacgtgtactcatccagtagtaaaataaggtccttccaatctcaatcggatagctaggatcttggtagggtaattttacaaaaagaaaaaataaaccacccacttcccaccttgtacctttgtaagcgaatcaagtggcgtataagttagcaaagagagcgatgcaggtaaaacaaaactgtactcgggacgatgagccccctagctttattcttgatttgttagcaaacgatgtaactatcctaaatgaataaaatctgccatatttgttaaaaaaaaatccccctggcatgggtttcctgttctttggctgtagctacccccaaatcactttgtctctcccacgaatgacggggacgtgaagctgctcgatgagggcgatgacagcacccacccacaagaaggctgatacgaagcg

SEQ ID NO: 54109 - DNA, 1079 bp, Oryza sativa
ttttataaaattacccaccctaccagatcctagccatcggattgagatgcgaagaacctgattgctggagtgtatgagtgcacaggatgagggtcaaacggttttaaaagagagtcgttcctctttcctcaaaccaaataaaacgttatagaatgttttaacatgaaaggcattaatggctatcaagtagaactggggagcactctcaggaaaatggataaactgagttcaggcacaaaatttgtactcggtacaatgctttgccgtatatagaggactgtccattgtttgaatagtctgcacgacagcaaagatggactacgaaccaactctttctttttcttttgaatctttgactgtagatatgcatctgtgaggttggaacaaattcaacaaatggctagccgctatcctccggcaacctataaatgcacataaccctgctactgaaaaaaaacacaacccaagctacagctagtcttccacaaacataacagcaacaacatccatagtagcggatagatgattcctataggaactctcactccctcacttctcacttttgctgtcctgtatgctttcttgaccctcccattaattccgtcactaagtagcaccgcactcgatgatgaatccaacaaggatctccaggccctcctttgtctcaagtctcgtctctctaacaatgcaagatccctagcctcatggaacgagtctctccaattttgcacttggcccggtatcacctgcggaaagagacatgaatctcgtgtcacagcactgcacctagagtccttagacctcaatggccatttacccccctgtattggcaatctcactttcctcacacgaattcacctatcgaataataggttgaatggtgagatcccaattgaagtaggccacctacgccgtctagtttacataaacctttcttcaaacaatcttactggtgtgataccaaactctctatcttcttgctctagccttgaaatacttaatcttgggaacaacttcctccaaggggagataccccttggtctgagcaactgttcaaatctcaaaagaatcgtcctcca

SEQ ID NO: 54110 - DNA, 737 bp, Oryza sativa
cagactgaaatcggctattaagcatgtcgctgaactaaccaagtccttaaaagttattcctggaaccgacgctcaagatgctcaagccatagaagaagtagagcaaattaggcaaaaagctatgtcggctatccagcaatacttatcacagtaatcccaatgtaataggacttagaaatcttttgtaatcggcaaaacagcttgatacttcatcacttaacatccttctatgccgattaatataaatttaaaattcgcgcaaaaaattttgccctctgtatttgctgcattttaacagacatatatgcccccctagttttacaatgtcaatggcattgataaaactataaaacaactaagggcgatataacaatatcggccattgcaaatcggcaaaccgtcggccgattacattataaaacaactaagggcgatataacaatatcggccattgcaaatcggcaaaccgtcggccgattacattagaaaacaactaagggcgatataataatatcggccatctcaaggcgatgcacatacatcggctatcatgtatcgacactaggaaccgatcatgaattaatccatacattcggataatactttttcaagtatttaccattaagcgtttgtccataaacttctccatcaagcccttgcaacatatatgcccccttagaaacaactttatgcccacttgtcgaatttactatcgcgagtatcaatcggcaatatca

SEQ ID NO: 54111 - DNA, 1740 bp, Oryza sativa
ttatatctatagaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctataatacacccggcggattcaaatccccaaacaggagtagggtattacctctcattgagagggcccgaacctgtctaaatcctttgtctccacatccatccacttttaggtctcgtgcgctaccccgttttattattgccgaaatcatgtttcgacaccctggttcttctaaatgtcctttttccccattaccgctatgatccggtgtaactgcacaacagttttaaaattaaacatttaccaatattgtgtctgaaagaagtgcgcgagacttaacatggatttgaatcagatgtgatagtgtgactgcaatttatgcaatctatgaccgcttattagattgggtccaatggtcaatatgcaccctggtagtgtagatcactgtggcaaaaattgtttacttttgtgttggcactgtagccaataatcgggttcattcatcaccaaaatggatatagtcgcaattgcgtgccatagcttaacttgtaggcggctctattaattcaaattgtgccttaacgtagcatagaggtggacaaaaagcgcaaagctcatggcttagatcagcttgtagcgatctcgactcagataggctcgaactcgtaatcttaatgagtcaggccaggttagatttttaactcataaccttaacgagctaactcgcgagctcctcgtttagcttgttagtacaagatatcaccacatctttatatacttagtacttcttaactagtgcttagatttttaattacatcaaaattattcgtatttagtgagttcttcattagtttgtgtttattattatgttaatatatgataaatttgaaattatcgatatgatataaatgagatagagcttgttaacgagcctaatgagcttaacagctcacgacccgaaccgagctagtcttttagctcaatgttaatgagccgagatgactcgtactaagataacgagttttaacgaattgagccttaacgagtctagctggttcgttatccagccctatttagtggtggctaacgagccaactcggctcgacttgtaaaaactcgttaagttagcgagctagctcgggttgacttgttaacataatgagttaaaaatggaaagcgactcgacttgttaaaataacaagttaaaaatgaaagcaactcgacttgttaaaaagcccaagtcgactcattaaactcgttacatcgaaatacatggtttaaaattcatatacatggggcaaagcgaagtttgtccctcgcgtcgacctcgcgcggcggctcgggggcgaaaccctagccgtcacccgcccttctacttccttcttcctgcttcgccgacgacggagctcgtcgccggcaaagccgggcgacgcgctgggatggcggcggcggggtaatctccctcgacttcatctcgccccggcgcgggtgtggcgacgatggcggcgggaccgcgaggtctcggcggcgggaccgcgaagtcccggcgattgcgttgtggtggggctccccgcggcgatggca

SEQ ID NO: 54112 - DNA, 857 bp, Oryza sativa
tatgtgtatctccgtgtcactccgctcaggggagtacatcgcttccaaaccaaaggaaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcacatcgaaattcaggaagatctgacgtatgtggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgctcggaagtttcccctttttcttgctttaaaaaaattggttaaataatttgtccgaagaaattatcttaattaacctagagctaattccataattaataaatgcaattaataattggaattggcattgtgggatttttttcttgggttccacatgtcacaatatattaacaggatttttagtggaattttcagagccttggaaataatttttaccaattaaaaatcaccaaggtgcaattttaatcccaggaaaatcctttttcttttttttcttttccctccttttcctttgttgggccgtcagcccatccctctcccgctcggccttccccttgtgggccggcccgttctccttccccctctctccgggacgctgacaggtggggcccacct

SEQ ID NO: 54113 - DNA, 12333 bp, Oryza sativa
  unsure (1)..(12333): unsure at all n locations
ctttctctcttgagtagcgatggccggcagccggcggcgggcacggcgcccacccgcaggacgactcgcgcaacctcgtccaccttcctcgccggccaccaacctaccacgcgggtggggcccacatgtccgaggaggacgacgactagccgccgctgctgccggtgcagaagcggccgcgcgacgcgcgccggaccaggtgctcgacaacgtcctggagacggtgctgcaccctcgccgtcgcctttgcaccctcgccacgcccgccgcgcacccgccggggagctcgcactcctcggccccgccggagaggccggcagtcgaggcgacaacgaggtggcgcggcgaggtcggcgagtaggggggtcgtcgtcggggatgtgccggctcctcgccgccgaggaggccgtggcgtccgcagccgccgccgccaccgtcgtcccggcgctcttcatcgggggcgccctccgtcctggctctctctctctctctcttttctctcaaccctaagggcagcaaagtcatttggctacgctgtttgacaccgttaggactaaaaacggacggaatggtgtggagggcgcaataaagttcgacgatggcatagaggaagtcttgaactttttagtggcacagaggcaggggccatcttttttaatggcacataggtaaaaacctccttcttttatctttgttagattcaaacagttcactggagacatcagggaaatgaaaaaatgtatagactgtacatgtatattttgatttctgatcaacaataagtattgtctacacaatacttactcccttcagtaaagaaaaaggtaaattgtgattctcggagtcaagacaatgcccactttgaccactagattataacatcatatgccctgagaaaagtacattgaccactgatatcatgcaagtacttttcatacaaattgaccaatcaaggcaagagatgtcattttacacgtttacgccaatcttaataagaatacacaccattatctaaagcagacatgcccaattgtccacccatgaatgcaaactaccgctttttcctaaacagaggtaacttgtggctaacaaggaacctcctgaatgtttatactcatccaaatagccaaatatcaggcctgaaaagatatttggtaacaacaaattacaagtaaactttagtgtggccattacctttatcacagaaaaacggtcagccttaacttcaaactcagcaattttcccaataacagtctccaaaagagttctcattttgtcattgtagccaaccatggttatctgtaaggcaatcataaatattggagtattagaaaagaagaggattttagtaagacacgtaacatgccatggggtctaacttctggagaaggaataatatcaacatcacaaaacatgcatgatgaaaaatcagggttatgcaatattgaccatttaatctaatagagagtatagtaccatttgtaatccacaaataagaaaaaaagaaaacaaatggagataaaaggccctgttctattcttcaactttctcgttttctgttagcacgtttttcaaattgttaaatggtatgttattttaaaaaattttctataaagaagttgtttaaaaaagcaaataaatccttttttcagatttataatagttaatacttaattaatcatgtgctaatgaggtttctcgttttgcgtgccataaaaatctatctccaaaactggagatcgaacggggccagatgtagcaacttatgaaaagattagatcatgtacatcttataaattaagatcatgtagtaatgaagtatttacaaaccactctcagtacttaactacatctagttaaaaaaatgcacatctattactatctccctacatattgcttccttgaacatgcatgagatattattgaagtgtaattccattgaattatatctaaattgggtttttgagcgtcaagccagtaaatactaatttgatgcacatcgtttggtcgaaaaatggcacgtattcaaaaaggagtagcttagtatcagtggaacaattcaatttccacattaaccagaaaattccttttttgaacccccaggaatttcataaaattttcacatggaacacttcaactccctcaggaatcagaaaaggaatgtgcttatcattatcaacagaagcccctccccccggcgggattaacaatgaagataaacaattgttatttcacgtgaactgcacagctgacctgaaaaccagtgtcatttggcctaacaccgtaataaagaccagcaacttgagcatcataagctgaaagcaaaacaaagctgttggattatggcaatgggtaaatcaatcaaaaggtaacttaacaaggagatgacaacgacaatgtgtttaacccctcgtttttctaggatgagtagtgtatgttcaggacggtgatttgttttaggcaaacagaaattaaggctctcaagcagaaaagaaccttttccaacttcatcattaatcttacctcctttaatatatcccctctagactatatgtctatcgtcagatcatcgtacaaagacaagtttaaaatacactcaaattttactacataccataatcatttaaataatccatgagcaaccttgtgaatacatcagtaagaactgatgattcaggagaactacgggacagtggacagtggaaatccatcttgatataggccttgggtgtgaagaacattgtatcaggtttataccacactctggaaaacagtgttttcctcaacatacaaggaaaacttgcctggataaaccaaaaggtatcaacaaacagtttataaaaacataattatgacttttttaaggtggtaaaaaccttctcctcggcatttttcaatgaaagatcacttggaaggaagatattaggttttggcatgtgcaaatcttccacgggagctttctctacccatttctgcacaaatttatacaaggaacttttatgtttccaaatatagaaattggataatataacaagaacagtaacatccaaatgtatacctgtataatggatggaggaactgcttccacagaatatgatgtaccataccacggctctgttaagtttgtttgcccttcaaattttttggactcccagaatatcctgaaatgagatgtggacgataagtatatgatgcccacagtaaaaaaaaaaaaaaaggtagagtgggaaaaaaatagctaatttaaggaatatatagagtgtgaaaggagaagagaaagcacatgaccattaaaaaaaaaactaatgaaaggaacagattggtttttgaaatttgacaaaaaaaaggggggggggcaatgtaagcaaagaaatttctttcaccttctttgacgaagaaataataaaatttctggcaagcaaaagttatcttcgttttttgacatgaaacagcaggagcatatatatatacacacacacacacatattaaatatatgaaagttctcttcgttagatcagttttctagaagtattacaaatttaagtcaacaagaacaatgaatctggtatcgcagagtgatcgaagagcaacactaaaagcatatacagtattctgttactgctgagataaccaatcaaatcacagtgactagtctgcattactgtatgagaacgttatatgcataagatcattatcattaaaagaatacacttttgttttgtaagttgaacggaaaatttctgtttgagattgtgtgcaatagatgtgctggcctgtgcactcgataagccctaagaaacatccttactgttcaggaagagaagaagtgaagattttgcaatgcagtaaatggaccgttcaaatcatcaaacatatgtggcacaatgaattacgataatgatgaatttcctaagaaaaataaattcagagtactcaagagaagaaaaataagtagattataactggatttaagtatggcaaatatgtgttcagataacatatgctgaacattaagtataatattcagtaactggtgttttgaatcttaaacataaccaggagaacctgatatgggcaatatggcatggtcgcactcagaacctacctaacattatcaggagtcaactcatttaatataccctgaatagcatctggggaaaattttgatggcacggacgatgcaatcagccaatcttccggcggatagatctgtaacagtgggagataacgggaaaaaacatgagatggcgatactgagcagaattcaattactgttttggaatgaaccatttggcagaatttattaggtgaagtggaaatgatctttcattgttcgatataaaatcacaatctgacattcttgtcagtttcattttgtgaaatgacacaaagtagccttcaaacaaacaaaacaaagttgtcacatttttagaaatgtccctcccaccgtcctgcccacttactctccccaaatccacatctcctccaaatcaaagatgcaagcatgtgaatctatagggcatttagacccatcagtgcaaaaagctccaatttttggtgcacatcgaaaaacttcggtttgctctggcagcaaagtgatccagtgatgaggaaaggccatggctgcataacaactactggcaagatgagttcttagcaactatgaagaggtagaattggaggaatcaaacaaagggaaagtggagatgtaataaagaggtacttgaaagaggataatggcaacaatgtgcgtgcctcgcctatgctggggtgggtgggggtgggggtgaaagtttacagaaaataatggaacatggtgactgtagagatgttaatactctgagatgatttctcactgacaaaataaatgaaagaatatcatcaatcttgatcttttgcatgagcatactcatgtcttatcaaaagccacccatccgcttagaaaataacccggtactaagattttgaataagtcactttcttctaagcaaagagatgcctactctctgccctcaatccagactttgaagagaaaaggcggaacagtgtacaggaaaacaggcaacaatgagaaattactattgatacacacacaataagaaacaatgatttaaaatagtgaaaatgcaaataaaaatagatgccattattgctaacatcctatagacatgcagatagaacatggtattatcaacatgcagtgctcaaagaaatggctggaatatacctgcatgtttgaggaaatattggcaacataatggataggaggacccttgtctcgatagtggaatcctgtctcacaaatagtttgaagcttgatgataaaacaagtgagatagttagttgtgagcattgcaaaatggactagcgcatcatcataatgtttcaaaaccaaattgactcagtcggtactgttttaacagtcagataaaatacaaattccaaccattactatactaatgacacaataaaccatttgaaggatgcacccatgctttatttgcacaatagaggaagcagttcaagtatagcctcaagcagaagacatatttgtctgtaatagaatgacaatcatgcaataattacttttccctccagttcttttttgtaaatactgtacattttccctctccaaaaccatatacagttcgtccaaaatgctaatggccaattaataaggacaatgaacctcataaatgcagagcgaacaaaaaaaaactgtacgagtcttctaggaagatatggcatgtttcatgattcctcttgaaagtgcagaacataataatttaattaattaacaaagatcactaaaatgccactatagagggatagtggaagcagaaaagtactaataatactaaaataaattactccctccgcccccaaaatatagcaacttctctaccagcacaaccttccccatctagttttacctactttcttaataaccatgcccaactctaaaaatccttatattttgtgacagagggagtactagatacaacaatagaagatattacatgtcagatcaaaacaagaatccagtttaatgaattcataaggtcatttgtaacaatttgattgtctagatttcaaaagatagcactaccaactcaggaagacatgtgcaaagctttaagctgatatcacataagataacaatcgattttggtcattataacacattctatttccaaatgaaacgcaaatccaagaccaaattcacctcatcaaaaatccacttcagagtgccagaggtctgaagtaatgttatgtatctgaacaacagtccaacaatatcctccatgtgctctatcgacaataatagtaaatggaaaatatcacttgcactgtaaagattcaatattaaaaaaggaccttcttgaacgaaaactaaccgtggcctacatcagtgagctttatgacaacactgaagaaagaaaactcataactccaatcaccttcccctgcttccaaactcatagcccaacctgaggaatttaatggaatacaattatacaatgttaaaaacagcaagcactatgaaagattataaattgaacttccctgaaaaatgagcaagtaaactatgtaagattaacataaaccaagaaattatataaccaaatctttggttttccttttagtgtttccatgtattgtttcaatgggggtgttcttgtacttttctttatcgtgtactctttcatttgtttcagtgaaactgtagttttattttccatgagaggtttaatataatttttgcatgacaaatgtttgcaccttttgcatattaatactcagtttgtacagtttggctgcatacatcccaaaatggcacctatttgataaaggaggtagtgaaatactaatgtgccacctaaacaggaaatcattccaatatgtaaatagttttgtacggaacattaactgaaagaaaagggacaaaacttgaagttgcctgtatataatactagtaaggaagcaccctacagagattcattaggtgaaacaaatatcacatgaaaacatatgcctaagaagaaaaacacaggaggcatcctgccatgtgcactgccaagaaatgaaccaattagaaatggcaactcgatgggaaacagggaaagccaagctaaggctggttagatgcattacaatgctacaaattagaacaagaccaagaaccagcttaaacatgtcacttggaaaatatggatagactgaatccattaatcacgtaacacaattgaaagtagtataattgaattaaataggattatcatgtctacacattgcatcaacataaacaatagaaaggttggactgccagtaagatcctgcggtaagttaacaataaggcctggtattcctattaacagaatcccttgaagcaagaggaacattacaagaggattgtatactcaagttccaatggaccaatcaaaaaccccacaactcactcatcacaaaataaattgaacttcttgtataaaacttacctaacttttttaggacataaaacagagacccctctccttcatggccaattagatgactcacatacttgcaaggaccttccttgtaatgtcgaatatttggggtgattggccatagtattctcaaagtatggccttgtttaatgggaactgctttaacaaggacctggaaatcatcaaatatcatattaaaacttgtaatatttcagaaaaatgcacctgattgaagcaatgcacttgatctctcagcccattattagcaaatgataaatgtaaacctgtaggtgttcacttgaacacggatgaccaggaaaggaaaatcgttcccttccagtattcctgacaccacaaaacttattttcaacaagagtttgaagattgtcaagactctctgcaaacacaataaatataagacaaaatataaattgaagaatatgtaaaagagatgagaaaaatagtgtaaagtagtttgctgaagaacctttcccatacacaacaagctgcatcaagttggctgagtagtgtgaatcataaaatttaataagctcaagccttgtgtccaatcctttctcctttggtttaacctccaaagtgtcccaatttcctagagcaataaatgatcagaaaaaaatgaaataaataacatttcaacctttctagcatgtaaaacataagtgtcttgtttggttcacattaaaactcccatggattttgatttcagagataaatctaaaatactattacggtgtaaatattcctgtctcataataagtttgctacaatttacaactttcaccagtaacctttcgtagtagtacataacttttactctgttagtaccttttttttgcgggaaggtaacttttagtacctactccctccataaaaaataaaatcgatttttttacacaaatctggacatagtgcatgtccagattcgtgtataaaaattgaattattttcggacagagtgagtaacttacaagtgtttcttaaaaaaacattgttattatcaaaagtttatgtttgactgcactattctgaaacaacattattttaagaacaagcacagtattaccatgctggcaacttaatgaagtacagtagaataagagggcagatatcagttattctcaaagtataagaggcaccaaagtaatccatgtaggatttgtgaactcaatggctgtccgagactatgctgttctcgccaatgataggaaattgatggtgtacaaatagaaatatattcgcctgatctaagagctgccgtagtgttctcccattccaatcacttccatgcctcaccacaaaatcgaagggagatgccaggtagtgttgcaacatgttaggtagatgctgagtcatattagtctggctccactgttgaaaggcatgggccagcacaaaatgtgaaggcgagcatgcaaaacattttactcacaaggacacaattctattcgtttctatgtccttcatggctattgtctaatttgtgaacacagtgcttttgcaaatgatcctcacagcccacatgtgtcaacagccaaacttcaagaaaagatgacctgatcctcagatgatagaatgaaccaccaacgaagggaatgcatctctttcaagaatacatgtagactggaaacataattatataaaagggctgtccagtttaccaattaaggcttattttctcagaagaacatacagtaagttctttttatatccatatcgatagaagagaattcagctagttaaaatcagaagttcatatggcacagacattttctgcaacaccacaggatcttatcactaagttaaatgggtgaagtctaacatgttcttgaaatatgtatgagttatgattataaaatgaagatagaaactaggtagcaagagttgcagcgtccactgctgacatataaatcagatactacaagaaaatgaaatgaggattaaaacacacaccagtgccaaacttgtgatatggatggctctccaaggaaatatggttttgaagctgaaaccaaaagagaatatagaatgaacagaaacatcataacattaaatgagatgagtaacatctatatctttcaatttaaggagcactacacactatcatataaatacattatcgcagcaatcacattaacatgagggtggcccgactatcaggaataggcaggtcaagcctctaagtggcgaattgcagcctcactatcctaatgagagatgcacaagtaggcaagaaagtaataggtatagtagttttctagtttctagcatctctcttagcatagaacaaagaaataaaaaactaaaagcaataatattttttgctggaagacagagtgacgagcagcagccaggcaccctagcatggcagaaacttcagaatgaatgacccacatattgttctttttcttgctatctgaacacctaaaaagttaaggacaaatggacaacttccatgaaggtaataagggaatgtttttgttcaaactttaaacctatgctcctggtgaggtaagtcatgagccaaacatatactgttacagtatgtcaagcgaagtcaagcacctcaggacaatggattgataactcaacacgcaagtttggaacagtcaaaggcggttctaagtttatctctgacgatatacaaattattttgttggcaaacctttcctagaatcacaacactcttgtcagtaagcaaaacttgtagattcaaccagagatgacaatcagtttcactaggcatatgtttctgatgaaagatcttctgaacaataatacgaaatgcagctatcaggatatccttgcttcatggcattcaaaacaagaacaagaacatcgaatctaacataagattgatagctacagcaatttagaatgaaaaaacatgtaggagtagatgaatttcccaaaaataattgcagtaaatgaaaatgacatatgaatacggtaccattcaactataacagaataagattccactataataatgttttttgcctttttaacagtaaggtacctggttcattcgccaaggatctgataataagtttttctgattttctgcagacagagaaagatcgaaattagaagttaattctctcagaagatctggtagatctagataagagggaaagcagtatataccagagtcaacagcttttatctccctaagagttgcatcggctgacagtaatggctttatgaagaattgtgcaaacctaaaacaagagatgataagcaaaatgaatcatattctgcaaaataagaataaaggtaaaagaaaagaaagcaacaggaggtacctgtccaaagcatcattgaggcaatcatggttcacatcaaaaaagaagtttgtatgttcacaagttgtgaaggcattggttgaaccaccatgctataaagaaaattcccatattacacaattgatgattcatagtagaggaaatacttatagatcatgatatttttgtacgattatatgaaacaactatgcctcccatcaactatgtgaaaggccaggcaggtggcttttccaactagagctgttaatggtttaaagggcccaatccctgcttaaaaattccaatagtaacataccctacaagaactatattgtagtgtgaccaactggcactaggggaaaaaggaagttatccattatcaaacataaactaaattaatcgtacaaatatagatatactctaatggcactctacttttaaagtactataaatgtaaaattaaacaagtggtatctgttaagcatacagaaagcagccaagtacctccataatgtgctacaagtctctaatctttcccaagtgattgagaatatttatacatagaatgagagattacactacattaactttcagctgccacagacccaacagtcatggaccttccagttgctctcaagcattccattaaaaattggattcaatttgtgttcagtcgaactatagaccaaactaagatcacttacaaaacatcgttttcagatgaacatgacaagtaaaaaaatggcttggtaaaatacatacctctgtaatatacttggagtaactgtcttctataggatatttctcactagcatagaaaagcatatgctctacaaaaaaagaaacaggcataagggaatcaaacaatacagagctacacgcttatattacaatacatgccatgaaacttttcacatgtgatagttaaatccaaccaagataaaagaaaacaacgcaatgaggttaaaactatggctattaatgtgctaatactcttttaaaggtacatcctacaaactatactaaaatgcaatatgcaaaacaagccaatatgtaactgttcaaattaaacatagactaggctcagaaacagaatgacacataagaaagttgtgcacttgcacttactttacttgtccaaccaaaggtaaatacaatgactattaagtattaaggaaattaattttctaattggataacagtggcacaccagatttttataatggtagtatccaaataagatgttgaaaacaatctggtgctgaaatgaactttttattaatacgtatcatccctttcaatacaaatacaatatctcaaacccactttgacatatttatactgcattagtataacagtctccagtcccgaatgacactgttggtacctttgttctttaatgaatctcatgagtttcagataagtaggtcattttacgtttcatcttttttttttcttttttttttttttgctctctgacactttgcaaattcactaacaaannnnnnnnnnnnnnnnnnnnnnnnnnnnnnnnnnnnnn

SEQ ID NO: 54114 - DNA, 3970 bp, Oryza sativa
  unsure (1)..(3970): unsure at all n locations
nnnnnnnnnnnnnnnnnnnnnnnnnnnnnnnnnnnnnnagtcccgaatgacactgttggtacctttgttctttaatgaatctcatgagtttcagataagtaggtcattttacgtttcatcttttttttttcttttttttttttttgctctctgacactttgcaaattcactaacaaaattttagttgcttattagctggatattctgacagcacctatcataagattctacaatctccgtcccaaaataacttcattttttacccatcagacacataccaatacaaaagcaaaaagacaaaaatgccctctactttatcaaatccgaatgcggttgttcccaaatttatctagtcccaatgcatttgttccccacttccataaactccaatgcaatgattgcttgaaagatgaagctattttgggacaaataagatgatgaaaaatgaagttattttggaacggagggagtagtgttgaatttgtacatttttttacatgcgagaatcatagttgaaaaaaccgaaccggatcagcagcttaaccgggaaagaggaaaaacagaaccagtttctaagctcgggtcagttatgcgctaggaccattcatgcatttcagaccactttaaaccatttcaaccatcaggtttcacggtaaagtagtgaaccgatgtcaaaccaggactggttgaaccagctgagtttgggctgcactgttgaaatgggtccagaaggaaggcccaagttctcatcaaggcctccaccaacttcatttattctaaatatttgtgataatagctcgagggcagggagtccaaccttggtctctgaactgaacaccacctcttgttgctatcctgccatctcataacttgtgtttgtaccagtagataaactacacagaacagtttgttgaaccgtgtaccactggactagtgaactagcttgggcagttcgctcaacaggtccaatatttttttgctatggtgagagtcaatcatccatgcattttcatggccatgctatacttgttttaatttctcatccagagatactggcaagaagctggaaatgtcttccagatgttttgatggatgtgatcccaaaatcgcaaaagtagcaagctgctgtctctagacctaaagtatttttttcttgcacattttcatatggtatgcctgtgataaaaaatatgcacaccaaatctcgattcttcatgttcatgatcaattcaacaacttaaagcaaacatgcttgttatgactgtgtcagtccacaacctgacaacctaaaacaatcttatgtaacaagccaaatgtagtggtacggtaagcaagcctagcattgaattatcatcactaacatcatgtgtagtgattaccacagcagccacgactaccatattctcaggtcttatgcaacagctcgaagcaggaaaaactcaccaaggaagtgcgcgagcccctcgagcccctcgggatcgcagaagtagcccaccgagacgttcatcgacgccgccgcctgcaagcaaaacaagtagtcgcgggattcaagccaagccaaaaccccccaggagataaccaaacccccttccccatcccgatcgaggtagagcgcggggcgagcgaagcgggaagaaccttgtcggtgtcggggtcgctgacgaggaggcactcgaggtcgttggggagcacgacgcggcggtacccgcgcttgtcgttgcgtggcctggtgatctccacatcgcccgcgccgacgccgccggcgccgccgccggtgggaccgcctcggcgggggcgtcggtctcggggggcctcgaatccatcgcgtccgccgccgctgactcgccgccgatggcgtggactggctgagtccgcgaggcctccgggcggttgcggttgggttgggtttggctttggctttggcacggcgagaccgcgagagaggtgggggcggtggatctcggcgcgggtggtggacagtggactggtggttaggcacgtgaggggtggggggggagatgggctgggccggaatgccgccaggtcagcgtgcgtgcaccggggacatctttctgttcgaagttcgagtcaagtcgagtaaacgatttgtcagttttctccgaatttccagtggcgtgtctagaacgttggaatcaaaaggatagtcactggacagtatggttgtgtttagttcagcgcaaagtttaaattttggttgaaattggagatgatgtgactgaaaagttgtatgtgtatgacaggttcatgtgatggaaaatgactgaagtttggatccaaactttgaatctaaacacagcctatgtgaaaatatagaatatggtacacgattaaattcttctattcccttgaaaacctgaaaagtggctgaggacctctttcctatggcttataagccaacgctaaaatttatcagcttcaacttttaaaatgctaaggacacctatataaaagttttacttatattatttttaacattgataagctgttacggcttatagttagccataagcaactgatacgaatgatatgaacttgaagaaagccattcatcaaatcgctggaatgcaacgtgacaaacaaccaaatttggcacacatgcaagagtacatttttcccatagtaatgcatagaagctacgcagtgcttaactgttcattaataccatgtgtaagagagttgattgtcatcagatgtaaataaaacttatttcacaaatagacccctgaaaaaacttattctataaatggtcctttttggacgccagagtcactggcgttgtcctattgccaccatagcgggtcacattgacatggcaaggggagcgtgccaatgaggttggtgccgcccccctcctccccccacccacgccattttttttcctctcctctatagtgtagaggagatatgtgcaacttttttattttcttttattttttttatatatttttttcacattgaagagcacacaagaaccaaccatagaaaaattaaactcaaatggatgaaatatgtgacctatagaattttccaaagctcaactgaaaagcttctcgcctcgaaaacacaatcttgcaagcgaaatttggagtttctaattttgccaaacccaaaaagcgggggagaatcggatgtaattttttttacatatccatggatatataaattgtctgattccgagtccgtatgaatgcctattaaaataaaggacactcaaatgtaaaaaaaaaaaaaactcaacaaacccatttttttatagaatgtaaaaaaggcaatgtacaaacttttttttgtttttttactataggaaaaacaaaaacaaaaaacaacgagtgaattttaggagaggggagagaggggggggcgctcaaggggggagggggcggcgaggctagcacgctcctcctggcacgttagtatctgaccgccacggtggcaggggcgacgccagcgacgcgtctcaaaaagaaccatttcttggataagtttttttagtgatatatttgtgaaataagtttttcaaaaaactaaattgtgaaaaaatccagtcttcttctccccttccctctctccttttctcatgcaatggggtaggacttgggctgcgttcgagagcatgggttgagaaccctccctctcatgcacgcaaaataaagcgactgtttaatgcatgattaattaaagtgttagcttaaaaaaacttgaagactgaattaatatttttctaaagcaactttcgtatagaaaactattgtaaaaaccacaccgtttagcaatttaaaatgcatacacgtgaaaaacgagagaggtgagttgaaaaaatcggggaaagaactcagcctaaggagggacttgagtcccccacactcacgttggatcagcccctatttgcaagttgctacacttgtgaatcagttctactgggcaagctctggtgatgaatgtgaaacct

SEQ ID NO: 54115 - DNA, 4987 bp, Oryza sativa
ccctatgttttcacaatgaaatttgatacgttgaattctggtaatctcaccactcaaaaagaggtgattgaactcaaacccttttgcaaccaaccaaacaaaatatcttcaatacaagatcatttcatacattcatccaaacaacatctcgctacaaccaggatcaaccaatccagccaaccaaacaacctcgttaggatctactcagccaggctatagtcatcctgactcatacgagccaggctagcatgatgcgagcaaccaaaaacaccctaggtgatcactagtgtcacggtcaccctcggtgccagcaaaaaggagagtcgtggagaaagtgtcgaaagaaatacatgcaattttgtctaaaaaaaataagaacagatgaaattacatgccaaatttcgctgcatacacaaatggaaaccaactataaaatccccaaattatatatgctaaatcatccacactaacaatccaaccatctccccaacaggagatttcagtaaataaccaaatacaacgctggtgctaatcatttgattccttattaccgcagagattattctttcggaatttgtaaatatataaaaatgttgacctataacttcatctgaccaatacctcctttgaatgaaccatataaaggtctcgacctcctgaagctgaatatatcggttatttgataggaatgcggctgtggctcgtcgtgaactaccttttcgtactcgttggtgtggagacggccgtagacttgtatactgagtatcttctttcgtggtgcattaactttgacatgattatcgaagaactcaatcagctcctctttcttgagatccctcagtgcagcaacctgcagttgcagaactccaggaattgaaaaatggtacatcagaggggcgatgtaaagaaatagggcctacctccgcctcttttctatcaaatttcagagttccttcagagatctctcgccagaagaaagctgattcctctcttatattcttgtatttctccagcttcatattgatgagagcattcacgtcactctgcagattacgcaaatcactgtttattccatataatgtttacgagtacagaaactgccaatgaataataatgacagcatctgttgaaccttgaattctatatcgggcatttggtatagagttccttcaaacatcttaagaaaagcttccactctggcatctaggttggctggatcctgtcaaaccaacatattagaacagaagaaaattgtttcagcatttaaaatcgcattgagaactctatgtaccttcacagttgactggattgtaaattgcaagccacggacgcctgaatcatttctggataaacaggatagcgtggtcaaatttttaagagggattgcatgctacctggaaaacattattgcaaaacaacacaaacaaacaagatacatcttattatgtacctttgtttaagccatgttatgtagccaagttgttcaactgaacgtaattggtgaaaggctggttgcttagcaacaagggcaagcaactgaagtagaacattttgtttgaggtcatcctgatgaatctgcattgaggaaacattgttacaggattgtaatgtgtattgggtgtattaaggaaaaactataataatgtaaggtaataaaagaagctagactgcaatgtttgtcatatgtttgagagttggctatcatgtgtccccaaagagatgaggaatctgcttttgatgggtgcaacagctctgtgttgatccatttggctaagcaggaatggagtaatttttgataataagatggtgtcttctcctttgtaggttatcactttagttactcggtggctacatacctgggctatcctccaccaaccgggactgcgggatactattgccgtggtatcacaacagttggaccaggtggcgcatgagtttttttacccaagagcatgggtggcggtctagtctatggattgatagccactaagatatatgtttatgtcaaacttttgtgcttgggagatgttctgattgtttctttcttcttttttggctgtgtgcattttatgcagaggccgggggtgactcagtttgtttgtatcatcttgatgtaattaactgagtctaaataaagcttccattatctaaagaaactgctagagtacaaaaggaggggaaaactgtaaatgcacaagaaataaacggaaataacaccaatgaagtgaggcacacctgaatataatgcagaagggaagaattttcatcctgctgatttaggcataaagctggataataatacctcaaacctctttcaagctttacaattcgctttgtaagatgctgcgaggagggcaatgctttgcacaaactgactggtgcattgaataagatgtcttcaacatgctgtataacaccttttacctcacccggttccatgtttcctaatatcaattacataaaaaagaacatcaataatgcagagcattctctcaatgagtagtgggagaaaaagggtcattagcagcattacaaggtaatataaagagcagtactaaagggcctgttcactttgatgctattttcaaccttaccaaattttggtaatgttactaaaaaagtggctacatttagtaggttttttttggcatcaaagtgaacatgcccaaagatgagggaaagtagctgtgaattaacattcaagttattaaacaaaccagcaaagtagctctcaataaatgtcttccccagcagatgaggcaaaaatttctctagatcactagcttcagtatgagaaattgcagcaagtttttcatcccatgtccatttttgttcctctaatatcaatgaacaatagtacgatgcctgctgatgaggttgctgaaatttgaaattctcatacgcctttgttatagtttcctgatgatagcaacaaaagatagaacaccctcactttatgtcaaccgcatagaattctggtttaatattgcgtcatcaggaaggaccagaatgtttgtaaactgtagcaagtcattacctttatcacaacaaaacggtcaaccttcacttcaaatgcagcaatttttccaatgacagtctccagaagggttctcattttgtcattatagccaaccatagttatctgtaaaacaatcataaatattcaaggattagaaaagaagaggattttgtaaaaaatatggctcataacatgccatgagttctgagttctgactcctggagaagaaacatttgaatgatagatcacaatttacgacacgtccataataaagcttcaccacatacaacaatgtcaggttgctaccacacgctatacatgaaattaacagggattaggcaatattaaccatttaataattgagaatctaatgccatttgtatctgcaaataaggaaaaaaataaaataaatggagataaagctgctgtgatgtgagactgtgacttgtgaaagcgtaaaatcatgtatgtcttctatactccagtactactactaatgaggctttataagccagtgcctgtacctaaccacatccagttaaagatctgaagcagtatgtggaagtaagaaggaaaatagttcaagggtcaacactgacaatggtatattccatgcttctatatgcaacaggaatcaggattatgatattataatgatttaagtaagaatcaaatgacaagcatctgcttattagtaacatactatcatcttatcacatttatgcaaacacggtatgtgtttaggacaaaaaatgtttatgcatagaaacactgtcagtactgcatcatctggattaggaacgaagataaacaattgattatttcatgcaaactgcacagctgacctgaaacccagtgtcatttggcttaacagcatagtaaagaccagcaacttgagcatcataagctgaaagcaaaacaaacttggtcggttattgcaacatggaaataaacaaaggcaaactaaccaggggatggcaatgtccttaatcgctcgattttctagcataagcagtgtacgtagaggatgagttttttttccgccaataaaaagtacccaggctctaaacagaaaagaattgtctccaacttctatattaatctcactcttgcatatgtcctttctaaaatgaattatatgtgttagactattgtatcaagagaagttgggaatacattgtaactgtttatgaaactatgccataagaatcataaaaaaattaagacatctctgtattactgcataccataatcatttaaataatccattagcaaccttgtgaacatatcagtaagaactattgattctggagagctacgggacagtggacagtggaaatacatcttgatgtaggctttgggtgtgaagaacatcgtatcaggcttataccacactatggaaaacagtgttttccgcagcatacaaggaaaacttccctggataaaacaaaagatatcaataaaaagtttcccaaaataaaattatcaatacgttttaagaaaaaataccttctcctcaacattcttcaatgaaagatcacttggaatgaagatgttaggttttggtatgtgcaaatcttccatgggagctctatttacccagttctgtacaaattatgttaggaacgtgtccacctccaaacacatagattggaaaatatgataggaagagtaacatccaaattacatgtacacctgtatgatggaaggagggactgcttcaactgaatacgatgtaccataccatggctctgttaagttcgtctgcccttcaaacttttttgactcccagaatattctgaaagtaaatgtagaagacaatcgatactacgtaagtattaatgcctttaagtaaaagcacaatgaaataaaactaaccaaatacatacatcaagtgcgtgaaaggaaaaaaggagatggttgtgataggatcaacttcgtgaggagcctcttgctgttttttggaat

SEQ ID NO: 54116 - DNA, 15911 bp, Oryza sativa
  unsure (1)..(15911): unsure at all n locations
nnnnnnnnnnnnnnnnnnnnnnnnnnnnnnnnnnnnnnnnnnnnnnnnnnnnnttcaaacttttttgactcccagaatattctgaaagtaaatgtagaagacaatcgatactacgtaagtattaatgcctttaagtaaaagcacaatgaaataaaactaaacaaatacatacatcaagtgcgtgaaaggaaaaaaggagatggttgtgataggatcaacttcgtgaggagcctcttgctgttttttggaattataacagtaaaaaatgcaaatggactagtgatgaaatttcctccactttttcgtaggaaaaaacttgaaatttatgtaaagcgaaagttctctttgttgtgtcatccttctagaagagttatatagtgtcttacaataggttaagtcgaagaatctgaagcaacagctaagtgcaaagcctgaataattattttccagacactacatgcggtaattgaagagcaacaataatagcatgcattatactgttactgctgaaatgaacaatcaactcacagtagctagtccccagttctgtttgataacattaaatgcataagattactgtcaaatagaatacattttaagtatgttcatggtttcatactgatctgaaatgaaaacaaaaaacagagtataacttactaaaatacatataatatacctgtgtaactaacatatgctgaacactaaaaacaaataaaaaaaaacatgactggtatctcaaactgtaaacatagcagaaaaaaaccttatatgggccatacttacttaaaacctacctaactttatctggagtcaagtcatttaatatactctgaatagcatctggtgaaaactttgatggcacagacgatgcaatcagccaatcttccggcggaaagatctgtaatagagggagattaggaaaagtcatgagacgatgatactgagcagaactcattttgtaatttatgaatgaacattctggcagaatttattaggtggaactggccatttcattgttcaataaaatttgatgtctaaccttcttgttaatttcattttgtgcaacgaataaaagtatcctccaaagatcactcaagacggttgtcacatttttcaaaaatgcccctaccttcttccctcccacctgctcactctccccaggaccatctctctttcagttcacatatattttcaaacttttttgagggcatatgcaaatttaaactttgggggtcttccaaagctcagatttttttttgtcacaccataacaagaatcatgaaggaatcataagctacacagaagcctagacctagagccttctcattacccaagaaccatgcaccactgcatcgtcactgccaggatcacctttttcctcagttacttctctggttctcccttctcgtccctgatcccactaatgctagagaatacaagtatccaaaggctatgactagagattgccaagctggggcccaggcattcaccacattggtctcttactcttagaagccacatcaaccaccttgaaacatactgcagtcatgcgatatggacttattcagtgacaaattgtagagagaagggagttatctggtggaatacagtgcatattctcaaatcccacccacacatccctaggaattctccccgcaaaaaaaaaaaaacatccctagggattcaaccaagtcttatccaacaattcataggagtcatcaagcaatagggccttaaagtatcacaagaagatagttttgcacaagattcttcctcgtacaaacttgtcactgacaaaatataatataaggtgcagattgatggcagaatgaaagacaatgtccattcttgatttttgcatgagcactcacatgactaatcaaaagtcatatccgtcaaatatctaggtagtaagattttgaacaagtcaatttcttatataagcacagagatgccttctctctgccctcaattcaaacttctaagagaaataaaggtggaatactgtacaggaaatattgacaacatatacctgcatgtttgaggaaatattgacaacatattggctaggaggactcttgtctcggtagtggaatcctgtctcacggatagttagaagcttgacaatcaaaacagagtgaagtagttagctgtgtgctatgcaaaatggacattatgtgcatcattataatgtctcaaaaacacattgacttagtccttatcatttaccagttgggaaattatacaaattccaagcaataataatatactagttatacaaaataaacccttttaaggaagcattaatgctttgtttgcatagtaaaggaagcagtgcaagtatattgcaagcagaagaaatttgctagtaggatcaacaatagaacatgcacaagtactcctccagttcttttatataagttgttttagacagtaaacttctctcctgaaccatctacattttgtcctaacttctaacagccaattaatgtggaacctaatacatgcagcacacagaaaaaacatacgagcaatttaggacgatatgctcacatattcatgtttcatgattcatcttcaaaacgtaaagaactatttaattaaataagaaaaaggtagctccctaaaatgccattcacagagggatagcggaagctcaagtaaaagtactgacccaattacaacgaattggacataaaaatacatgtatcctgaccaaaacaattatccaatctaacgacttcattctgtcgtgtgtaacagcctgattattcaaatttcaaagtagcactatcagcgccagaagaatttgcaaggctcaaactgaggtgacaatcaattttggtcgttgtgacagtatttccaaaaaaaaaaaaaatccaaaaccatagttcacctcgtcaaaaatccatttaggagttccagaggtctgaagcagtgttatatatctgaacaacagtccaataatgtcctccatatgttctaccatcaatgatatgaaataggtaaatattacatgcatcataaatcttgagtataaaaaggcccttctggaatgaaactcaccatggcctacatctgtgagccgtataacaacactgaagaacgaaaacacagaactccaatcaccttcccctgctctcaaactcatagcccatcctgaggaatttatagaatacaaagttaaacacagcaagcactacaaaagattatagattagattttactcggtgaagaatgagcaagtaaaccatgtaaaaataatataaatacaggaaactatatagcagcaaaaccaaatcttgtctttcctgaagaataataaagcattcaaaactaacataaacaaaggaaattatatagcagtaaaaccaaatatttggatttcctattagtgctttcatggtttgttcaaaagaattttcttgagctttactttagttaaaagtccatatttggtcccttaactatggcatcggtctgattttcatccccaactctcaaaaccctccacatttcatccatgggcccaacagggtttgatgtatagatggccatatggcccgacggcccggcccaaggcccggtgatttggcccagcccgactcaggtcgtgcccgtgccggcccggctggacagtcgtgtcgtgcctgggctgctacctcggcacgctgggccggcacggcccggcacaaagttcagggatgcgaaacagacgtattttcaaccatatgtaaggcatggcacaaagaatagggaggaaaaatagacgtattatatggcacggcctaaatagtagggacgtaaaataaacttattttagctatatatatgtcacagcccaaaggagggaggggaaatagacttatttcaaagaagacacgatgggccgcccatgccttcgggccggcacggcacggnccgactgctggtgggccgtgcctgggctgaggtgcagcccgtgggcaggcacgacacgacccgaccgtgcgtgcccagcccgatcgcctcggccgtgcctagcccatgcctaggtcgggcgggccttatggctatctatagtttgatgtgccaccacatgcatcatagttggcaaattaaaaaacaaatatatgggttctagtattttctttttctattgtttacttttgattattatggtgaaatttttcattatttgcctatgtagactccacataggtgccacatcactgaaaattgtcccggtttaggcacagggatgaaatgtggatggttttgagagttgagcgaccaaaatcagaccaaggacatagttgacggatgaaatggggaatttttccttttctttattgtgtattgtttgcttgttccaagggaacattagtttggcttttcctaatgacatttttacataataaatattaatagcattttgtatattagttacaaaagtttttaaggtttggctgtacatataaaaggcacccatttgaaggtggtatgaattatcaatacaccacctaaagatgatattgttgttatactttctccgtcccataataagttcatttttagctccttccatttctcctaaaaataagttcatttttagagtaatcaatgcgtcagaatttgtgaaagtagaaaaataatagtattgggagtagataaagtaactagtaaggaatagttgcattgggatttgataaagtaggggtattctagtcttcttagttttgtattggtatgggtaagatggatgcaaaatgaacttattttgggatgagggtagtacctaaatatcctagaatgaaacattaactgaaagaaaatgaatttcatctccagattttttgcttatactccctccgtccctaaatatttgacgtcgttgacttttttaaacatgtttgaccgttcgtattattcaaaaacttttgtgaaatatgtaaaactatatgtatacataaaggtatatttaacaatgaatcaaatgataggaaaagaattaataattactccctccgttccaaaatataaggcacaaccacccttactccaaagaccaagaaacaattattatcacctcctaatttgtatcaccctaataaataacatgcatgcacccaatagaattagagatcttgatggtggaggacttaaaaaaatcataatttaatggagaaaagatactaactaattgcatacatgcatgcacgccttatattatgaaacatctataaaaagtagttgtgccttatattatggatcagagggagcacttaaattttttgaataagacgaacagtcaaacatgtttaaaaaagtcaacggcgtcaaatatttagggacagagggagcatatgaaagcagggaagaaggaagtgcacagagataaattaggtgaaaatgacaccacatgaaaacatatgcataacaaaaacaggcatctgtacatgtgcactacaaaaacattagtaatcaactgtaaaatggcatctcaatgggaaaagcaaaataagactaattagatgcatttggatagtggatcaggccaagaaccagctcaacacatatcaccccgaaagatgggtagactctgaatcagttaatcacataacagaattgaaagtggcattcttgaattaaattgtgttatcatgcttaaacacttcaacttcatcgacctaaacaatagtaataagcgacaaaagtgacaaaagtcagactgccagtacaatcctatagtaagctgacaataaggtccgatatccatattaacataatattttgaagcaagttgcatagaaatagaggattgtgtactcatgttacgtcaaatagcccaggccagccaaaaagccccaaaccgacccaccagaaaagaagttaaacttctcatatagaatttacctaatttttttagtacataaaacagagacccctttccttcatggccaactaaatgactcacatacttgcaaggaccttccttataatgctggatatttggggtgattggccacagtattctcaacgtgtggccttgttttatgggaactgctttaactaggacctgcaagtcatcaatttccataattaaacatgtccaagtaaccttacatttcagaaaaaatcaccgagtggtgcacttgacttttgaacctatctttagcaaatggaaaatatcaacctggagatgttcacttgaacatggatgaccataaaaggaaaaccgtttccttccagtattcctgacatcagagaacttattttcaacaagggtttgaaggttgtcaagactctctgcatacacaagttacacaacagatataaggaaaaaatatataaaaattgaagaatttgtacagaaatgaaaagaatggtgtaaccagtttgataaagaaaaaacctttcccatacacaacaagttgcatcaagttggctgaatagtgtgaactataaaatgtaataagctcttccaatatgtccaatccttccttatttggattaaccagtaaagtgttccgatttcctaaaacaatagatgatcagaatattagtgaaaaaaataattgttcaacctttgaagcatgtaaacatagggcctgctcgtaactgcttgccggctgccgctgcggcttctatacagaaacagtagccagcatagctctttgttgcggctgtgcagccgcatccagcagttccaatcaggcctatcgtcccgtatttcattcaagttaaaacttccatagattttgatttcagagaaaacatctaaaatggttttaaggtgtaaatattccctgtccaggagcaataagtttgttatgcttcaactgttcaacatagtctccaatttacacctttgaccaatggcttttcatactagtacataacataaaattcttagtacaaacttacaagttcttgtaaaaaaaatattattattgaagtattttcaagttacaatgggaaatctgcagaaatcattttcatatggtcaataagtaaagtaaaatcatagggcaggcataaattattttcaaagtataagaaataccaaagtacttggtgttcaaattgttgttgggatggccattgttattaagattgaggacaaaaaggtacaagaaacaatatcattgacacaaggttgtcgaggttggttatgcaccggagcgcactcccaagaacgcgctttccctcaaaaataactttttgtgaacgcactactcagtgcattcccctgatcttaagagctagctaccacaattttcaccaaatccaataaacaccacgcctcaccaccaaatcaaagaagggatatgtaaggtgttgtgacaggctaggtagatgccaagttgtattagcctggttgcatgggccaattcaaatgtgaagggggaaaatgaaacatttgtcccacaagagcacaattccatgtgtttctgtgtccttcatatgctactgtttcatttgtgaaagcatttttttaatcaaatgatcctcatggcccacatgcaatacaacagatcttcaagaaaaggtgtgcgcaagccttgggtgatagaatagaccacaaaagaagtgaatccatcatgtagattgagaataccataacagaaatgggcttgtccagtttacacacacagtcttatttttttcttggaagaacagtatgtttttttttccatccatgattcaactagctaaaaatttagaatcataagttcatatggcatggatattttttgcagcattacaaagcgtattcttgaaataacttcaacatgcagtatttgttagtagtgagttgtgactataaaatgaaggtagaaacttggacaccttggtaccaagcatgccgtatagttgcaacatccaattgtggtatatagaatcagacactaaaaaaaatgaaattatgactataacacacaccagtgctaaacttgtgatatggatggctctccaagcaaatatgtttctggagctgaaccaaaagaatatagacaatggaattatagcatgaaagaacatggtaaaataaatgaaaacaataaaatagatcaaaatatgatatgaatatgataccatattactattcagctataacagaaaagattaatgatgttttttggacataaaggtacctgactcattcgcaaaatatctgtcagtaagtttttctggttttctgcagacaaagaaagaaaagaaagagattagaagttaattctctcagcaaaaatggcagttccagataagagagaaagcaatgtataccagagtcaacagcattaacttccctaagaattgcatcaggtgacatcagtggatttatgaaaaattgtgcaaacctaaaacgacaaatgtgaaggaaatgaaacagagttgcaaagtaaaaaacaaaggtgtaaggaaagaaagaagtagaagttacctatccaaagcatcatccaggcaatcattgttcacatcaaaaaaaaagtttgtgtgttcacgagatgtgaaggcgttccttgaaccaccatgctaaaagaaaacccatatcacacaattgatgattcaaacatagaggaaaaacataaagaccatgatattatttatacaaatttatgaataattatggctcctaccaactgcatcagaggctagacagatggttttctaattagcacagttaataattaaagggatcaatctctgcttgcagaattccagtagcagcataacatgtgggagggaaatcatggttcaaggcttcaagcactgcaagggacaaagcttcattgcggccaacgttggcccacccaatgattgtacagtctatatgataagtaattgtatttaaggcattttacttattaagcttcaaattggtcccatctggattaagccactcgtgcacattagtgttcgaccactcactctgccaccgaaagcactggtgcgccgcaacagacttgcaacatcaaatatatgagttcactaacaagtacacgtgtctattatattgcgaccaactggtaatctagggaaaaaagggcagcaacccatgatcaaacataaactagattagctttacaaatactgaaacactctaacggcactagccaagtacctccaaaatgtggtgcaagtctctagacattgccaaagtaaattgggcgtggactagacattttgcaaagcctacagtatgctgaagttcagttgacactctcctgaacaaattgttctcaagcattttcactaagttttgagatcaatttaagttcgatcaaacaaattattgaccacagtaatatcaagatcagttagaaagatactttttaaattaacagaataggtaagtagatctgcctggcaaaatacatacctctgcaatatactttgagtaactgtcttctataggatatttctcgctagcatagaaaagcatatgctctgtaaaagaggatccaggcataagggaatcaaacaatacagagctacacacatgttattactgcaatacatgtgccatgaagcttttcacatgcaatactacaacccaaccaagatttaaaaaaaaaacaatgaggtttgaagagtggttctttatgaattaatactctttaaagggacacactagaaattataaagagagcaatatacaacagccaaattaaacatagactaagcacagtgatagcatgacacgcaagaaagttgtgcttactttacctgaccgagaaaaaaatagttacaatgactagtaagtaaattaattttctgattggataacagtggaacattatatttctattgttcaccttaagtatccaaataagatgcttgaaacaatacttggcctgcccgagaaaaaaagttagaatgactggtaagtaaattaattttctaatcggatggcattgccacactatatttttataatcacctcaagtatacaaataagatgtccaaagcactctggtgctgaaatgaactttctaataatatacgtcatccatttcagtacagaggcaatataatgaacccacattagcatttataatgtattacagtattagtataacagttttcagtcacaaatggcattgctggtacctttgatcctttaatggcatgtgaatttcacataagtcattttaaggcccaactgttttttttctcttaatgccctttcacatatggactttgacatctttgcagatttatcaagtaaatggttagttccaaacgttattatgcaactcataaacttttcaaggaatgggccgcttattagctagatattgtgacagcacctatcaggagatagtagtgttgaattgatgttgtacatgtgattcagccattcgtgtgttttcctggccatgctatatttgttttaatcttctcatccagagatactcagtatgatttggaaaatttattttgagatgtgttgcatgtatttttacagctattgatgttacccaaaaatgaaaaagaagcatgctgctgtctgtggacttagaagtattttttacttgcacattttttacttgatgggctctgagaaaaatatagatatccaaatttcgaccttcttcctctttacatgaccaattcagcaattaaacaactaaaagcgcatacacgtattagaacagtgccagccacagtgcacagcctaaaacaaccttcttgtaaaaaccgcagaatgtagtggtagcctaagcaggcctgacgcaacataagtgcatagagatgatagagagatcaagggtattaagcaccaaggcctgactgcactaagattatcgtcaccaacatcctgtatattcataaccatttaagggaagcagctaactacaactaaaatcacacatccacgattaccaatttctcacgttttatgcaacaagtcaaaacaggaagctcaccaaggaagtgtgcaagcccagggagcccctcggggtcgcagaagtagcctaccgagacgttcatcgacgccgccgactgcaagcaaacaaacaagtcggggttcaagccaaaaaaccagagagataccaaaccccggcggcccatcccgatcgaaggagcgagcgaagcaggaagaccttatcggtgtcggggtcgctgatgacgaggcactcgagggcgttggggagcacgacgcggcggtacccgcgcttgtcgttgcggggcttcgtgatctccacctcgccgttcgccgcagccggggccgcgccgccggaaggctcggcgggggcaggggcttcccggggcctcgagtccatcgcggccgccgactcgccgccgcgggcgtggactggactgaccgagaccgagtccgcgcgggcaccaggcgggcgaagagccgaagacgaggagttggcttggcacgagcacgacggtgtcttcgcggcggagaggggtggggaaatgggcttgggccggatgagccacagcgacatcggggcaacattttgttcaaagcccaagtcaagtgtactcaagtcaacagctacgtaccgctccctccattttattttcatatatagcaagactttctagtatattcatctagatatataaatatggataatattagaaagttttacattgtgaaacagagaaattactactatggttctagtgcgaagacaccgtcttaactaggtgtgtttagttcacgttaaaattggaacgatctgatgaaaaagttggaaatttatgtgtgtaggaaagttttgatgtgatggaaaaattgaaagtttgaaaaaaaaaatttacaactaaacatggtgtgaaattttgacattcttcaacgaaaaaaaatgaaccctcacgctaaagtgtacttcagcattatgtactctggccctaacagctctaacgtactggcacagaatccaggtcggcatgattcagtgtgagcaatctaatgtgcttcattgcctgcaatatgacaagtagcctagtggttagatgaccttcatgccataccagcgtcgctggttcaactgttggagcatccacgtctctaagagggaaagctacttaaaaagtactaactctgcaattctgtggtatcgtgtagacccatataaattcaggctgtgtttagacccaaagtttggatccaaacttcagtcatttttcatcacatcaacctgtcatacacacacaacttttcagtcacatcatctccaatttcaaccaaaatccaaattttacgctgaactaaacagtaaacacagcctcagctggcattcttatggctggttttcaaggataggttaaatactgaagccaatatggtcagcaaaaagtggaatgatgacccccactgccctgtttgccttgctcttgagacagctgatcacatcatcctaagatgcaaaaataccgacaatctctggagaaaactaggactcttgcatctggcaaacaaagcagaaacaatctctgatttcatccaagcagccattgacaggaaacaacacaaagggtgataccaatctgatttgcagtctgcgcttactctctgtggaaatcacgcaacaacatgatttttgacagacagatggacaatctccagggtatcatgcaacagatctgtgattccctaaatctctggtgtgtacgaagtaatgaagacactagacacaaaattcgatcatggtgtgaaagactgtcctaaacaacagcctaatgtttatgcttctgtaaattctttcttttcccccgtttttttctttcttccttaacctctataactctttttccacttcactcttttttattccttcttctccctacctctctcttaactaataatcttgtaaccctaaacctcatttctataaatgaaatgactataaggtagagcgctctaccttcttgcgttaaaaaaaagtactaactccatcccaaaatacttgtcgctttgagtttttgtttgtaatgtttgatcattcgtcttattcaaaaaaattatgaaactattatttattttgtttgtaactcgctttattaaaaaatattttaagtatgacttatcattttttgtatttgcactaatttttcaaataagacaaatggtcaaacattgtaagtaaaaagtcaaagcgaccactaatttagaacgaatgtagtaaagaataatgaatatattaagtctttattgcttcccgagtcaaacatggcaccctcaagcagagaagggtggacaccacactaccacaccacaataactctattgtttacttaaacatggcactgaggtggtgtttttttgtgttgtagatgaagataaagtgttttacgtaaaacgaggttgtattagcgtgtgattaattgagttttaattattacaaacttgaaaaatagatttatctgatattttacagcaactttcatatagaaagttttcgtacgaaacataccgtttagcagtttaaaaagcgtgccatgaatatctaaattttcatccaacttttgttagagaaaagaacaaggcctgagcccctagtgatatgaactgcgtgaccatatagcaatgttcccagcgccaagtatacaacgctaagttgtacttcagtaccaaagatgacaacaataaggttggcatctttttaatttttttttgcgagattcattcttcaaataagttttaaagacggccaaatgtaaaatttcaaccatctataggtagggtacgtgtgtatttacataaacaagactcaattgtcctaattaatactctttccgtttcatattacaagttgtttgacttttttcctaatcaaacttttttaagtttgatcaagtttatagaaaaaatgtagtagtattttcaacacaaaacaaacatactatcaaaatatattcaatgttaaatttaatgaaactaatttggtgttacaaaatgttctaattttttctataaatttggtagtttgactagaaaaaatgttaagcggtttataatatgaaaggaggattaggctaatttaatgatatccctatttcatcatgtcttgtactaagcgcacgaggtaggatttgcgtgtgatctaagtcttccttctcttcttattagctcacttgatatatcaagttttttctactccctccgtttcataatgtaatactttatagcattgctcatatacatatagactatgtgtttaaattcattaacatctatatgtatatgagcaatgctaaaatgtcttacattgtgaaacggaggaagtacatgacatagcgttaaaattatgggttgtatttttggtttaaatgtactatctatcttaaaatatatcaatttttatacacaaatcctaacaatggttcttatttttgctagaccggctaaagaccaagctagccaaatttcattaagattaggattatttacaaagagataggtccttatcatggtgcaggtgaaaaaaatggttcttatttttgctagaccggctaaagaccaagctagccaaatttcatgattttacaaagagataggtccttatcacggtgtaggtggaggtggggaaaaaaacaagattaggataaagagacatccctccaaactttttttttaagaaaacattgtgaacatatatattggaaattgatcacgagacaccagagttgaaaccgtacactttttaccattatcctatcaaatgcatctctatggtgcaggtgaatctcgctgctgttaggcgtgtctagagcgtcggagttttacgtaacttttgtagtaagatgtttcttcagacgtattagtcttctagttttgagcaaaaaatctcgcattctagttgttgaggtgtgatacacatatagctgcaaaatctctgcaatccttgccggaggagtaaatggtaaagggggaggtgtcctgatgatggggggactctgaaatgcagacacttccgcaaggaactccaaacagcaaacaatctaacatgtttgtagcaaacgagacaaaataacaccggttcgttgttaactccatgacaacactgtcttttatcatgtggaccaaataaactccaggagcacatcgcacgacgcccgtgatatctgacggccttttctgaaactaaaatgcccggttctcgaagagatcaggctaggagctctggagctgaagtggcgaagacgtgaatcaagtaaactgttctctcttgagataacttctgcatcatggattctgtcagagaaggtaaggacaaatggacaatcactcttgtcactgcccaagtttaacaggttgctccttctgaatgaaacttcgagctaatccatctgaatttgttagtagtaaatactgtagtacaatttactggtgcaagaagtaagagctccatgacacccagctactctgaagaaaatgttcaggtgttcggcaaagttgcattcagatgttaggctactcggctactgtaagtacacatgttagtacattgtatgagtccttgttatatcgagcaactgaggtggtgtttggatccagggacttaactttagtccctgtctttagacactaatttagagtattaaatatagactacttacaaaactaattacataaataaaagctaattcacgagacaatttttttaagcctaattaatccataattagagaatgtttactgtagcgtcacataggctaatcatggattagttaggctcaatagattcgtctcgcgaattagttcaagattatggatgggttttattaatagtctacgtttaatatttataattaatattcaaacatccgatgtgatagggacttaaaagttctagtcccatctaaacagggcctgagcataggggacaaacaaagggcctgttcactttgatgccatttccaaccttaccaaattggggatcctctagagtcgacct

SEQ ID NO: 54117 - DNA, 1089 bp, Oryza sativa
ttattaaaatttggcagcaaactaaatgtagccacttttttggcaactttactaaaatttggtaaggttgaaaatggcaccaaagtgaacagcccctaagttgatcgctagtgacatactgacatggcagtcttggcagctttgcattgtggaccaaacgccgccccgcattttatctgcagctttttctctgaaaattgttgatcgtactgacgccttcaataattgtgtcccgcgatgattattttggagtactcctacatcatattcagactcgtacggcttgatctgccatacatgctgttatccaaatagattaataactcctcggagccatggtccaatggattaggataagtttagtttgagaccaaaagttaacaaaagcaaaatgagtttaatctcactggttaggtttcttggatgaaagtagctcgagttctagacttaacataagtttcttggatgaaagtagttcgagttctagacttaacataacatgtgcgtttatatttatgactgattattgttttgatgataaacaacgtatcgacaacaagacacttatgataatttcgtaaatcttagtaatgcatgaaaaatggagacacctataataactttgtgaatcttaaaatatactattcttgaaggtgtttatatgaatatggtaagcatgtgtattgagtgtggtgtactacgataaactgaaaactgttacaggcacgtgttgtagcagcatacgattgttcaatcgattgatctaatctgagatgaaacccacaattccaaagtccaaaacatgaggtgacaaccggcagagatcctcaaattgcagcaattccacaggatcatactagtttaattaattacgacacgaaaggaggggggcaaaagagaagatgaacacagctccaaacgcaaaagctcacaattcacagggcgcgcgccatcctaaccccaccccccccccccaaccccccaactagatcaacttcaggccagcggcggcgacggagagcacggacacggcgatggccgtgaagacggagcggccaacggcggcgttgccgtgcggcgacggggcgg

SEQ ID NO: 54118 - DNA, 2884 bp, Oryza sativa
gggcgccatgtaagggccagcagaggagtggccggaggcggcgacgcggatgtccaccttctggccgatgccgcagtggcccgggaagccgcagaggaagtagtggtggcccgtggcgttgaggaccaccgagtcgttgcccgtcgaccaggtggcgatcggcttgctcgtgtcgcagttcttgtagtccgacttgctcaccgccatcacgttgtggaactgcttgttgtacgtgaagactgcacggctttttttttttcagacaagagaaggcaaaaaatagtcagtcaattcagcaaaacacgagagagatcaaagttcttttgagttcaatacaaaaaccatgaaaactctgttgttccgcatcttggactaaccatcccttagagggtattgttaaaagatcctcgattcctaatgaaatcgatttagtagtggcttgatggaagcctaacgtttttatttgatccagtatatgggatgtatatcccattccgaaatgatatattaatctgctaataagtcgttcatagcagttccatctatctctttattatgaaagaccagattggcccgttccgccataaataagtacctctttttcggctgagtataattcgacaattcctgagtaggattcgacaatgggcctgagtcagtgattcgaaaacttagttaacttcctttcctaaatctcaatctggattcgtgcggcaaaaatgatgatactagcgaaatcggaatgcccctcgaaaggggcgaatctaacttccttgtttagatagtgtatgaataggcctgactaaatccttgtatggcttcctctatttctctgtaaaaagaaatatgaccaagagtaagactggggtacgtcatgaagctttgtaaaaacagagctagatcatactagtatcatgcatcagcatgatgaaacagatggtcatttgtgcaaaaaagtgatgtttttattttttgtactacttttggttgttgtggaacaagatgaacctagtgcagttcatatctggaaggatcctaccagctaactcgatcgcaatcaccagatatgacatgcttgagagtcactactaaaagctctatcatgttcagttagttatatttcttaatctattccactcctaaaaatccactctctagtgtctagtatccttactaatgactctgactggtgacgactatacttggttagatgtgattgggaatatatgctgttatacataacgataaaaacaataacagcattggtttgacaaaagaaacccacggcaccacgcgtaactatctcaaagatactataaatctagaaccaccaaaatagagctaaacatgtgaaaatcctagagctagctactttgactgatcggatggcatctctccagggcaacaaatgatatgatcgcaatgccaactttccagctcatgggccaaacccaatcaggtgtccacattgcaaaatggcagtttggcaaccctatcataatagaacagcgataatcatagaccctctttctggacgagctatatgcatttgtggttctttgattactctatgcttccaagttccaaaagatggcatccgtgccgtcatcttttcggcccaccaaggaagcctaccaaccaaccatgagattgctcaacagaaaacaatgattcaatgagagcgcatgcatcggtgtgttggccatagggtccaacataattttgacaagctgtggaacagatagcaactgagagcatgaaatatactcctataaagttgtggttgattaggatttgatcatttaattcaatgcaaagaacaaacattaactttcttcagcagaggcaactgaaaaaaagtgcctttggtgccctctttttttaatctcagctaaagaacaagtgccttcaaaatagtcggcacacatgtctaattgtgcaaaagaataaaacgcctttccttaaagcaagaaaagctaatccttacaggaataattgagcaacaaagtactcacaactcacaaggagcgctagagcttaaaaagaaaaacaagtgttatggctgacaaagtgacaaatgactaaggctgtgtttagttgagggggaagtttggattttggttgaaattgaagatgatgtgactgaaaagttgtgtgtgtatgacaggttgatgtgatggaaaaggactgaagtttggatccaaattttggatctaaacacagcctaaggccctgtttagatcctccaaaatggcaaaagttttaccattttatagcactttttgccattttgaatttaaacactagtagcaaaagttggcaatttggcatttggcatttgctagtccatagtagcaaattgtgccaaaaagtgctttgggaccactccctctctctttctctctctcactttagtgctagaatggaaaaactttaacatgcatctaaacaccaactagtacttttgcaatgctaaaacttttgccatcaaaacttttgccatttgtcatttgccattccaaatggatctaaacatgccctaatttggccgtgccttcacgctccaactcacacgcaggcatacagatccttggtgagaagggaaagtactcatctggtagtgcgcgctctttccgaaaccagcatgttctttggtggagaagaaacacaaagaaggccagcgctatctgacgtcaggtatccagatagacctgtttggattcatgccaaaacacggagtactctcgcttaccacaccaaccgcgtgcctgcgtgtcggcgcgccgctacgccagaacgacagatgcgcgtggaacacgcacacgcaccgggtgtggtgcggccgtgcaggccaggcaaacaccgatccggctcgcccggcgaa

SEQ ID NO: 54119 - DNA, 938 bp, Oryza sativa
atgtgtttacatggtgtatctaagaagatcgtgtctgatcgaggaaagccaattcacttcaaagttctggcaagaaattacaagaagaattgggaacccggttgaatttcagcactgcttaccatccacaaacagatggccagactgagcgagtcaatcaaatactagaggatatgttgagagcatgtgcgcttgactttggtggagcatgggacaaaagcttaccgtatgctgagttctcgtacaacaacagttaccaagctagtctgcagatggcaccatttgaagcactgtatggacgaaaatgtcgtactccgctcttctgggatcagacaggggaacgccaattgtttggtacagaagttttaaatgaggcagaagagaaagtcagagctgttagggaaagattgagaatcgcgcagtctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcacatcgaaattcaggaagatctgacgtatgtggagaagccgactcgtatcctcgaaaccagcgagagaaggaccagaaacaaagtaataagattctgcaaggttcagtggagccaccactcagaggaaagaggccacttggaaagagaagatgagttgaaggccacccacccgcacctcttcgccagctcttccgaatctcggggtcgagattccgtttaaggggggtaggtt

SEQ ID NO: 54120 - DNA, 5394 bp, Oryza sativa
  unsure (1)..(5394): unsure at all n locations
ccaagttgacagaaaaatctatcatcatttaaaatataaaattagtttcattaactctaacatttcatatattttgatactatatttgttttgtattcaaaattattggtgatatggacccgagggtatcatgtctagagggaggagacggcccccaaacccacgtggcacttccccgaggggggttgggcccggggtggagtggcggctgctccctcccagttggaggctaggccaccctaaccccctccacgcacttaccagcatgcgcgggttaggtgggcgcacccaacgcccaactaaccgtatttaaggcgggtgttgcggccgtgccacgccgtatttaatgcggcgtgcaggtgtggctgacaggctgggtgacgctgaattgaccgacgtagcagggtgagtgcgtttgctaaaaaaatgactaggaaaataagtcaaactatttatataaaatgaaatggagggagtattttctttgtttttcccgtagcactattgaaagttctcatcttcttctttcctatgtttttaattccttcagaattgaagaattcttctattttttttctattcctatgtttttcctatcctagaatcaaagggggcctaaatatcttttttagcaattattatatcaatgtttataaagtgctacattcgtcccaaaataagtgcaacccatggatatccgtgtccaacgtttgaccgtccgtcttatttgaaaattttatgattttttttaaaaaattagtcacatataaaatactatttatgttttatattctaataacaaaaaaaatactaatcataaaaaatttaaataagataaacggtcaaacattggacgtaaatagtgcaaaacattacttattttaggacagatggaatacgtggtaaatgtattaggagtggataaaaagagaaataattttattggaatatgataaattaggggtattctagtttttttttgtgtatatgtacgtgcaagatgagtgaaaaataaatatgacggagggagtagtttcaatgcatggcttgaaagttatagatgctatcctgtatattgcccgacccagatatgtcggccggttgataaagtgtcaacgttcccaattgtaaaaaaaaaaaaaaggaaaaaatattccatttcagctttgttggcctattttgcattgattattcaatttagatcaggtagtggcactcgcattacaagaaacgatggcacatttacgctttcaaacatgagatgcagtggatgcaaaatccagatctgaatactgcatcatcaggtactaccggaatagctttcagttgttaatttattactatctggcagagattataaaatgttgacctgggcatggagattgattcataccgctttgatattcgttgccagctgctactacctttcaaaaaatagattaatttccagttaagtgcatattttattcccaaataggactacatccatcccattataagtgcagtcgtggttttccgcgtccaattttgaccgtccgtcttatttgaaaattttttaaaaaagtttaaaaacataaatcacgagtaaagtactattcatgttttatcatctcataacaacgaaaatactaattataaaatttttttaaataagacgaacgatcaaagttggacgcggaaacttatggttgcacttataatgggacggagggagtaccacttactaagttcccttgtttgtatcctcgctaatgttattcgatctcataactcttagacaaactttagtctctgttagcaagtgaatgctaaaaaaaaatagattgtttgggtataaagagttatgaaaaccacgatgagaaaatggattagatttcatgtttaaaaaacatttttggcatggttggatagttaaaaagagagtaaaatgttcggtttcatagttgatggttcatcctacactcaatgatagttatggtgtgtttgatactttccttttccatcgcctgttctctcatttttttttcgtgagcatgtttttcaacagttaaacgatgtattttttcgtaaaaaagaaaaatatataggaaagttgtttatttttagctaatatttattaatcatgtgttaatgagttattttgttttacgtgtgtgagggagaagtactctttatttagagtatgcaataagccaatatcgttattattagaaagaggatagcatatcagaaagcatagttcctccttatttgccatctagtaggtgtctcatagacatatatgtgacaaataagaaaagaaataaaataatttccacccgtgtataattgatccccatataaacagatcagcctaggggcctaaatttggaaccatagttactgacaaaaaaaaatgagaacacaatacattgcattcaactagctagtcttgcactattaaatattacatttttattgaccaacatcttactactacaatagtagggttagagaactgaaataccacgtgaaacaaatgtagaaagtgggagtagtacgtgcatttgttctttctttttttcaggtaattgcaaaagtatttctgtaaacacaaaagtaacctgctgtaaaacacgcagctcatcgtgcaaaagaggagcacagataatgcaaaacaaatggatgtccacgagatgactaatagagtaatgatggtgatgatgcttgttacttcgaacatgggaaatgaaattggggaaattagtcttcatgattatctaacagaatctacttttaaaagctggaccagcctaattgtctctcctctactaccactttactccaatttaaaatgcctgtttctggatgcaaattcaacccatgatcttctgcatccaagatatagctcatctttagtcaacactgtatttctaaaacaccactacttagggttagtgtctaagcttgaacaagtttgggtataactaaatttatagtcccattatttcgccaatagctatccgtgccctaaatatgaaatacccaatacatgtatactaacttcggtggagtccaccatataccaagttttatacgaaatcaagccttaaacatatgggaaaagtcctggatagacaatataaacttatgtaagttgatgtggtttatgataatttaaatttaaataataatgattcaaatgtaaaagttgttgtggttttatgtaaaagtttggatcatagattaatcatctaagggctaaaacaattgaggtgatatgacttaataagagaagaaattaagggagataatttgaaccatgaataatcatctaaggacaaaaataattgatgtgatatggattaatgagagaagagagagagagagagcacattaacttagttaggagttaggatgaactatataagtatataaaatattataaaaaataatgatacatattgaaatattatgtgaattatgtgagatgataatttaacatgcttacatttgaaaagctataaaaattaataaattataaaattatagataatataacatgcttacatgtttaaatgtaataattgttattgaatgatgatgtgatatctttgtatgttaagtttttcgatttagtaggctctaactttataataaaagagaaaatgtccatatattgcaatgggttagtaccaatggtaatgagctgggtgtgaacctaacctaaaccatgtgaatttttaaccaacctttggtttatgtttttatccaaaggattttttattttttatttttatgtgtgagagcgtgttgtgcacgagggaaagggtggacgaacgtcactgcaaaattatgttgtttcgagacggccggataaatattacaaaaaaatcagtaggatagtatttgaacaaagtgctctttctttttaacttaaaataattttgacattacaaactttttaattgtgtaatgaacaaaagtagccctaaatgaacgtagctcaactggctatgtttcttatagtataacttgttcatttgagtttaagttttggacttaacgacagaagacatgtgctcacctttactgctaattatttttttcaatagtttaaaggtcggtttcttttcttcttttttgaataaacttttgcagagcaggttgccggttgtataagtcaaattaactcccagaaattattcgtagttggatgcgttccctggaaagcagagccaagttgttgatatttggtcaataaacactgcaaaatcatgtgtgtttaatttcccataacacactttccctatttttggcctattttatgcccacctagcccctaatcattttaattaatcacaaaaaatatgtttcgttaatgcattttttataacaaggcggctagtatatactacctccgttttttaatagatgacgccgttgactatttctcacatgtttgaccattcgtctgattcaaaaaatttacgtaattataatttattttgttatgagttgttttatcactcatagtactttaagtgtgatttatatcttacacatttgcacaaaatttttgaataagacgaatagtcaaacatgtgagaaaaagttaacagcgtcatctatttaaaaaatggaggtagtagtattaattttgagatctattgctgctacatcctactcctatagggcaagtgagttaagggactctaaagggactgaaaggctgaaattacgataatgaggtctaacaaaagagatgcccaatacttgaaagcctctttcttgtccagttttaattctttatattttatactgagctacttgcttaattaaactaatgccgtgggagacaactcgaggtaagttggttctaatctttttgtgttctttgtgtttactttattggccccaagataatattatatctgggatcatgtttctaggtttaaatttcttaagcctattaaaaaaaacatgggacatggacaagcaaccaggccaatgccgccatccactcgagagattgatcacacaagcttggtgacgcataatttttttattttactattgcaatattttaactttgcatgatgcatgatattattattatgtttaccactagatacaatattggtggtgaggccaattatttatctagggcaagtgcatggcttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54121 - DNA, 711 bp, Oryza sativa
cccctttgggaaaaaaaaatattttgagcttgtgccaagttagtcatgggtgccaagaggagctcaatgatccccgcactcttgctcctcgcttccttgtccatcttcaagctaccttgcttctccagatcactctctttcagctacgatttctccaagcccaccactttcaatcgttccgacatcgcaatagatggatccgcgagtctcaatggtctcatcgagctcacgcagaacgctgacccgaaacgtgaaggcatatacgacacggtgggccgagggtcctacggccatccggtgccgctctgggacgaggccaccggcgaggtgacgagttttacgacgcgcttctcgttcgtcatcaagtttaactagtcagacaaggccaagtacgcacccagcgacgggcttgccttcttcctgtcaccctatccgtcaaagatgtctccactcgacggcggtggattgctcggcgtcttcaccaacagcactggcatgaatccgtccgccgccggcccgatcgtcgcggtggagttcgacacgttccaaaatgagtgggaccagagcagcgaccacatccgcatcgacgtcaactccatcaactcgaccgcggtgaagttgctgtctgaccgcagcctctccaacgtcaccgagccgatggtttgcgtcgtgagctacaacaacagcacaaggatgctggccgtcatgctg

SEQ ID NO: 54122 - DNA, 1055 bp, Oryza sativa
  unsure (1)..(1055): unsure at all n locations
tatcatctaatccacttaatttgctattacatcatgatcctgctaaataatctgttacatgcaccccccttggttgtttttctgtacatggacctgaaatcttgccctatgttcatatgttggattcaaggttgcagcagactatgtttgtctttgatcataaaaatgtaaatagtggtaattcccctgtctggagaaaagagactgctgatcttatcagttctaaatgtgtaacagcatttagtagaagctttagttttatttttctcaaatggaatcttaggggttaagcagacattgtttaaagctcaggggggttatctggactttcgccttaactctactttagttggtgcctatgttgttatcctatcttttgtcgatgatactttatgtacttatctttctctttgttgtgctgcctgatccatcataatttatacatgttcaaatttgttcatagttgaaatttgtgtggtcaatgacttgctactaattcatgagttgttactatcagattggctaggcagacggttaggtccacggcttcttggtaggggcaacgatggctccatggtactcacatctcctctgatattacccttctcctttcaattttgtggatttgcttagttccttatttatttctatattctaatgcgcagagggtcatgagggatttgtataggatgcttgacgaaataaattctgaagaagtacctgttgatttgaaggtcccaaactttttgatgaattcatctgggacatgaagaataatgattatgatttaaagtcatttgcttttaggctgaaggcaacaataaggttctttcccttgtttgagtactggccatattttctatttctgtccaagcatgtgaatngcaaaagttctcactaggttatgttggtggtgacttgtgcttgagaatgaacgtcatgatttctttgagtgtggttttactttggaattcaactgaaagcttgtgtcacttcttgggaatattaatttataacagntatgttatttgtgttggatggtgatggacacgcta

SEQ ID NO: 54123 - DNA, 2083 bp, Oryza sativa
actatagggcgaattcgagctcggtaccctattcaaggtgggttatgcagcaaataggtcataactaccttaacccagtttcaaataccgatatagtctaagttcacatgcaactttgcaaacaaatattttcattcctcaaatcatgggatccaatgtgttcaaaggatgggaggagaaaacttgccttgatcagagaattgttagcacctaatccacttcttcaccgattatgcaattatctagataaaggacacgacatgcaattaaacaccgaaagagctgaaaatccaaaatgctctaaaatgcatgatttatgcacagtgggttggaaatgatctaaaatgaatttaggtgaaataattcctattttattttattccatttgggagttatgaattttagaagttttatcggtttacaatagtatagtcttaggtagtgttatgaaatacttttgtaaaatgatttttattagattagacttcacaggggtgtggagatgtgttttctaagactaacacatttggtttcacaatttttggaattataatgaattctttatgcattttacaagttataacgtgttttagacatatagtgttttatatgttcatgacttttgagttataggttcagaacatgctacttcctgtttaagttgaataaaaggaataatttggttaactaaaacatttttatctcacatgtttatggtctttactactatggttcatattttataaagtagagatgctttaatctaaactagcaatatattatattaacctagaaattgttatatgagctaagttcttctaattttagtggatggaaatggaactatggcttcactggtcaatcaagtttttatttaggtttaattagacctaaagtgtatatatatacttatacatgtttatgtattacttaaacaacactatgtgtttaaattcttatttcactaagttaaggttttgatcaatgttctctacaaaaggtgacaaattttattttactatgttgaagataactatttgctggttctatagaaactttgttcatttcatttggactaaaaataaattttctacaagttttacaaattaatggctgctctatgttagtaaatccttatatgaatatttagagacttttactacacagcaagtatataatcttatttcataacatggaaatacatgttttagtgatcctacataacttaagtttattcaaattgaagctaaattgggttctacatgaatttctaaagtttagcttatctaaaactaatcattatagagataatagttttagaggcatttgatgcaaagtaagtaattacttttatttcacttaatcagagactgtatgatgatgaatctgtagaatttgattttgtttcaaaatgagttgaaatgaattttctatgtattttataagtttgtacatgttttatgtataacctatcttagataaattttagagacattatttgtacagtgagtgtcaagttttatattcctggaataaagttcataacttcaagaatctacagcaactggaataacttcaaaatgagctatatttgattttatatagattttacaactttgtgcatttttctgctaaacatatatttgtttgggcattttcctaatttttcttcagattttaaaggatgggtccacatggctgtgagggaccaatatgcacaaaggcccttgaggtttctaggaatcaacccgcagtcctaggcccatatgtcagtgtgtttctacaattgtaaacagatccctgcacttaatctaattcacggaagtcatccctctgctctaggcagagcagagctagccatggctgagctcgatctggagctcgccggcagcaaacggtggctcgtttgagggtgaggtcaaaagataaaatgaagagcaagctctcgcgattccattcctctagttttcttggtagaggacatcggagtaacgcccatggcaagtgtgagccgccgtggttttgggtgaaagtgcatgtgtgcatggaagtcgattaccaatgaaaaggatgcatgcatgtg

SEQ ID NO: 54124 - DNA, 10721 bp, Oryza sativa
  unsure (1)..(10721): unsure at all n locations
nnnnnnnnnnnnnnnnnnnnnnnnnnnnnnnnnnnnnnnnnnnnnnnnnnnnnnnnnnnnnnnntgtaaacagatccctgcacttaatctaattcacggaagtcatccctctgctctaggcagagcagagctagccatggctgagctcgatctggagctcgccggcagcaaacggtggctcgtttgaggttgaggtcaaaagataaaatgaagagcaagctctcgcgattccattcctctagttttcttggttagaggacatcggagtagcgccgatggcgagtgtgagcggcggtggttttggggtgaaagtgcatgtgtgcatggaagtcgattacgaatgaaaaggatgcatgcatgtggtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgtgcaaggaatcgaacaatggctcaccgaggcagcggtaatcgacgatgacggcagaggcgatcctagattggcgccggtgaagaaaaggatgtgttctccgtgttcttgatgtttccggctggggttcttgaggcgttttgaagaggaggttgaggtgatgacaatggcgcagcggctttctctgaggtggatgagaatggccggacgacaacgatggttgaagcggcggcgctccggtgcgtgctccagggcatcgtcggcgtggtcgcgttccggtggctgtgatacacaaaacgggaggtggtcaaaagagaaatggttcggcactgtgtggagagaagggaacgcggaaaacctggagatgacctttacccaatcagcgatggcgatggtcgtcgtctccacggccggcggcaaggtttggggcgatggagaggcagagaacctcctccctcggtttcttcggctctgagtggtgaatggagaatggcgacgcgtctaggaggagtagagagcgagaaaaaggaaaccgagatcgacgacacgttgcggccacgcgtcggctcgctcaatctctccctctctcggctggagcagtggaggaagtgatggacagagctgaacctagcctaaggcactgacaagtggggccaactcgatggaaactaggccagggagagagatatgggtagaagactggtaaactggatttttagattaattttcggaattattttctcctctaactttgtaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagagaaggaaaattctagaaaaattacatttattcatgataactaatctagtatttgaataaattattttccatgttcactgatgtgcagttaaatgtacttttggatgaaatatggttttagccgattaaaatttaatttgatttcttttagttgtctgcttcgaccgattaatttgagatatcaacttgagtgttaacacgttaccaaattacggaggataagtttgtgctaatcattgtccacataaatttttccatgattttatcttgcacaaaatattttagagaattaagttgacctttgtttgtatatgtgttcccacttcataattgcatctaatattattatagggattacattaaacttcttttagactgagaagatgatatttgagtttaatattaagtccacatgttattacccaagattaactataggtttgtttagtgaagtaattcttttagattatgctcatgggatctattatggaatgcaagaccaaaacttcaaatgcacaaagaactcgagcctaggcatgcattatgtacatgtatgcttggtgacatttctagtctaatgttgggaatgaaaatgttttattttgttctcaaattttaatcatgcaatggtttaagttgatcatcacctaaattaaaacggaaatttttggctctcaaaattggagaaattaacctctaactattttgataagaaattttaagtcctaaaatttcgggtatgttacacctagtctatcctaggttgatgatatcgacgcttgtgggcgccgtttcctccttggaggtgtcgtcatgttggttctctcttccttcaggtgaaaaccgggttcctttcggaacgggcgttgacagcatccttaatgttgtttccttgttgaaggcttcgctcagaaggtatttgctccactagaggatgtttggtggttctggagaccttgtcattatgttgtcgaagctgcttgccttttggtaagctcggtaacgacgacttctgtgaggtctcattagttgtttcttttcttttctgtattggtttttgccggtttcccgtttaattaaccgtgcttgtttggttttcgggcccggtttcccttattaactgggccaattctcttcttctataaattccggcaggagaaactcctgccgtcggttcctcgaaaaaaaaattcatatacatatataaatcatgatttgtgagcctatgaccaaagattatgattgtcgtgctatgtatcatgactaacaatacaaggaataattacgagtttattacgacctttacactggcaaaatgtggacaattaacttatatcttaatacatcatgcgctcaacgagctacctcgagttgtctcattaaacaaatgagtaaaagttcaaactcaactcaactcattaactgccaagtcgagttgagtcgagaagagttttacacaaattaaattggggcaatagcgcttttgaccctgttctagaacctaccaatttgaccatactttttcaactttgctcatttgaccctcgtttttaaaactgaagatcaggtctgacccccttctgttaaatcaacgtaacggtgtgcccttcttattcacacgtttgtgccgcctacctccttgtttggaacaaacaggagaagaccgcgtcgccatcctcttcgaagcaagaaggagcatcgccaccacacatcgtcctccccgtccagatcgaggaacagcgccgccaccgtcgccgtcctcccgtcacgacgcggcgccgccacggatttactccctccgtcgccgccgccgccgctaccgtcttccacgagctggcgtgaccgctccctctctccacgagctgacgccggcacggatccgcttcctccgtgtccctccgccgtcgctgctgccttcctccacgagccggcgcgtccgctcatccgccactgccgcaactcgcccctccatgcgccgccgccgcacaggatatatgagagagagaaacggtagtgaatgggtaggttagatgtggattggtttccttgagggtagtttggtcattacagtatttttttctaaaaaaaatggaaccttaacagtgcggtggaaacagggttagacggggtgttcatttttgaaaagcgggttcaaatagcaaactagaaaaaaaaaagctagtttagtagttagtctttcaaatgaggtcaaataagtaattatcccaattaaattagcttacgagtttcgagatttttgaccaacccctattcacacatatccatccagcatcatagacccggttaagcccctcctatttgggcaggcctacatcccgaaaaggtgctccatggaatgccaaaacgcacccgtcccggttcccattcccattcatagctatctaccacctttttcgatcgttacgcaatgctcgcgcaataacgaaatctaccgcgtgccataccgccacgcaactagctagatgccactcactcgaggttagttaggcatgggcatcacatagcaaactggccatcccatagctttcctagctcccacgagacgaccctgcaccctgcatgcggcagcacggcgcacacgctcctttcttgatcgtgcgcgtggagcccagacgtgaccggccggaacggactccggcttggttcgcccttgcacagcactgcacaagcacaacccggtcgatcaatcgatcgatcagtgagtgccgaatattccgcacctacacgtgttcaccgttatgcgatgcacaagtctagctagtgcacttgaggaataatttggatgcatgtatgctgctgctgcgctttcgaatgtcaggaaaaaaaaacacatgggtgatgatcgagtgaacaatgtgtctcatcaatcagctggccctaaacgaacgaaccatactctgattgcgtagcaagtaccgtgggtgattcgattcgtggatttttcgttcaatacaaagagcgctaactggtaacctggtgcgcttagataggagtaatcagataccactggttatctggtgcttagataccacaggttggtcgacaaatgtccagaccgtgtacacacctgcacgcaccaatgtggcaatgtgcaaaacacccggcctcaacctgtcggcaaatgccctcgatcggcatcaattccctaccaccacgtacacccccgggaaacggagagtgaccgtcgagccgtgggaggaggaaacaacaaccggacgagaagaaagaaccagagctcaagcacccaaacaaacaaaaagttcccggttgaaaataacctgcagtagcttagctactagtagcactgtgagcactagctttgtcctgttccaatccatgtcgtagtaccgctggtgatgctggtaggaccggctagatgcaggccggatgcacctaccttcctccccgtaaacaaacacgtacgacgtgccagcccgggacccgattcgatcgaccggatcaggcaaaaaaaatcataccagcacgaaaagcaagccaaccccgcgaaagcggccgcccggcaaccgccgctccgttcgcctgcggccgcagcagcagccgcagcgaccgtacgctaggaaaaaaattttccgaacggcgccaaacgcgcgaagcttccctccgacctcccccgccccgtctcgccctccgatttggcgcatgccgtgcaacgcaccggccgcgtgcgcgtcgcgtcggggacgagacgagacgtcatctcgcctcgggtctagctagccggtgcaacggctgtttcgcccgtgtcccctcccgcgcgttggctttcgttcgggccatctgatgatggggatcacgctgtcacgcagcacgcgccgtgcgtggcgcggacgtgccagaaaaatgctctcgcgtgcgtgcatcaacgcgcgtttcgggtggtgtgtgcccgtgtggagtacgtatacaacctttttcctggttcgcgtcagtgcttgggaagagataactgttttgtgttacatcaggtgaattcagggtttttttatggcaggcagcacgttcacgttaatcggggatagactatcacctattggaattgtcatatgcggtgcatcggtgtgaattaatatctcggttcgtaatcgtgattggctggtgcgttcgtgcttactttagagctcgtcgtgccgggacaagatgtttcacttcacggtcttcacgtccgtgggtgatgacgtatagatgaaagcctaagaaatttagccttttattggtcttttgtttaatcaacgaggtagctgtcgagctttaggggtgccacgtgtacgtccaacccagagaaatttagccgtggatgtagagccgctggtgaaatgatcgatgtttactggagttacgactaggtcatttgtttggaaaagtaaccactaaccagtcaaggtcactggccatctggctccacctggacagattggacgcacgcacttgaagttttgaatagttcatgacgtcttttttagtgctttcttctctaaatctaagatgagcataatatatactgtaaaatttggtcaaatcacgtgtaggtgcaccagatgatgtaggagtaattatgtaatgcaccgtgcgtaatcggttacggaactgggtagtaggtttaccgaattgcaccaatccattgttggactagatgatgcaatcgccttgtgagcttatttacgaacaatatgatcttatattttctccgttcaagtatataagggatattggcctaatcccttatctaaatatataagcaattttacaatcccaagacaatgtttatcttctatccatcaatgaactcatgcactagtttaatcctcacttaacaactttggtactactccctccatctacttttgatagttatattttcaaatctgaaaaatttatttttgataggtatatttcaatcaaacaacctatcatcttaatggctttcttggatttaatacgtgactctcaattctttcacataagattggctctatgggcatcgagaaatgtaaatattaataaatcgcttgtttacgaggaatgactagtagcatatttaaatagatgataagtagaattatctatcattggtctgtctgccaagataacatatgactatcaaaagtagatgaagggagtattagtttattttttcaacctttaccttatgtactggtttatttcctcaaccatcatcttttatactatgatttaaccctcttttaacttccttaattattctcaaaatggcataataccatgtatttaaagacagagagtactttgatcgcagatcattcagaaagaaggtctatttttgagatgattcaggcagaaagtttcttttttttgagagagaggaaggcagaaagtttcgactttcgatcatctggtagcaaacccagcaaaacttcagcttacaaggtgagcgtgaacccgacaggtcgtcgacccttcggctggatggagcagcagctaatcgcggttacacctttgggccctttcctcggttgggccactggaaggccgtagtgctgctcattgtagccattgggccagtgtcacatgggcttacaatgaaaagcccatgttctccgaatgaaaaaaacgtacagaagcaacgccgtcttttcagctcggatgtctgaaaactcctaaaaccccaaagcagccagaccagtacacacaccattttgcttgtcaatggccgccgccgccgccgatcccctcgtcgccggcgccaccgtctcctccgactccgactccgactccgacgatctccacctcctcctcccgaatctcctcccttccgccgccaccgccgcatcagacgcgcagctccaccacttccacctccccgcgctcccgtcccctatcaccgtccgcaccctcccttccctcggcctcaccttccagctctggccatcggcctccaccctcctccgcgtgctccccgcctcgccgctcctcctctcgcgcgcgcccaccccggagagcccgctgggcatcctcgagctcggctccggcaccggcgccgcgggcctcgccctggccgcggcgctgcccgcccacgccgtcctctcggatctccccgcggcgctccccaacctccgccacaacgcgtccctcaacgcgcccctcctcgacgcccgcggcggctccgtctccgtcgtcccgctcccgtggggcgacgccgccgcgatggaggccgtcgctgctccgccgccggcttctcggttcgacctcgtcgtggcgtcggacgtggtgtactacgaggcgttggttgaccccttgattgagacgatgcggttcttcgtcaagggggaggtggtgttcgtgatggcgcacatgagaaggtggaagcgcacggacaagaagttcttcgccaaggcgaggaagctgttcgacgtcgaggtggtacacgaggacccgccgctcgaagggtggcgccatggcccggtggtctacctctttaccgagaagaagcggcgtgacaagaagtgaagaagctcttccaaaaggtaatgactgcctgctcgattgtgttcgtcatgtgttctttctgtttgttgtgaaagatcatactgttagaattcaaacagagaaaaaaaactgagggccaaaacttggttgtgtggttgcatatggatttggatgtgtcaggtgctatcctttgttttatttatggattctagttaattctcatggagtcacaatgaagtttaggatttcactatcttagaataaccaatctaataatagacgatatgattatgaggtggtagtagcagtacaggactttatgattggcaagggactgccgaaatttgtagtttgaacaagacaaagtttttggttctcaagaacacaagtctagcatgtcttcgtactagcacttcaaatggtgatggacggtctctagagaaaagatcaatggcacaattcctctgcatgcaaggaaggaatgacataaaacattatgttacttaacatggaaagttttttgttcttttgtgttacttttatggaattgaagtggaggcccaagaattatgtgttccattgctgctattttccttcaaattgttcatacatttagtagtaagttccttttgttatgggaataaaactgtagaaatccatttacacgaggaactgacctttttcttgttaacatgcaaagctatcaatatattgaaagcgagaaaatcagtacattacaaattaaccccaagagaatgcagatacacaggcttacaccatgacatttagctatgaaacaataattgaatcagggatgttcacagcatttagctagagtcaaatacacgtctgtttgcagttaaacttgagtgcctctcaaaaacagtcagcactgcacaaaggcaaacatgataacacaataggaatacacggcaaacctagtaaccaacctctggcaaccgaacagagggaggggcacaagaatcattggttgcactggacgagctcgtatttccataactgttcggcctttccagctccttcagtgtcccattagatgactgtgaaaatctgcagagagaaattggtggtgcaaagtacattgccactggcatctttggtggaaggtctggtaatggtgcttcaaacttcagtacgcttatgacctggcgaattgaaggccggatattataatctgggtgtgcacaccaaagtccaacaaccatcaaggaaataacttcccgctcttcaaattcaccatcaagccttccatcaattgcattaagtatctcatttcttccataaagatcccaaacccattgaaccaaactgatcctgtcattatcttcctttggcacaacgggcctccttccacaagctatctccagagcaagaatgccaaagctgtagacatcagtctctttgcttgctttcccagtagtgacacactctggagccatgtaacccatggtcccagctatcactgtagtttgtgagcctcggtcatggtctacaagccgtgcgagcccaaagtccccaagcttagcgttgaatccagaatcaagcatcacattgcttggcttgacatcacgatgcacgacacattgttcccactcctcgtggagatacaggagggcggatgcaacacctatggttatcttgaaccgcaatggccatgctaacaggtttccaccatcatagaggtgtttgtccaagctcctgtttggcataaactcgtagactaacaagaactctccatgctcatgacaccagcccacaagttgcacaagattccgatgccttagtctgctgatgatcttgacctcagagatgtactccttcctcccctgtgttgacccttttgcaactcgttttatggcaatttcaatgttttgatccttcaagaaaccctggtatactgcaccgaaacccccttctccaagctttctctctgcagcaaaattatccgtcgccactacgagttcattgtattggaatctccttggccccttgcctttctcaaactcactgtcaatggactcatcacagtctagtttctctttttccttctctcttgaccttgtagtccttctaatccttctaaaacataaaaagaagcaaaccaagccaattgagcagaccacaacactaccgctcgtagacaagcttatgaccaatataccttttgttttctcagtcttcatcaggtgcacatctgtagaatcaaattcccagtaaagaatctggtgcagctctacaaatttacctgtggaagcagagaatccgatggacactttgtcagggagatatttgctgagatcaaccgaataagataggctggagttgccactgaattgtgggttgtcctggtacgacaagaagacactcaagttccttgaatttgcctggtaagttacccaagcattggctatccggccatcgttgatactacttcgccatgtcacgttggctacagatacaattgagtggatgttgatgcctacatggttgccatctggatcccaagtgtttttgtggctgtcaaactcaacagccacaatctggttgagtggatcgctctgatcattactattgctgaagaggccaagataaccatccatggagttattggggaccacagaagggtatgatgagaggaagaaggctaggccctcaccgtacgaactgtcgttcgtgggtgcatatatcttgaacgtgaagcgggttgtgaag

SEQ ID NO: 54125 - DNA, 1611 bp, Oryza sativa
  unsure (1)..(1611): unsure at all n locations
gcacattctcttggttttgtctttcttctcacaaagataccggaagcaccccaaggcgacgtgctcgggcggaatgtatccctctgtactgtttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaanaacctctggatactctctgactatgggaatatcctccaacttcttagtggttttctccactgctacctcttgttcttcaccagcagcctggtttaaactaatccctggcttccgcggcactggagacttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactatccaaatagaatcatgccccgatgacgtcctgggcaaaccggtgatgaaatccattccgatttcttcccactttcattctggaatctgaagtggctgtagcaaacctgctggcctttggtgttctgcctttactcgttaacagacgtcacagagtgctacgaactcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttctcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcacagcatagttcctctacccatgcgacgttgcagtaactcttcctgctcaaggcatctgctaccacattagccttgccgggatgatagtgtatccccatatcataatctttaattagctccaaccatcttcgctgtcggagattcagatcaggttgggtgaagatgtactttagacttttgtgatctgtatatacctcacaacggttactgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaacttctattgcattcagcagaccagataaacttttcttccttcttcaatagctgtgtcattggcttagcaattttagagaagt

SEQ ID NO: 54126 - DNA, 1359 bp, Oryza sativa
tgcacggctggcatatatacaccccgttgttgggtgtctacgtcttcaccgaccggcttgcctttgccgccgccgactggtgtttctgcctgcacggctggcctatatgccaccgttgttgggcgtatatgtattcacagaccggctcgcctcgaccgccgccgactggtgtttccccctgcacggctggcctttatgccgccgttgttgggtgtctacgtcttcaccgaccggcttgcctttgccgccgccgactggtgtttctgcctgcacggctggcctttatgccgccgttgttgggcgtctacgtcttcaccgaccggcttgccttcgccgccgccgactggtgtttccgcctgcacggctggcctattatgccgccgttgttgggtgtctacgtcttcaccgaccggcttgcctttgccgccgccgactggtgtttctgcctgcacggctggcctttatgccgccgttgttgggcgtctacgtcttcaccgaccggctgcctcgtccgccgccgactggtgtatccgcctgcacgactgacttattatgctgccgttgttgggcgtctacgtcttcaccgaccggtcgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgccctcacctctacgtctggtttatacagctaccactactgatggacatcatcgtcttccgttgccgactggttatgccgccgccgactagtgcttttatcttcacaactgcgcgtcttcgctaccagtttgcttctgttgccgccgactcatgttcacttcatcacggcgatgcaactttgtcatcatagtggagcgacttcatctttattatcttcggcactggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagct

SEQ ID NO: 54127 - DNA, 856 bp, Oryza sativa
  unsure (1)..(856): unsure at all n locations
nnnnnnnnnnnnnnnnnnnnnnnnnnnnnnnnnnnnnnnnnnnnnnnnnnnnnnnnnnnnnnnacttctgtaccaaacaattggcgttcccctgtctgatcccagaagagcggagtacgacattttcgtccatacagtgcttcaaatggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactatccaaatagaatcatgccccgatgacgtcctgggcaaaccggtgatgaaatccattccgatttcttcccactttcattctggaatctgaagtggctgtagcaaacctgctggcctttggtgttctgcctttactcgttaacagacgtcacagagtgctacgaactcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttctcccatccagattgttc

SEQ ID NO: 54128 - DNA, 1500 bp, Oryza sativa
aacacatccgtagtgtatagagaacacagtaccccgttacaggatcgggatctgtcctgcagttcgtactctgtagagattagagaacctactagcatcacatgagcagagcactggctacacacaccaaatttgttctgcacgccaagaaatctattgccgggcagtgaatgagactttcgccgcaccgcacgcaccgctcgtgtagtcgtgtgtgacagtgtgagcacgggtatcacaccagccggctatgccggctatacgcagtgctgtatagtggacgtcactgcgtcaaccatattcgaggcatttagcggagggcgacgtcgagacaggtggatgacccaacatgaccaacactccagcgccttctacgccgcacaagactttggagttgaatggcgctaattgctgcgaagtggagctcgggacctcttccagtttctagacaggtcacaagtactcatgatatagcggtggaatactcccgtgtacagttacttgtgtggcttccactcgcaggggatcgagcaagaactccgtgaagagttactgttagccagccgggtgcccgggcagcgggcaggcaccatgtggacgctacagtacgtaacatggttacagcgaccgggtttttactgaagcttttcttttcccttcttctctgtgactgattcgtctgataaaaggctactacttactagattttgtctcaacaacgaacttgcacttgcagtcttgcacatggcaagattcatgttcaagcaacaaaactacaaacgtgtgtcgttcgcaccaatgtttctgaggagataaaacgccggaatgcagcaggaggagcggagaacgcgtgagcgagagggataaactcgccacgaaacgtacgtaccgacggtgtcgccgagatggaacttcttggaggcggcccaggctgtgtagttggggctgcccatgatggtccacccggtcttgtcgcccacctcgtacacggccgccgccgccgtcgccgtccccgcccacatcaccaccaacgccgccgccgccgccaccgccacggccatggccgacgacaccctgctcgccgccgcaccaccacccatgaccgagagcgagaggagtagagagcgaagtgcaggttaggacagtggcgagagtggcacaaaccggccggttaaataaaagctccgcaacttttcgatcccctcgtggggtcgtggtcgtgtctcctcccgaaaatgcccccgcgccgcggccaagctttcctttcggcgtgtgtcatcgccacggtgtgtcagtcaccgcgcgagcgactcgtgggtaaatttctctcgccttttatcatcgcggcgccgactgcgtgtggtgtggcggtgtgggggcgtcggctgtttgttgccgcttgcaagcgttgaatcggttgtgcgaatgccgagattgccctcgggcctcggttgtgaacttgtgatgttggcgcagtatggcctgtagctgaggcgtgat

SEQ ID NO: 54129 - DNA, 1035 bp, Oryza sativa
aaacgttgaacatgaatagtgcaaaactgcacttattttgggacagagggagtactactttggtttgtcggattggatttaggccctctttgtttagggttataagccaacttataagtcgaaaagtctaaacctaaacaaacaagcagcttttccgtttggcttttttaaagccataagccactctaacactattaagccaaaagttaggttagagaagtttttttggtttatgtgaggtagatatatgactcaactactaaacttaggacattaaatccaccggcttataaatcatataagccaataagctgacttaaaagtctaggccaataagcctaagcctaaataaagagggccttaatgctcgagatatactaatactactccctttgtttcattttaattgacgctttggacaatgacacgctctacaagatatatctttaaccttatttttctattataatatatacaataaataaatgtatgtttacttttattatagtgttttgaaagacaaaattatatatgtttttctagtttctttatttttaaagttattggtggtcaaaattataaaagtttaacctcaaccttatccaaaacgtcaattaatatagaactagagtgagtactgtcactagagctatattttttttccttttctttattcgagagtttacttttttttttttttgaccagcgtccaaaccaactcactcgagtctaacgagtacgagagacctgatctgtgcggtcgtgaatccgtttgaaaccgagtctgatgcttgtcggtgctaaaacattcggcccaacttacttgggctaacttgaaacggcccattattgatcagttgggcccaagcccacgtgagtccccgacagcataaacccctcttctcgtccctctcctcccaacctcgcttccttatccacaccaatccgccactcccctccgcggcaacccccccgcgctccgccacagaagccgacgccgacgccgcgcgcgtacatgccgccgctccacgccgt

SEQ ID NO: 54130 - DNA, 3821 bp, Oryza sativa
  unsure (1)..(3821): unsure at all n locations
tttcatggccagattaagtttaacgatatcagcaagacgaaatgcttcaaacttggtgggggtttacagtgtgttccccccaaagctgctggggtttatattttcacttagtaaatactactaaacatcagaaaataattgccactcgttagcccctaatgattttgacgcattctttaaaagactcgttctaatggggattgtctagcattcttgttggctgcccagaatccagacaactttggtggtgggtgttaagggcaattgggcaccctgagtgtctgccggtgaatgaaccatcattctaccaatggctctgcagcagtcgaataagaattcgagagcatcttcggcggggctttgacacggtagtcacgctcgtggcatggacaatttggaaagaaagaaatggccggatattcaatcagcaacaaaggacctgggtggacatcgtgaagggaatggcggcagaggccacgctatggcgtcaagcaaaccaagccatcccagctctgatctttaggagggaattttgtagccaaaacagaccgcgagacgtacacctttgatttcctgcttgtatcctgtctcagtcccatgctgctttgtatttgactgtaaataacttttattcctcttaatacaaaaatgcgctcctcgcgtattcctatatgcatggtctcaccagaggatgttgtgcttgacaggttgtgttccagaacgcccaaacattttaagctcctccacaaacttcatgagtctccgtgctggaccaatgcgcttctatagcaggcctcttattcttcaaaactcggacaagaggcaagctactttggatttaaatatttatcccactgatcgaccctccacattaagctttaataacttgtgattatcatgttatcagagcagtattgaggcatgccactattgaagaaattgaggcagaaaaatctgtcattgaagaccaagctgtaagtgcaatgcatcttctcactgaatgggtattttgccttccttttttgtgccttgggggctcactagctgcagatatgcatcttcagagagaaaggatggaaaaggcaattgaaacagtccaaaataacttcaatactgtgaggacagggcgggcaaacccagctatgcttgacaggattgaggtgtgaggacttagccttgttcctttttctgtttgtaagtaactcttgcatgatcacatcttttatcattacactcaatgcatactttatcattccatacacatgctactgttgtgtgcttttcttaactgaacctatgtctgggctggtatttattgtggctggctaataacaaacacaaacaaggaatgaaactattgctcaaataccatatgcagactgtttggataatttgatcgccttctgtaactaaaactagagcaaaggattttctttaggacagaaaattgtgaaaattgaacatcctattatgccttatgtgtgagaattttgttacaggttgagtattatggaactccagtgaacttgaagagcatcgcacagataaacactccagatgcaacttctctccttattcagccatatgacaaatcctcgtaagctgtttattattcccacttcagtgttggtattgagttttccatcaatagtgttgacacaatgacactcatgcggtgcagcctcaagctcattgagaaaacaatagttgctgcaaatctgggggttacaccaagcaatgatggagaagtgattcgagtcactgttccaccattgacttctgaccgcagaaaggtaatgctttagaatttcatctgtgtgaattatgtgtggttacttggtaattctgggtccataattccatatggaaaattttgtttggcaagtttgtacgttgcgttttcttgccatccaaaacattaaggattagctgagcagagctgtattgttcctgagaacaaaaaataaatgccttatgttcattgaagttacagtattttgaacttcaaaactttgcattcaaacccacatagacacctaatttgtgtttacaagtatgttaacataaacaaggccgatgttctatacaaaataaggtctctaaaatgtatgagatcaccaggtatcacctttactgatgtgggagtatttgtcttgcctcaaacaagaaaagtagaaattgctttggacatgccatgcacaaaagactagggtatttcataaaagacctttatgatggattatccagtaagctgtgatattattgaattgtatttgatgaattgatgtacaactttcttctatcttccataaacacaattgttatttagtatacaaccgtagcgatcaatctacaccattaaatctaaacctaccatgatcgacagcataaatttttctattttccccgaaaaatgtgtttatttctaggacttgagagcccccttttgccttctcttagtactaatataatacatgtagttggttgaattgcggtctgctatagctttcaaacaggttcaataatattcatagatgttttccattgattataaaattcctgccactttcttatccatcttagattcaatctgttttggcaggaattggcaaaaactgttgctaaattagctgaagaaggcaaggtactcttaagcttcacctttcactgttttttactgaaacattctttttacatttttattgtgatttaatgtttttatgcctcaattttccagcctattatttttcttgtgcacccatactagtatgattagtacagcactttagcggtctgattgactctgctaacctgcatttggcatggtgctggtactgcttgtatggagtaatgtagtgcgaacaatagtcgatgtaccgtagcatctggccagggaagacatgaggaagacttcgtcttcttcagcaggaatatctatttccctaattgattaaattaccttcctagtttaaggatttgctatcttgcatctgccagttcagaaagccctcttttttgtaataatggcattgtgatcgttttcattaagcaatatataatctataaacagctagttccatatatttcccctgtactaatctaacagcctcatttcttccttggcgagtaaagtgccctgccagcgccagcagcaagatgatggcgggtggcctgccctcattagctattactgtgcacataacagccatattagtttagtaatactgaatgaatgtatatctgaattttttttatgatgcatcagttgaccagatacttagcacttcttcaagtccatttctgctgcatcttctatgtgtattagttaggaaggtggagcatagtatgagctgtagtggaagaggctttcacaaaaattgtttgccatgcaccctttgctcttggtgctgcacaaatttcaggagtaccatatgattgttgctttgttggttatttatccaatttcttcaaaaggctgaagcacattgatagttttcagaagatgcttttactttatagaaaatatgcttgcttcttttttgacgcctatgtgctgccttctcattgttgagtagcttatacacacaaattttcactgactgataacatattcatctccttgtggattctatgtaatatcgattattaatatgactaacttcttttacaggttgctataaggaacataagaagagatgccatcaaagcttacgatannnnnnnnnnnnnnnnnnnnctcagttaataatactattttgtgggtgctattgtacctcgcttttttgcagtgaaattaactgctttcacatgcttacatagga

SEQ ID NO: 54131 - DNA, 3024 bp, Oryza sativa
  unsure (1)..(3024): unsure at all n locations
nnnnnnnnnnnnnnnnnnnnnnnnnnnnnnnnnnnnnnnnnnnnnnnnnnnnnnntataaggaacataagaagagatgccatcaaagcttacgatannnnnnnnnnnnnnnnnnnnctcagttaataatactattttgtgggtgctattgtacctcgcttttttgcagtgaaattaactgctttcacatgcttacataggaaaagaaactttctgaagataacgtgaaggatttgtccgctgatctacaagtaaggattccttgcctttccttcacgtggtttagtgaggttcccatgtcctttcggaatctcatctattagatacaggtatgcaacatgaactgacatcgtgtacaaattatgcagaaagttactgacgagtacatgaaaaagatcgaagctatccaaaagcagaaggaacaggtaatttggccctttcattggtctttcttcagacaagatattccttcatgttggacacaattgcatgccccaaggataaatggcttgtctgaaactagtatcagcattgctatcctgtaatcctttaatcctccagaaccataggaattgactcgggcttgtttgatattttcattttcaggaactcatgaaaatttagacaccaggttttaatcttgaaattggtgagttcatcttcctgcgaagtagatgaagccgaagaaaacaatgtcctcagctaacacggtgaattatgcggtcacagatttcttgagccttttccatctttctgatggccggcattttgccggatgcatctttttgggctggagtgcaatttcagacaatgttgccgtgtccttcattttcatttttgtaattattgtgtgtactccgtgtaaaagtaggtcttgaccttatccttgttctaccgctacattgtcaatattcctcacgtgaattaaaatgctacagttgtgaatttatcgccacgcactctgaagcatcaactactggtgccatattgccagttatctccatgttcagtggatctcagttttgtcagcagtcaccgacatctggaccttcgcacattactctatgtcatcgcacggactgacggacaatagcaaaaaggccatttttctttcttaaacacgcatgccttcatttacacgcgcgtactgtacactcataaattcattcctatcagcacacagtatatttctctaagcacatactagtatgaaaactgaaccgatatgttgagttgatgaagttattactataaacgtttcacatcatctactattgagaaaaataattagaaaaatcgtgaagttttgaactcaaggttttctcaatggatacctttgaaaattgtttcaacctctaaccaaaacagccaagaaatatatcactaaaaattaatacccatccacataaatatgaagggcgccccaattagaatcaaaggaaatagagaaatttctcgtaataagatcagttataaataagagcacatgtgttaaggtctagaacttgaagctggaggggtagaatcattcgtaagaaacttttttttaagtaaagtgcatggttagcacctaaacttgttcatctgtgttacttttaactagagtagttacctaaactcccaaaatgtatttttacatcaccaaacttgttaagtgtgtcattctggtccaaaataaccacaacaccttcgggatcttacatagcgctgacgtcgcatgccacatgacatttattattattattattattattattcctttttctctcttcttccttcctgtttgtatggcaaaagaaaggagaaggtagaggagaaggaaaaaaataaaaaaaatgtggttgaaatatccaggtaatatgccacgttagcgccatcgtcaccacatagtatcctagaggtgtcgtggcaatttggaattggattgacattctttaacaaatcacaaacctaaaatcacaaacctaaaaatatattgagagttaaaaaacttatataacgcatgaaataaatttaggaactggtcgtacacttttttattattatttctgaaaaacctcggtgagtgagattagatcagttttttttagtttattcgaagattatagatgagttaatgcgcctgtaaacctcagatgtggttggaaaggatgttttgttttgacacgaccaggaaccaaccggctatacccggtcaaggcctcccataggccaatagtccgatccactacacagcgtgtgtcactgcagcaccggtgtcgagtcgacacgtttcacgccgacaacgaccagcctgcgataattacggacaccgatgccgctcctgcagtacgctgggggcccctctgaccccgctggataccctgctagagtgggcaggtcactgggcccacggcccaccaccaggtgggcctgggagcagagcaagtgggccccagcaggttacagtactccacggagtgattgtaactgtacccagcactagatggattaggggatgatggtgtgaggttagcaactgttctgttcttggtcactactgtagtactaatccatcagttattacagtatcatgagaacaatgcatgatgtctctgtccaaattgtctttttcttttaaacgagagggccgcattactgtttatccaggatctaaaatatcaaagcaacaatgaaatcgagcagattacatgaactttcatcctttttaaaaaaaaatgatcctttttagaaattcctttttatagataggttctcaacgtcagttttattggctctaacctctctagtacatctcaactgttagggtgtgagcgttagcatcattagcgccgagaagttaggcctcgagcccattcttgaaattagctttttcatcagcaatccaattagacaaaaaaaaagatcatcgggacaaggagcaaaacatttgcggattgcggcatgcaaaccaagcaatctaacaacccagcagtaacgaaactcgtgcaagaaaaaacccaaagccaaaggcaagacttggggg

SEQ ID NO: 54132 - DNA, 10332 bp, Oryza sativa
tgttcttttgtgactgatgtcgatgtggtaagacactcttatatcccacacgaaataaaatatactacctctatattatatttcaatgtatgacgccgttgatttttttattcagcgtttgaccattcgtcttactcaaaaaatttatgtaattgttatttattttattgtgacttgatttatcatcaaatactctttaagtatgatataaatatttttatatctgcttaaaaattttaaataaaatgaatggtcaaacgttagttaaaaagtcaacggcgtcatccattaaaatacggagagagtatatctagattctaaatccacgttgcattcagagtttgtaagtttgattaaactggtttcaaacaatacacatgttaatatgttatgaatcgacagcttcagatggaccgcaaccgtcttcatccaaagagaacgaaattgggtgctttccagagtgaggcatcgcacccgcatcgtgcatgcggtccatcgagagccgcacgtacgagagcttggttggtctctctctctcgcgcgcgcgaacggacggccaccgttgcaccggcgtccacgatgacgttctatttgaagccaccgaggcggcgagaggcaatcgcacgtgggggccggagcgcgacccgggtggggcccgcgcggcatccgacgtggcccccgcgccggcgctgctactactactacgacccagcaaaccttatcgccacagggccacgggccccacggccgcgtttccttctccaggatcaggccgacgtgtcggtacgcggacggtggggccccgtggcttggtggggtccgcccgtgtgttctctggttttagcagcatctctctgtgcgcccgtcagtgcggacggtgggccccacacgtaccggcctggatcttctgtgccgatctgcgtgtggactacaccttccgtctcataaaaaatcaacttctggagacgaagctgaactgtactacactgttggctaactaggtggggcccgcacggtgtccgtacgtgtaaaccaaaaacgaccacaaagcaatgcacatcaggcaggcgtgacgttgacgcggcaccaccggttgccgaggatgaatgggcccacgtggagcccacggcccacccacgcttggagaagcacagcagaatgtggaaaatgtgtgagcctataaatagtggcaggtttttggattggaagcaattgatcatctactcccccgcgacgcactcttcgtcttcgtcttctcgtcctctccggtggtgatcggggaactcatttgctcctcctccggcggccagcctccgctcgtcgccggctcgaagatcgccccgcttccgcggttaacatattgctgttttttttttcttttcgttgaattttctttcgttgcgccggcgtacgtgccgtgcctaggagcgatcgaagtgtttgctcttggattctctttgttttcagcggtttcgcaagtcgcaacacaggtgctctgcttttgcaatggttcttcacttctcccggttccatttggcccatttcatcagatctccctcacaaaatttcatcagaaacgttcttcacagagaacggggaaactaaaactaaaagtcatatcgcgaccgcgcggtctcttccttctcctaaaagtgccgcaccctctccccttcgtccacctcgccgtgcggcgccttgctcggcatccaggaaacaatagcacatgcttgattgctgaccatggctgtcgagatggcctgcgcttgacatcgtgcagcatggagtatcagcattgtgcgctgcctcaccgggtgcaagcgctagcgctacctcgtacaacatggagtagtagtgaatctatatttcttttccaccatcttatttattccaacgtaactctatgtttcaaacaaccatttcattagggtttgtgaaagtggaaaacaattatattaggatttgataaagtgaaaaacaattatattagaattttataaaatggaggtaattccaatcattttgtctttatattgttacgtgtgggaggagtgtgaaataaagttatttaaggacgaagataatactaatttatgttgacatgaagcctgaacttcccattataataggaaaataagaaacttgtttttggagtattacaactatttaagctaggtgggcagtgggtgtagagggaactgaaatttgtttacataaaacgagatatctcatttaacgaatgattaataaagtattaactattgcaaatttaaaatataaattaatataatttttaaaaacaattttaagatatttttattaaaaaacaccccattttgcagttttgaaaacttaggactggttgaaatgaacttcttgtgtcgaacgcattcatagaactagatagagtactcttttcgttacaaaataatcaaacatgttactagatactataatcaatctagctggagtagttctataaggccatgtacaatgcggctctccacgccgcgtccctagctcacgccgtccatccctgtccctttttcacgccgctcagtgccccagcagaagcgcacgtcccttagcaaagggacgcagctctacgagcgcctcggctaggggagcgatagaggaggcgagctgggtaggggagtagcccaacgacaccgctccgtcccctgtttttcctctttcaccctcgtcctttccacctccccttctcgccgttgaccaccgcgctcacgcgttgtcggccaccggcaacggcgtggctccggcggcggcgttggccctcctcatcgccctcgcggttgccgtcaacgggagagagagggagaacggcggcgacaagggagagggagagaggtgagcgtccgcggcaagagggagatggagacgagcggccgagacgatgctggtgacaacctgcgcgacctcctcccccggcgttgcggcctcctcctcgatgcggcgcggccggcgcgctccatcccaatttggccgcgagggggctagagccgcgcacgacggcgccggaaccaaggtcggcgacggcggcggggcaatgtcggcacgaggaagggaggatagtgacggccactgctttccgtccgctacctctgttggaaatatagtcattattcggcatattttaatccaagaaattgaaacaatgatcatggcataagcagtgtagggtgatcttaacataaccagtagcatactatgcgcatcatgaatgtcagaaacaggaacataccagtaatgcgataacatgctagaggcatcatgtagaacaggaacaagaacatagctcacacagtatagcgctaacaacagtagtaggaggagaagattataccccgagaatggccctccgctggatggtgaggcagaattgcctccgttgttgtagtcgttcacggcacctcctcctggcgcaccagctccggatccagctcctgtcggcgggggcgcaccacctccgccagcaactccagacatggcgatgagcagtcgtgcaggaggcactccccaaaaacctgatcacccgcctacccggtgcagatctcaggcgaaggtgtggtttcggaggcactgcttcttccaatctctcgtgcgcgcaagagatcagaagcggggaagggatgtcacgcccggaagtttcccctttttcttgctttaaaaaaattggttaaataaattgtccgaagaaattatcttaattaacctagagctaattccataattaataaatgcaattaataattggaattggcattgtgggatttttttcttgggttccacatgtcacaatatattaacaggatttttagtggaattttcagagccttggaaataatttttaccaattaaaaatcaccaaggtgcaattttaatcccaggaaaatcctttttcttttttttcttttccctccttttcctttgttgggccgtcggcccatccctctcccgctcggccttccccttgtgggccggcccgttctccttccccctctctccgggacgctgacaggtggggcccacctgtcaggtcgtccccttcctccagccacccgcctccgacggcaaccgccgccgaatccgccacgccgccgcctcctccgctcttcccgcgcccacgccgcgccgctcccgcgtcctccccacgtcgccgcctcttcccccgcatctcccggcccgcgcgcgcgctcgagagggcgggattcgatttcgaatcccacccctctctctctctctcctccccacgtcgccggccaaatcgggagggttcccggccacgtcctcccctcccttgcccataaaagcactctcccgagccccctctttcgttttccctcattcgccgcgctctcccgtgcctcctatcgcgctcgcgccgcttgttgctagcgccgccgcttgccgtcgccttcggccgcgcgtcactgccgctagggtcgccgccgcgccaacccaccaccgccgttagcttcgccgccgcgagagctacctcggccgccgcttcgttgccgcgaatcaccgccggagctccgatttccccgcgtcgccggtgtgctcgccattgtttccatctccggccggccattttggtcgtcgcggtcgctttctccatccctaacgcctctccatcttctcctagggtgtcgccgccgcccgtccgtgcctccgcatcaccggtcgtcgccgccgctttctttcttcgcgccggccgccgtgctcgaaggtgaggaatcccctctcctccttcctttcctctctctcccatgagcgccgccgccctccgcgcgtgcgccgtcgtcttcgaccgccgccccatggctggccggccggcttgagccatgccgagcatgccgccgccacctccctcccttgtgccgctgccaatggggcccacgtgccggcgcccccttcctctctcttgaaccgctgacatgcgggccccacctgtcggcgccgcccccccccttggatgacgtcagccctgggctttattgcgcaataaagtgattaaggacttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgtttgcttgtgtgctctgtttgtcgcgtaggtttcggccgtttcgtcgttccgcggtttctcgaagacgttgctgaggtctcatcagtgcgagagcaaggcaagtcattcaatacgtttgatcatattgtacccaatttacaaatatcccgcatttctattaaatgttgcatccttttacaatgtaatgtgggatgggtcctattactcagccatttattgtttaccatatgccattgataacttgggtatcaaaatgactagatgttggcctaggaaatgcttagccatgcttagttcaactagcacacaaatggggatcacattattacatagactttgactatgagcatagctttagattggtgccaccgcatgggtgtcagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggcgtagttcaggtggttggttgggcctgttgcaacgtggtgtagcgttggacagtgattggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctctttttcccccacaccagagctgaagatcttccttgttggagctgttttgccaaagtttgtttcgtcgctgccgtcaaggtttgcctgtggagtggagtcgctcgctgctgaagtcaagcttcccggtttagctcgcttttatctttcccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaacacctaacagccttctgaaccccttttcatatgcatatgccctttttcacttggatttgttttgggaaaatttggagttttgcctctttggtttgcgggaaaaatcttggtcatttattcggatcggatttttttttaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcatgctcggttatttatttgagtcttcttttgctttgtttaacttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcagatggagataaggaatggttcacgcgactcgaacaacgccagtggcagcgaagagcagatcaatggaccacgtgccagcaatgcacctaatagcagtccgtccccaccgcccgagaacccaacgatcgctcaggtgttggacaatcagactcagatgatggcaataatgatgcaacagatgcaacaacagtaccatcaggtgttgcaacaggtgcagcggcaagcacagcagcagcagcagaacctgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtactgatgccgagaggcaggagaagtttttgtctggtcttgatgatgaattgactaaccagttgatctctagagattatgaggactttgagaagctggtggataaggctatccgtcaggaggagcacggtaacaaaataaaccgtaagaggaaggcagctcagttcaggactccccaggggaagagtcagaagcctcgtttcacgatgggacgtcacggtggaccttccaccatgattatccgacagcaccgtccctaccacccgggtagcttcaacaagaaccaccatagtggcagtcacaacaacagtgagcagcacagtctcaaccctactccgagttcactaaagattccagctcaatcagttcagccagctctgccagaacagcccaagaggttgggagaaaaacccgaactctgcttcaattgtaacaaacccggacacacggttggaaagtgctcgaagccaagacgtgctggacccaagtccgttcaggcccgtgtcaatcatgcatctgcagaggaggcgcagtcagcaccagaggttatattgggcacattccccgtcaactcgacaccggcagtagtattgtttgattctggtgcaacccattccttcatttccaagcgttttgctggtgcacatgggttatctttagtgaagcttaagataccaatgcgagtgcatactcctggaggtggcatgaccacaactcactactgcccatctgtgacagttgaaattcaagggtcgatttttccagccaacctcattcttctcgaatccaaggacctagacgtcatacttggaatggattggttgacaaggcacagaggagtgattgattgcgccagccgcaccatcaagttgaccaatgcaaaaggagaggtggtaactttccagtctccagtgccgcggaagccagggattagtttaaaccaggctgctggtgaagaacaagaggtagcagtggagaaaaccactaagaagttggaggatattcccatagtcagagagtatccagaggtttttccggatgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggagaagaaagacaaaaccaagagaatgtgcgttgactaccgcgcactcaatgaggtcaccatcaagaacaagtatcctttgccaaggattgatgatctgtttgatcagttgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggtttttatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcaattaccaagtggaccccaccaaggacagtcactcaggttcggagtttcttaggacttgcgggctattaccgccggttcattgagaacttctctaaaattgctaagccaatgacacagctattgaagaaggaagaaaagtttatctggtctgctgaatgcaatagaagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcacgatctggaattggccgcagtcgttcatgctttaaagatttggcggcactatctcatcagtaaccgttgtgaggtatatacagatcacaaaagtctaaagtacatcttcacccaacctgatctgaatctccgacagcgaagatgg

SEQ ID NO: 54133 - DNA, 2750 bp, Oryza sativa
gaaactaacaccggggaagcagctaagaaatcggatcagactcgcggcctccttttctatcacgagaaagaacgtggacgcgctgttgcggagggaatcgtgggaacgtgggttagtggctgcaaaaggatagcgacgtgacgtgatgtgacgcacgcacgccgccagccagccacgcctcgcccacgcccacggtccggcccggcccggcgcgcgcgcgcgcgcgcgtgtggcattccgacccccacctcaactggtcaacagggagcctctaataactccctatttaggttgagatatttctcgcttaaatcctgaggtggtattattatccttaacatttattatgggcctttgagatttaatagaataaattgggcctaccccaattattctaacaatccccaccaaatttcaaggctcataagaaatgttctcaatgttgtgcctgtttgatataccagggttttggtggagactgttaagttgaacttccacctaggaaatgagctacaccagaccacaacttaacaatggactatgccttgaattgtaagttttgtgtgatcaggtttcactcagaaccttgactggtactgggctgccgttcgcatcccctctgtttggagcatataagttaagctccaggcctttcatgagtatctagagattgcccaaatctcatagactgtgactagcagtcgaactcatataggtgtgttccttctgagatgttctgcaggtcaacatctctgcttggaaaagccactcggatcacattaagacataagccatcctaccatgcaggaaagaagagaagcacatcatggaaatgagcccttttcaggggtctcttctctcagtcacacaatagtttgtttcaccatccaaattcacgggatctccgatcacaatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcccagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtgccctttagataacgcattactctttccagagcctgccaatgatcatctcccggatttgagacaaaccggctcagcttgcttacagcaaatgagatgtcaggcctcgttgcgctagccaagtatatcaatgagccaatgatttgagagtatctcagttgatcccttgctattcttcggtttttccttaatagcacgctgggatcataaggagtaggagctggcttgcagtcaccatatccaaagcgactcaaaaccttgtccacatagtgggattgcacaagtgtaatcccaccctcatctcctctttgtagtttgatgttaagaataacatcagcctctcccaaatccttcatttcaaaattcttagacagatagtctttgacctcctcaatcacattaaggctggtcccaaagatcagtatgtcatcgacatacaagcacaagatcaccccttctcccccaccatagcgatagtatacacatttgtcagcttcgttcacaacaaagcctgcagatgtaagcgtgatgtcaagcttctcatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtagtcaagcgagcaactggtgaatatgtgtcgaagaaatcctcgccttccttttgggtataacccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatttacaatggtgccctcctcaggattttcctcaggcgtttcatcattgtgttctatcggggcaaagtgctcatggggcatgacagtttctttactataaatgctaggtgtatatttcataagaaattcattctcaaagaatgtaacatctctggactcaaaaaatgtaccaacatgcatgtcaggtactcc

SEQ ID NO: 54134 - DNA, 1020 bp, Oryza sativa
ccataagcacccttgtgaacatatcagtaagaactattgattctgaagagctacggaacagtggccagtgaaaatacatcttaatgtaggctttgggtgtgaagaacatcgtatcaggcttataccacactatgaaaaacagtgttttccgcagcatacaaggaaaacttccctggataaaacaaaagatatcaataaaaagtttcccaaaataaaattatcaatacgttttaagaaaaaataccttctcctcaacattcttcaatgaaagatcacttggaatgaagatgttaggttttggtatgtgcaaatcttccatgggagctctatttacccagttctgtacaaattatgttaggaacgtgtccacctccaaacacatagattggaaaatatgataggaagagtaacatccaaattacatgtacacctgtatgatggaaggagggactgcttcaactgaatacgatgtaccataccatggctctgttaagttcgtctgcccttcaaacttttttgactcccagaatattctgaaagtaaatgtagaagacaatcgatactacgtaagtattaatgcctttaagtaaaagcacaatgaaataaaactaaacaaatacatacatcaagtgcgtgaaaggaaaaaaggagatggttgtgataggatcaacttcgtgaggagcctcttgctgttttttggaattataacagtaaaaaatgcaaatggactagtgatgaaatttcctccactttttcgtaggaaaaaacttgaaatttatgtaaagcgaaagttctctttgttgtgtcatccttctagaagagttatatagtgtcttacaataggttaagtcgaagaatctgaagcaacagctaagtgcaaagcctgaataattatttttcagacactacatgcggttattgaagagcaacaataatagcatgcattatactgttactggtggaatgaacaataactcacagtagctagttcccagttctgtttgataacaataaatgcat

SEQ ID NO: 54135 - DNA, 2664 bp, Oryza sativa
cccggatccggtccatcctcagatctgagacatgcgccccccgatcttcctccaaaatcccctcctctcctccccggattcctcccccaaacctcaccaccaaacaccacaagatccaaccaaaatcaaaatcactccgctaagattagagagaccctcttcctctcgctacaaatcccctctctctctctctaggctactcctactactctggctctcctctcctctcctctcctcctcagctatggtggtggcctcctcttcttctcgccgctgctctctcgtcttgtggcctcctcctccccctctctgccttggccttccgtctggctcgctttctaggcaacccgctcgcctcatcctcgttttgtcgcttgccacccccccccccccccttcatccccgcatcggacggcccggatacgcgcgcccggcgatcccgcatccgacggccacgggctcgcgttgcgccaccgtggcgggcaccgccgccctcggatcggggcagggagggggggcccacacgcggggggtccgagagcgacgctaccaccgaacccccgcgcaataaaatctctttttcttaccgtaaagcatgggccagaaaccgacacgtggcgggtgcccgcgggcgggaaaaatctaagcgtcgacccgcagtaggaggtgggtggtggatggggaaaaaggatccccatttagccccctaaaaaaaaatactaaaataattctggtatattttaataaaatcagcactaaaataatattatgccttattttatatgaatttaatattggctcgttgtccgcttttggtgggacccacttgtggggccatgtagatggtcctgatctggacagtggggagggcgggggggtttaccggggctgacgtggcacggcgtcgcaccggttgctgcgcttgtgttaaaagggcggaaagtctccaggcaagcattaacggtggggcccacgaaccggacgtagcctccctcacccctcttcgctttttctactcgtgggcgccgacgtggcagtgcgatgacgtcacgtgggcgcccactagccaccaaccttcacagcactactctcactcgcactatttctgaaatactaatgctatttattaatttattatgccgaatataaaattcgataaaaatactgttttaatttcgaaaattggtcaattttaggagtattctagtcagctccgccatcattcatcaatccagcaaggggatcgagaagaagccatcacttgcaactaaaatattcgatctactcactaaattaagcaaagaaacctgaatacggagtaccaatagagttaatctttgctgcggtattcggaatccgaatgggtacttctaccattttctactagtgacgtacttggttcgtgcaagctcttatttaaatgaaaagaatcacgtgcgtcgtcaccagtagttttggcttaacaccgagggttaattcttcatgcgtctacgtggacagatttaaccacaaatataataattagacatacttcctatatctcataaaatataaatttagaactagatgtaacaaattatagtacaataaatctaaatatatatatgtcaggattcataataataggatatgtcacattcagtactacattgatttttcatgcgatggaggaagtacgtactatattggttttgatggacggagtgagtacttcagaaattccccggtcttttggagaattgtgttttattatgtggatagtagaaaaaaaatctactagcaatagcattagcagttactccactaatgacgctagttaaccagccagattaggtgttaatcccgctcattaaccattttaacccccggctggtggtggacgcttcacgcggggcaacacgtggtctcggtccaccataggctgtcgtgcaccaccggagggggaaaaaggcggaggaggatgtggtggggcccacgcggcaggataagccatgatatttttttcaattttctttttctcttttttccccgcgcgggaggagagagacgtgaaggagagaaaaaaaaaggaaaagaaaaggcgagtggcgcacagacccgcgtgtacttttccctgttcgccagccagtgacacgtgggcccaacgtacggcggggcccggtcggcgatttattttcatttatttattatattaattatatgtttttccacgggggagacggggggtgggggtgtctggttcgttcgggagtgggaaaagcgtgtggtggagtggtaggggggggaccacatgcaactcacgtgagccccggatgttgacaaggaggcacgtggttgtaggcctcgcgacccctctcacatgggattgtctgcgctcagccgggggtaaaaaactgcacccatctttgattatttaccgtttatggtttttttaacaagcgtgtaaattatggcattttaagatttttattaaaatgttttaaattagtactatatggtagtacagtgaacactccgcatgtggtggggaatgagtgagcaggaaaaatggaatggccactgccaaattatggccattggattcatcacagttgactgctagaatggcaaatactgcctactactcctacatcaaggcatggatgaacatacattgaattttac

SEQ ID NO: 54136 - DNA, 5912 bp, Oryza sativa
cccattttttaattaaaatttaaatgaagaaattcgcaaatattcatttaaagagcatataaacttcaaatggccatatcttggccatttgaactcggaattggaccgttcaagtctctaatttttccttaagaagtcaagaacccatttttgtgctttgtttctgctgttatatggagttatttagagtaaaagccttttcttttccgttggtcgtgtagacgctgcagcttcggaagatccgctcttcgtggaagttgaagccgacgtttgggaaagcgagcaaggcaagacacatcatcttgatcatattgaatccccgtttataaaattatgttgatttaaattattgcattatcgctttatttaaattctcgcgttatcactgttttatttagccatgcctatttacctttgttatgaccttatgattattggtattgttattaatattaccttgttcaccctagaataaacaaaacctcaactagtggacactctactcatggcaccactagtttaattttaggtagatgcttcgcaatttaattaggtaacattaggtggtttttcaactctagactttgggaaatattcatatcacctggacactttggaattgttggtttattgtggaattggcttcacaccgctccttctattcaaaagtccccaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcctgggggttccggccgtaggtgggattgggtcggtactcttgtctatggctaggatgggttggaaactatgtcacgtctttcgtctgtataccgtggtggtatgtggcacgtggttgcacgtgagaaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttaggacgagctgggacccagggtcgggttgccagttcggtctgaatcatcataggccttgggttaaggcaggttcgtgtgggttcacggccttgattaataatattgtttagttctaggatcgcgtttacaaaatagccctgagcaactaaatgtctttaaatgctgtttactgcaaccctaacccctttatggtataattccttgtactcccttgcatttattctgcatttgtgggtgtgtcttgttgagtacggtggttgtactcagtcttgctcaatttttcccaagtccagaagaggagctccttgaagatgaaggctttggtgtctagctcgtgcctgccgtcaagcgcctgtggtcgtcgccctagtcttccgctgtttctcgtttgtctttgtgtgtgttgggccttcgctgcccatgtaataagttaactatttacgcttccgcttgttaaactctgaattgtatcaacttttggtgtaccttgcctcctgggacaaggattaatgcacgcacgtcaggaaagcccgttgggttatttccggtcgtgacaagttggtatcagagctacccttgaccctaggacgagccgtagatcccaagccttagcagtatttttcgaaataaaaatctcttgtatttgtgaaaatcctctagtctctctctgtcttgctgcttcatttatcgccaaaatctgatctttaaaatgttgtttttctttctgtttttgtttgtagatggccggcagcgtcacccgtcgtggtttggacatgactggcttcgtcttggagctgcgaggcatgtgcgtggtcttggggtatccacatggagtggactaccaggccaggccgcttccggatcaggagggtgacgacgcggagccccacgctggttgggaggtcactgcagtgatcctctctggctcccccgagcggacttcgctggcagtcaccgcgggtggagattccttccccgccgcttgccagaacgccgctctcctcgccatcggcactcttcaccagcgctacccggacgagttgcagcactcgccctaccgctaccaccctcgtcgcggaggagcccgcgactacgccaccttccgggatgctagctcggaggatgatgctaccgtcgtgcacctggcgcgcatggtggaggcgtacgacgcggctcgtatcgacttccatcagatggtacgccgcgggatggttgagaacaacatgaagatcctggagctgcgtcaggagaacctgcagctcaagaaggacctcgacgcggtggaggcgcagctgcatcagctcaagatcgcccagggagaggactgccgccccaagcgtcgccgcgtttgccgcagccagaagatcaccgcccgcaagagcacctccaggcccgagctggttcgtcagtccctggcgtggacctgctttgtcgagacccctcgtgccgagcccgcgcccgtggttccccaggagggggaagcctccggcgttggtagcacggagggtgcgctgttgctcaccttccgtcctggcccgtcgcagcggtagacgagcagttagtaggcttgcgcgtgtgtttttcctcgtttgtcttcttgagttgtgtggggcatagttatgccggtgtgtggcataactgtgtcggagcctgtcttattttatttgcctaagcaacttgaacattaatgaaccaatttaatagcagtaataaattcaagaattatagtagtcgtgggtggttagttttaatcgtcagctctctctctctgtttgctggttctgtgtggggttttcagatggtgacgaccaggagaaccgctgtcaccggtgatggcaatcaacctgaaggcagcaaccacaaccaccagggcaacccacctccacctcctcctccgcctccgccaccaccaccagacaccaacgccattctcacccaaatcctcgctcagcaagccaacatgatgactgctttcctccaccacctccaaaatccgccacaacagaatgctccaccaccacctccccaacactctaaactcgccgagttcctccgcatccgcccacccaccttctctagctccaacaaccccgtggatgcgttggattggttgcatgccgtggggaaaaagctagacacggtgcagtgtagcgatgaggagaaagtcatcttcgccgcccaccaactgcaggggcccgcatctctatggtgggaccacttccaggctacgcagccagagggacagcctattacttgggcccgcttcaccgccgctttccggagaacccatgtgcccgctggagtcgtggctcttaagaaaagggaattccgagagttgaagcaaggcaaccgctccgtgatggagtatttgcatgagttcaacagtctggcccgttatgccccggaggatgtgcgggaagatgaggagaagcaagagaagttcttggcaggaatggaccctgagctgtccgttcgtctagtctctggggactatccggattttcaacgactggtggacaagagcatccgcttggaagccaagcacaaggagctggagtcgcacaagcgccgcttggcgaatttccgcaatcaacagggtgctaaccaaagggtccgctacaccaatccctatccagggggatcctcctcgcagcagcagcagcagcaacaacctcgctccgcgcctcgacctcaattcgtggtgcgcgtcccacagccgcagcagcagcagaatcagcaagggactcgtgcgccccgtcctcctacgccaactgtgcagcctggtcaaggccgcagggacgctcaaggtcagcagcgtctgtgcttcaactgcttcgagcccgggcactttgcggataaatgcccaaagccaaggcgtcagcaaggccaagcgcctccccgctccaacaacggtggaaaggatgtcattcggggtcgtgtgaatcacgtgacggccgaggacgtgctgacaaccccagacgtcatcgttggtacgttcctcattcattccatccctgctaccattttgttcgactctggagcttcccactcgtttatatctgtgacattcgtggggagaaatcagttgggggtagaaaggcttaggaaccctctgctcatcaccacccctggaggggttatgacagcaaagtaatatagccctgccgttcctatagaaattcaggggattccttttccctcggatctgattctgctagacaccaagaacttggatgtgatccttgggatgaattggttgactcaattccaaggagtagtggattgcgcgagacgcacggtcactctgtaccgagggccggaacaaccggttgttttctttgcacccccaacctctgtcagaagttcagaactgcatcagataggactgtcagaaatccccatcgtcagggagttcggagatgtgtttccggaagaactacccggtatgccgcccaagcgagagattgagttccggatagatcttgctccaggaaccactcctctgcacaagcgaccctatcgtatggcagcaaatgaactggccgaagtaaaaaaacagttggaagagttgaaagaaaaggggtatatacgtccgagtacttccccatggggtgctcctgtgatttttgtggagaagaaagacaagacgaagaggatgtgcgtcgactacagagctctcaatgaagtcaccatcaaaaacaagtaccctcttccccggatcgatgatctgttcgatcagcttaaaggtgccactgtattctccaagattgatcttcgtttcggatatcaccaattacgtattcgtgaagaagatattccgaagaccgcattcaccacgcgatacgggctgtatgaattcacggtgatgtcattcggtttaaccaatgcacctgctttcttcatgaacttaatgaacaaagtgttcatggaatacttggataagtttgttgtggttttcattgatgacattctgatatactcacagtcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagttactcaagtccgcagtttcttaggtttggcaggatattaccggagattcatcgagaacttctccaaaatcgctcgacccatgacacagttgttgaagaaggaagagagatttgtgtggagcccgcaatgcgagaaggcgtttcaaactctcaaggaaaagctggtttcctcgccggtgttaatcttgccggatactcgcaaggatttcatggtttattgtgatgcttcgcgccaaggattggggtgcgtgctcatgcaggacggtcatgtggtagcctatgcctcacgtcagctacgacctcatgaaggcaactaccctacccatgacttggagttagccgcggtggttcatgctctaaaaatctggcggcactatctcattgggaatcgctgtgaaatatataccgaccataagagtttgaagtacatcttcacccagtcggatctgaatcttcgg

SEQ ID NO: 54137 - DNA, 1688 bp, Oryza sativa
gaaagtccttattccattcacccgggcagtacaaagatgtacttagatttgaaggagaaatactggtgggttagcatgaagcgggaaattgcagagttcgtggctctgtgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcctatcacccgcagacagatggacagaccgagcgtctaaaccagatcctagaagatatgcttcgcgcatgtgtactagatttcgggaagacctgggataagagtctcccctatgccgagttctcctacaataacagctatcaagccagcatacaaatggcaccttatgaagcgttgtacgggcgcaaatgccggacaccgcttttgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacctggaattcgcagtggatgactttgtgtaccttcgggtcacaccattgcgaggtgtacacaggtttcagacgaaagggaagctcgcacctcggtatgtgggtcctttccgtatcattgctcgacgcggagaagtcgcttaccagttggagctgcccgcctccttgggcaacgtgcatgatgtgtttcatgtgtctcaactcaagaaatgtcttcgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaactcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataagtgaaaagaaataaacaaagttaaaagggttttataaaaagaaaaaaatccctaaaagtcttttccccctccccttttcccttcttgggccggctcggcccagtccctccctctctctctctcttcccccgcggcccatcggcctcccccgcgcgcgcgcgccgctgacaggcgggcccgcccgccaccctcgctgacgggtg

SEQ ID NO: 54138 - DNA, 1160 bp, Oryza sativa
gcattctttgcaaaacgtccagtctacgttcaatttcctggcaatgactaaagacttgtaccacattttgggggttcttggatgcttcctgttatgccaatagatgccacttgtttggttttatatttatagtactttaaccagagtgcgattagagaaattcagtatctgtagagctaatctagtttaatttttttaatcatggttactgcccttttgcccctagagtaccagttgtcagttggtaacagtataataggcacacgtaactatagtatccagcttgtgacttgtgagtaaactcatatatttactgctgcgagtttgcggtggtgcaccagtgcttacagtggcagagtgagagtggttcaacactaatgatgcacgagtggcttaatccatatgggaccaatttgaagcttaataagtaaaatgccccaaatacaagtacttacttcctccgtcccaagatgtagctatttctagcacagtatcttgtcccaaaatgaagctatttttttcacctacctcctcctctcaactaatcacaaccattcttcttcacctactttctcttttcaaccaaccacacacttcctccaatcattctcacctactttcttaataccgtgccaacctaaaaaatacctacattttgggacggaggaagtatcatatagactgtacaatcattgggtaggccaagtttggccccaatgaagctctgtaccttcagtgcttcaagccttgaaccatgggttcctccaatgttatgctgctactggagatttgcaagcagaggtttagccttttaaattattaacaatactaattgggaaaaccaaatcgtctggctggcctctgatatagttaaagaatagggggcataattgttcataaattcatataaagaatatcatggtatttaagttttcttctctactttgaaatcatcaattgtgtgatatggatgtttcttttagcatggtggttcaaccaacgccttcacatgtcgtgaacgtacaaacttttattttgatgtgaacaatagttgcctggatgatgctttggataggtaccttctactgctttctttcttttcacctttgttcttattttgcagaatctgattcattttgcttctcgtctgttgttttagg

SEQ ID NO: 54139 - DNA, 1372 bp, Oryza sativa
taaaaggcaaaaaaaaagtggtgaaaaataaagctagatccgattcctttaaaaacagaagaataaattctgattcctataaaggcgaaaaaatctgaaaaaacatctaaaaaaattcgtccgatttcctaagaaagtggcgaaaaaatggttcgtaaaaaataaaaagctggttcgtacaaaataaaaaatacacgcgagaaaaaaatggaaagggcgaaacaaattccgatttctaatcagtatatatctcttctctatctataatctaatctaactatttaaaaagagaaaatgcacgagaaaaataaaaacggttcaaaataatgcgtgagaaaaaacgcaaaaaaatgctaaaaagggtttttccatcttccattaaaaaaacgtgcgagaaatactatttccatcatcggtaaattttttcaaaaaagcatgcaaggaaaaaaatgtaagaaaaatgcgccatttctaaaaatgatttgaaaaaccgcgcaaaaaaaacaccgtctattaaaaattaatcgctttagaaaaactgtcagaaaaaaacgcttaattgatggacgcttgagtcgataggatccatcgattttttgcatctattacacggcttttatttcggttttatattctcatgtattgggaaaaaaagcaaaaaaaagatctattaacaaaaaagcaaaaaaccgccgtgagataagaaaagccaacaaaagggagaaaaactattggtatgttgtcgtcaagtaaaaaaaatcaaagaaaacatgctatcaagaaactgttagaaagaaatgcgtcgtttataaaaaaaaagccgctcattcaaatacaatcattatcattgacatgaatatgcatgaagaacgtatatgatcattagaatttattcacccgttgcaacgaacgggcatttttgctagtagattaaaatataagtaatttggggtcctaattttttgggccctgttccagcttgaacacccttatcgacggcccggaataaaattaaagataaagagaacaacaatgttattaaacttacattgaacatcgcaagcacaaataggtgcaacaagcacactcagcacaagaatacggagtaccactcccttaaaaataaaaaaaatacagatattagcaccgacagtacaattcgagcataccatacccttgccttacttaaatttgaaactgcaattaatatatttaagtcgcatatatcactaacgaattttaccggccttctttgtactggtgagcttagcaaggtcctcagtgagccctttttcttgaggcacttgcttgtgaagtgcctcctgagatgagatgtaccggtagtcgattttgccgtatatactttggagca

SEQ ID NO: 54140 - DNA, 1938 bp, Oryza sativa
ctaaaagcaactatataaaattaatgcagagctgctgatatgttaaaaactagggaatttcttttgatcactttaaaaggcatatggaaatatgctggacactatttttaatgatcatatatttgaccaatgcttggtccaaatttaacgttctaaataagctctgatgagtttgagctacctaccttactcatgctaccttctttccctgcagaattgagctcaaacttcacactttggaggcttggaacattaccacctggccttatagcatttagaggtcatgttcatcctattgatccatcatggcatttttaggcttggggtatcaggaaaagacagatatccccagtgttcagaaagcagcagtcatacattacaatgggcaaagtaaaccatggctggatattggttttaagcatctccagccattttggacaagacatgtgaactactcgaatgagttcataagaaactgtcatataatggagccccagttattgatgggctagataaccattctataaatatggccgtaaattatgaaattaaattcattattttggagacaaatacaagatagtccagaaggatacccacgaaatgctctctgaccagtaacccgaagctggtacacgagccgatggagaatatttaatgaacacaaaggaaatattttcttcctatacactaggatctctttccctttatttattccatttgtatcatagctcatgaaattacagtattgtttaggatggttcttttgtatttattggagcaatataaattgcctgatttggcgggattgatggtaggcccatcgttattgtaattgttgggttccagttcaccacatgaacaacatgggccagattttgattttgcaaagcaagccctgtacatttgcttcctgttttctttatctttttgtggtcatctggtatgatactctggtgtcactggtgtcatcagaattggattattatacttactgtaaatttgtaactcctgtcatatttggtctttgactatctataaccttttcaagtttagtacatacatcagtgtgtattgatcattttattgtacattgtttacaagaaataagaacttaaatgaatttctttagacgaacttcagtggatattggttatggttagcaggtactcctaaaacaatactggttggactagtttgagttctaattatttcttaagagggagttctttttcttcttttaatctgcatgtaattctttatttttcataattcactcataccagcataaaacatcaaggacgacattttctttcacatgtacattatctatatagtatgcggaacatgagcatgatatcactacatcaaatgtgcttcattgtgacccaaccaaacatagaagggaatggaactgcaggcttgctacatactgatcagtaaacactggaatcaagttattctatatatagcccaattggggaaaaaactagaaacacagaaaaatctttacagtggatgtaaccctgagaacacctatatcatcacatcagaaaagaaaaacctcatgatatttctatctaaactcgaaatcatcgttcgcaaccttcagcctcgaaatctgggaagacgacgaacgcgatcgacagcggggcgacatataatggtgaattgactgagaccatcactggtggcagtgaaggatgtcaccatctcaagtgagctgaagaggagctccattgagcagcactgtctggcaaagggttgccatcctgtgagtcagatggtactcctccctcttatcaagcccatccgaggctttgctccaacccaaagagactgtctcttcaggccatggacaaagggggtgtccctctttatccctgccatttctctgaaattaatgttgaggtcatttctgactgagaccatgaatcc

SEQ ID NO: 54141 - DNA, 813 bp, Oryza sativa
  unsure (1)..(813): unsure at all n locations
cctaattttgatccttttgtgaatttcccaggacttgactaatcctttgctagctaaagctatccaaggtgaatattatacctattttctgcgaacaattttctactgtaactaaaaaaaatggacaacagtagggaatttccatactaaattgcaaataggattaaagttacaaagtcaaagactcaaagaattcttgtcaaagatttatctgttccttgcaactacatatgccagcaactgtgatcaatttcattctaccgtgtggaggtttacttgttacactgactaatataagatattagagggtaaatcccgttttaagaaacatattgacatttgtggttcattctgtacctttatttattaagcttggaatttgtttagagctactttccacaaaatgtatttgccttcttatggttttctacactttcccatgattcatggactttttttcccatttatttgtttttgtagcctttagccctctacgtatcagacttggaggttccttacaagatcaggtggtgtatggcacgccgaatttaggatctccatgcaccccatttcaaagagttcaagtggcctgtttggattttctcaaggatgcataaccatggaaagatgggatgctattaataagatctttatggatacagggtaagggcttccttctccagtagtttctgatgtgcattcttttttctgtagtgaattctgatatattataagataaattgttgaccacatcacaannnnnnnnnnnnnnnnnnnnnnnnnnnnnnnnnnnnnnnnnnnnnnnnnnnnnnn

SEQ ID NO: 54142 - DNA, 9094 bp, Oryza sativa
agcaggagggagagatggaaggaaggaaatgaaaagacactacttttgcagacctgataacctgtataaccattaacttggtcaatctccttgattgtctcagcaatacttggtgctattaaagggtagtatcatactgccggcctgtcaataggccctgaaaggacagatgtaagccacaggagaagcagctcaaatttggaacttaactaagctttccaaaaagctagatgaagcttggtttgtatcgtctttgccggccaagattatgaagtcaagtatgtctcgcccataatatgattatggtggttgccggcagaaaaggaggttatctcctctcagcaaatggaacatgtattttctaaggcagaattggactgagttcagacatgcacagaatctgccaaaaggaaagctcttatcgatcttatatgcttaacaaactgggtcatgatgtaatttttgtctttcatgcggcatacaacaatttcatgcagcacaggagagtttattaatacatatagcacaatgatttaccttgtccttagggatcagttcgatgacaacttgacaagcagtaaatatttcttgactgtaatctctattctggagttggcacaaatctattgagttatggcaaccaagatcagacggcagaagtgaagtatatggcactatgatatatcttgcttgtgcactgaaaaaagggttcaaacatggaaaattaacaaagcgaccacagcttatgtatttcgcatagtgtgtagtacacaaggatcagcatcataatctcagtaactagaagaaaatatacaccaactgttctttttactaggagaatatacatcgattgttctattcatgcagggctacttatatacacaaatgattaactcaaaacctgcaaggaatattcgtaaagtacattattgagtggatctgtcatactcaacatgagtttcaagtttgctgccatgaatcgatcgttcatttcgccgtgtcgctggtgtttgtgtcgtccgttggccacgctacagtttccattaacctctgacgcattatctccagattctcattcgaaatcttctcgtacatttttgcatggtcacatttctgcattgatgaagaggtaactaattaaataatttatgcatcaaagatgtctcaaattactctggaatatctcactcttttttattaccttgatccatttgctgtacaagtggagtcgtgtgatcatcactctctctgccaaatcttgcctctcctggtgcatacgaagtcaaattaattagagaatgaaccttggcacaatgctgaacatcatatatatttttcttcattgcttagtaacaagatgcaaaaagatacctttgcgagtgcgatgaggaaatgtttgccctcctttggatcgttaaccacgacgtagctgacaaatcgtaagtgttcgtattttagacgctaaggatgcagattggaactgacaccaacattaacctattctacttagatttcatttcaacatagcacaatatatcaatgtgagattttcttgcaatggggtgacttacttatacagccaagtataagcaggtggattcatttcatacaactggtggagcaccgtgcttgtggccttgtaagtgaagtaattcatgatttcctgcaaaatggagagaacaatcttcagagttccatgcaatctaaacccaattaaccttgcagttagagaaaattaaccattatattgctgtcgtttacagatagcgttccgattatcccctgccggttcaaaaaaaaagaaaatcgaaatcagtagtgtacacgcaccgtgtgcacgtcttcgaacccctcctcgtactgcccggcgaactcgtccacgatgacgaggccgcggcggccgggcctcctccccctccgccgcgccgcccgcgccaccgtgcgccgccgcctcaccccgacgacgacgccgcgggaccacggcaatggcgccgcgcggcacgcggaggaggatgaggacgaggagggaaggcagacgaccgcggcggccatccgcgcgacggcagccatcggcggcgccgcgaaggagagctagagatgtttttttccctcccgacggctcgacgccggctgcgacgatgcgagccgcggcggggttctggataggcagcagcggtggattttttttgctgaggctttggctgattctgtccgcgaaaacagcgcgtttcatgggcttcctgagggcaaacgggagaccccacgttcgcgccgatatttcgtccggcagctcgctgattggtggcggaatggcgacgagagatgattctatttgcctctctgtattttcgcgattcccttgattctttttttttttggcttcagaagtacatttctctttcagccttttccttttttttttgagaatattcacttttagctttttgtgagaatgtaatttgtggaatgcatgactgccaccctaaaatatcttttctgatagtgaacaccaaagtaagggcacttgcgtatgtttatcatagtgaaagaattcaagttctacatttgatattaatgtttataagtacattatttgatattaatgtttataagtacattatttgatattaatgtttataagtacattttactacaagacatcgcaaattcgtgattttagttatgggacaccacatgaaatcacttttggggtaagacactatgtaatcttggttatttgctaacgggcacggctcccatttatttagcgttttagtgttgactatgcaagagctgtccactttttgatgcgctgtgaccaaattgcccctgcccatcctcaaattgactcacctatcggctggcgccgctcttcgtcgtgcagttcatccatctcgcttcaatcctcgagcttcgcctccactcactcctcacctaagacactgtcactccgccgtcaccgcatcctccccaccagcctgctctcctccctcccgacaccataggcgccacccgcacccacgttggtcgaggcgcttacttcccctccaccaccggaaacctcagtattaggagcaggagaccagcctctaccatggtgttgctcgcacccacatcaagtcatggcgcttcctcccttcaactacggccgttgcggcggtagaaccagcatgacgagaagggcctccaccacggcgccacatgcacccacattggtcgcgacacttcctgctcctctactgccacaagacaagcgccgtcgcgagcctagcaggagcccaacccaccggcgtcgcccaagcccccttcggcagaggagttgggctagggtccacctacctcgtggaggtcatgtcggcgtggctcgtcagcttctacctaggagcctagcaagggagctgaggggagccggaccaagccgccacaaccgaagtggaagaagccaagaaggaaggccagggtggttgctgatggcgagcagaggtggcactgtggctggagtgtgagaaggactgacctagggatatttttgacgtttcatgttgtttatctctcctatttagccggaaattaatattttaatgactatggtgtccataagaaaaaaaaccacattttgagagtgccttcccctaaagatcgacttttgacgtgccctagagttaaaaaccacgaagttacagtgtcctacagcaaaatttgccatgtttatatgagcatctcatttgtactatgttttgaaaaaaatcttgttctaactgagactttagcttagaccctgtcacgtagaatgttttgatactaatttagagtattaaacatagcttacttacaaaactaattgcataaacgagagctaatatgtgagacaaattttttaagcataattaatctataattaaagaatttttacggtagcatcatataggataatcatggattaattaggctcaataaatttgtctcgcgaaatagtccagagttatgaaataggttttatcattagtctatgtttaatacttctaattagtatcaaacatccgatgtgccagggactaaaattttttaaccccatccaaactcccccttaagaagcccaaatccgaacacaacgctttgtagctgactagcttagacctgagggcctgtttgatatagctccaactcctaaatataagtccaggagtttagtctggagtagagttgtggagctgcctaaacccacctccacaactctagtatattttgtgagagagctccacccaactccattcctaattttggtggagctgaaactgtttggctgagctccagcttcagaagggatggagctggagctgaagctgtaccaaacgggcctgactctgagaggaaaggcctgactccacggtccacgcgcaccgcatggcgtacgcgcgaaatggttcacggactcgcggtcatgcacacccgcgaaaacctgcgctaagcaaaagcaccggaaaagcaacggcacgagcccgtgccccgtgaggcaatgaaccaaattggcggccgcgtcaaccacgccaccgggacgcgcgcgacggcaagaaaaagaagtcgcgaagtcgcggattctgcaggcccccacgagaccacggtttcctacggccgatctcgcggggacgcagccggagacgacgcggtcggtcgcgtcgcaccccacgccccggccggttagtggaccgattcccgcaccggcacaccgcgcgcgcaccgcgtcttcttctctatcgcgacaagtctggcttggtcatcgcgtgagtcgatcgcctcgttgctttccgtggccgcgtccgtcgccgcctcgcgcaccagcgaatccggacgtcgaccgctgcctgcggatgttgtggacagctcacagttggtgttcctctgaatgcacaggcgccgtggttcctctcacttggtgtgcaatttaccgtgaaatcccagtgagatataacctacgtcttcgtaacggtctcccgtcttaactccgagtctctgactaaccgtgaacctgatgatgcagttgctagcctcatcgcgtgcgacgaaatatcaaatgatgtcgtccgtgtttagatgacttcttttgtactcctgcactgtctgtcgatgtcatggcagtaggtgcctcctttcaccgactccacctgctccagaacaaagcaggtaccaactgttacaaggaaaaaaaaatctgtattttccaatactgtctatttttattatcttgctttgaatactaaccgggtatttattttggattatagaaaagaagtacacaccattatgcacacacttcaaatattcgtaagccagtagaaaacggaattgtgcaggtggcaagcattctcttttctaaaaaaaaaatcaatatcataaatcacattcatttttctaaaatatttaatttattattaaaattaaatcaagtagataataatacatggtaataattcaatgaataacccatgccaaatagagtcaacaacattgttcacgttttcgacaaaaacaaaatgaaagccaccaaattataaggtttcgacgttgaacacaagcagattctaagtaacttttcaaatgattttcaagaatttaaatttgaaataataaatttgattggaatttatcaaggttcatgaaaaccgtcataagatcgggatccaatgctcaattgaaaatgtgagaccctgccaacaacggctgtgtttagatccaaagtttgaattcaaacttcagtcttttttcatcatatcaacatgtcatacatgtataacttttcagtcgcatcatttttaattttttaaaaaaatttaactttacgctgaactaaagacagccaacgaatcaaagagggttatagccatcccggccgttttcggcccgggtcaaaacgttatgtatgctactcgatttcgtgcccccacacccttgacgagcgagccttgccctcttctcttcccttctctcctaccggcggcaactaccgggaagccgccgccgaccgccggagcggagtcgtcgcggcggcgagggcgaatcggtaacccccccccctccggagttccgggatggggacgccggagttccccaacctgggcaagcactgcagcgtcggcgactgcaaccagatcgacttcctgcccttcacctgcgaccgctgcgaccacgtacgtctttcccgtctcctcccctggccgttttcgtgtctcggtgcctcgttgccgaaatcggatttgctgctgcggtagtttttaaggaaatttgttcttctgtagattgtggaaccaaagaactgattcttcctggaatttttgcttgatatacggtttcttgaagtagatcttggaaagcacctagtttagggaaaatctcgtctgggctttagcctttaggacagtgatccatcacaatcgaggagatggagaagggaaattcatgccaatgcctaggcagcacgaatggagatctttttttgaccgtttggtggatgagagttgatgtgtctatcgttgaccgagaacatgatgaccctttcggtgatgctcttgcagttttgcgcccttttggataattagtttcatctactaattgaatgctatgtagccaatcacataattggtcagaattgttgcttcaataagaatgaaattgatctcagacaaaatctgaaactgggcttaagaatgcaatgggtatggtttcaaatttggaacggggaaaaggaggatttagttgacaaggagtccttcattgttagcttgttgcctatggttgaatgcacataatgataggaaaaaaagaactgaaaaacagtagtggaagtgtggtatttattcacaatgccattcatatctgtattttgtgccagaaacatgccctctagtcattgtactgtttctttgttgccctctagtttctttcgttgacatcacagcatgcagctccactggaatcatgacactctggaattacacaccatataggagtatgcgttattgcagtgttcaagcataactcatcctgagtagcactccaaggtcttgagttcaaatctccataggagcaaatttcagattgggttatttgagggctaagttccctgtttgataggctaagttcctaatttaaaaggctgcatatatccggttggatgtagaggccggataaaaaatacccttctctaaaaaaaaaagcataactcatagacattttgggttcaaaatttttccataatttattatttttgaatcctttccacttcatggcttcccgaatgtaaagtaacattgcatcaacatccaattggcagcactgacatggttatttgatcattgtttaggtcttttgccttcagcaccgaagttatacatcgcatcagtgtccaaatgcaaatcagaaggatgtgactgtcctcatctgcccactctgtgctaaaggagttcgcctgaacccgaacgaagatccaaacatcacctgggacacccatgtcaatagtgactgtgatccatcaaattaccagaaagtaacaaagaaaaagaaatgcccagtgcctgggtgcagagagacactgacattttcaaacacaattagatgcaaagattgcaccaaagaacactgcctgaagcatagatttggacctgatcacaagtgtccagggccaagaaaaccggaatctacattccccttcggaaatatgcttaggagaagtcagaaagcagaatcatgttcaaattcaaacagcagtagcactagttcatcctggtggagctctagtcttcttaccgcagcaacgagtttcaaatcatctgctgaagctgggatgcagaaattgagcacagcaactacccaagccatccagaaggctaaggatgggatctcgacaagcagcagtaacagcggtgatctcgtggagcaatgtgttcagtgcccagcaagattttccaccgtgggggccttaatcgagcattgcgaaaagtcccatcagagcaactcgcaatcaagtcgtagcagagtgacggtcgatgtctgcccgaaatgcagcaaggcatttcgagatccagtgttgcttgtggagcatgttgagagggaccatggaggaacgtcaagagcgtagatctgcttatgtttactgtacctgtgtaacctgtaatttgcttctcattggtcaatggtcatcacactcaataggatttggttggattgtgctctattattacggttgggttcaaaatgtgcccatgaaagaaggtatagtttgttggctgtttcaaggcaagccattgtgaattgaacctcattctagacaccaggaaatcaaatttctgattagttaaaacaatgcgtcgtttagatggctatgctgttgcaagttacaaatattgccttctaccagtttgttaatggtgaaatggaattcataacctcaccgtgcatgcacaggaatccactgtagttacattacctgtcaccattgacaacccttgcaacagggaacatcatcctttggtctgctgaataaaggcgaaggattattttcacatggtttgcatcccagatgctaattgaacactgagagaaacgtgagtttcccaatggttaaaaccacgtaagaaatttcgaatttgtccctaaattggacgtcttttagccgtctaaaatcctttttgttcaacggatttggtcgagatataagccgaaaaacaaatagtgaaacgcgttcctgaagcccatcaaagcaaacctgcctcgaacaccttggatcctgtgacccggcatcgttacgacgctctaggaattgcgaagacgaatggccatgatgttgtggtgacgaacggctgctgttgctgtaaaatcaaattgttttttattcttattctgcgatgaacaattggcatctgagattattgattttgacatttgaagattattggcgaagtggttttggaaataattgattttcagatgatgaacaaggtttgttgttttgtcgtgtccggtcagaccggccaggtgctctgtgtcgactctgtgtcgacttcgggttgtttgtttagaaatccgtggatgtttcgtgttt

SEQ ID NO: 54143 - DNA, 4996 bp, Oryza sativa
  unsure (1)..(4996): unsure at all n locations
nnnnnnnnnnnnnnnnnnnnnnnnnnnnnnnnnnnnnnnnnnnnnnnnnnnnnnnnnnnnnnaaaatatagtgccataaatatagctacacccttctttctattcgatcctacagttgtgagggtgacgcgcgccgatactggcggcaagctagcaaatcagaagtccggcgatggcatccaagcgggaaatcaatgtccaaaatccggcaacaaggacaatagaaaggtcttggttagtgtgcttgactaggttgccgttgatttgtgttttgacttttgaaaagactactgttactaggttattccccatagtgtgtgcagtcgcagcgaggaagattggccatttctttgcgtggctcagtcattagttagtggatctcaggaagaaaggggagtgttctgtacagggtgaaattacatcaactactgaaaaaaaaaatccacctctctgaatacgcccgccatcttccatctccttgatgtccccaaacatccgaagtggcgttcgcgctttctgattgaagatcatttcgttcctttcgttccacaccgctcaggttaccagcgtcaagttacatttgttttggacctctaattgtttcttgaattctcttctcctagtcagatatcgctgccgccattaatttgttcccccctttgggaaaaaaaaatattttgagcttgtgccaagttagtcatgggtgccaagaggagctcaatgatccccgcactcttgctcctcgcttccttgtccatcttcaagctaccttgcttctccagatcactctctttcagctacgatttctccaagcccaccactttcaatcgttccgacatcgcaatagatggatccgcgagtctcaatggtctcatcgagctcacgcagaacgctgacccgaaacgtgaaggcatatacgacacggtgggccgagggtcctacggccatccggtgccgctctgggacgaggccaccggcgaggtgacgagttttacgacgcgcttctcgttcgtcatcaagtttaactagtcagacaaggccaagtacgcacccagcgacgggcttgccttcttcctgtcaccctatccgtcaaagatgtctccactcgacggcggtggattgctcggcgtcttcaccaacagcactggcatgaatccgtccgccgccgccccgatcgtcgcggtggagttcgacacgttccaaaatgagtgggaccagagcagcgaccacatcggcatcgacgtcaactccatcaactcgaccgcggtgaagttgctgtctgaccgcagcctctccaacgtcaccgagccgatggttgcgtcggtgagctacaacaacagcacaaggatgctggccgtcatgctgcagatggccccccaagatggcggcaagaggtacgagctcaacagcacggttgacctcaagagcttgctccccgcgcaggtggccatcggattctcggcggcgagcgggtggtccgaggagcggcaccaagtactcacctggtctttcaattcgacattggtggcgtctgaagaacggagagaaaacgcaacgcgaggtaggccggccgctgcggtgcttgcaggtgtcgttgtagcatccgtcgtcgtcgtcggggcctcgatctgtttgtttgtaatgatcaggcggcgtaggatatctcgccggcggacgagagaagagtacgagatgggcggctccgacgacttcgacatgaacgatgagttcgagcaaggcaccggtccgaggcgatttctgtacagccaactggccaccgcgacgaacgacttctccgaggacgggaagctcggggagggtggcttcgggtcggtgtacaggggcgtcttgagcgaaccggccggcgtccacgtcgccgtcaagaggatctccaagacctccaagcaggggaggaaggagtacgcctccgaggtgagcatcatcagccgcctccggcaccggaacctggtgcagctcgtcggctggtgccacggccgcggcgacttcctcctcgtctacgagctggtgcccaacggtagcctcgacgcgcacctctacggcggcggcgcgacgctgccgtggccgaccaggtacgagatcgcgctcgggctcggctcggcgctgctctacctgcactccggctacgagaagtgcgtggtgcacagggacatcaagcccagcaacatcatgctcgactccgccttcgccgccaagctcggcgacttcgggctggcgaagctcgtcgaccacggcgacgcctcgcagacgacggcggtcctggcggggacgatggggtacatggacccggagtacgcggcctccggcaaggcgagcaccgcgtccgacgtctacagcttcggcatcgtgctgctggagatgtgctgcgggaggaggcccgtgctgctccaagaacaatccatcaggtcccgcctcctcgagtgggtctgggacctccacggccgcggcgccatcctcgaggcggccgacgagcggctgcgcggcggcgagctcgagctcgacgcgaagcaggtggagtgcgtgatggtcgtggggctctggtgcgcgcacccggaccgcggcgtgcggccgtccatcaagcaggcgctcgccgcgctccagttcgaggctccgctgccggctcttcctccgacgatgcccgtgccgacgtactcctccttgccgagccttgcattgtactgcgacgcggcggcagctagctcgtcgtcatccagtgcagggttttcttcttccacgagtggcgagcgttcgtcgacgagctcctctgcagcaaccgccgagtcgtcgtggctacttaagcacaacaacaggggcagtgaaaaaatagtattaggcaacaattgattagatcatatctttagtttgatgccaccttgatgttgcttagctcttcgttgtttatgtgtattgttcttcttgggccgccgtgtcatttgtgatatgtacctcaattcatatctccttttctatatatgcgttttcaactttcctagtatagcctgctatctttgatcttaattgaatgtcacaagccgagtcactgtttcgcgaaacgacatatttgcaaacgaaaagtaatttgtgaataaaacttttatatacgtgttctttgcgatctaaaagtaaaggctaaaaaataatttcgatgaaaaaaatttctcaaaatcagtttcaaatttaaggttgaaaattcaaattttgactaataattataagcataagcgaaaagacgaggagcataagcataagcaaaaattcaaattttggcgggacaaaggattgcgatctcgtgaaggtgagctaactccaaaaatccgtcctcggttgnnnnnnnnnnnnnnnnnnnnnnnnnnnnnnnnnnnnnnnnnnnnnnnnnaccggttagccatacgacggtgaatccgttcgacacaacgcccgtcacactatagaagttgactatgtttgaactcattaaccttaaccataagaaggaagatgcctaaggctaggcctttgactagagtgaagttgtaacaaggtagggcatgtctgggggagcttctggcagctgtagtttctctcagaatcagaagctctacctaacaattcagtttttttgtccaatttctgagaacctataattgtagaatctagaaaaataaactagaagctagaagctgaaaaactccagactctcagaagctggaaaacttcagactctaagaagctggctatgaaccagctgcttataattttaagctccccaaacaggctcatagtcgtactggaagttgcagctggatcacctcctttttcatgagctaatacttacgtattttggtttgacattaattgcttcatgcccaaaaggaaggcagctacgtttgagctaaatttggatatggaagtcttttttcgtttagggcaaagtacgaccaagctcatgagcttattatcctatatcggaacaattactagttgatattgataggatctcctttttaatggccccacaccctcctgtgtggtgtgtgcggtgtggcagatggggatatcaaaaggaaagggatagagtttttctcgtttttggtatagcataccttcttttgggaggcctgcagccccacacaatgagctccctcataattgcgtcgttgtgcctaggtaaggaattttgaattttttttctctgaattggacatctttaagcagtataaaatcttttctgttcaaaagagccgaaacaaaaactgttcgagatatgagccgaaaaccaaaagtgaacccgttcatgaagcccatcaaacgcatgcagcttaacctcgcctgattcagcagcccagttgaaggtcttcaaatcgtaggatttgaaccctcgtgatgaatccacaaggtgatctcccgtgtgtgttagactgttagtcacccttggtgccagcaaaaggaaaatgaaaaggtcattgtacaagggcccaaaaaatataagaacagttgaagcagagaagtatgaacatatatccacaaaaagttcctttaagaatgatatagatgatcgtgattagaacccacaaagtgatcgccaggagaattgaaaggtctaggcttgactagtgtatcgaaagaaaactgtggaaatatagatgtatcaacatatgcccacaataagaacgatcgaaattacgtgtaaagattattctttcgaaatttgcaagcataaaaaaaaaaaagacctatagcttcatctgaccaacacctcccttgaatgaaccgtataaaggtctcgacctcctgaagctgaatatatcggttatttgatacgagtgcggctgtggctcatcgtgaactatcttttcgtactcggaggaatggagaccgccgtaaacttgaatgctaagaattttcttttgtggtgcattaactttgacatgattattgaagaactcaatcaactcctctttattgagatccctcagtgcagcaacctgcagcaagagaa

SEQ ID NO: 54144 - DNA, 6014 bp, Oryza sativa
atcgtgattagaacccacaaagtgatcgccaggagaattgaaaggtctaggcttgactagtgtatcgaaagaaaactgtggaaatatagatgtatcaacatatgcccacaataagaacgatcgaaattacgtgtaaagattattctttcgaaatttgcaagcataaaaaaaaaaaagacctatagcttcatctgaccaacacctcccttgaatgaaccgtataaaggtctcgacctcctgaagctgaatatatcggttatttgatacgagtgcggctgtggctcatcgtgaactatcttttcgtactcggaggaatggagaccgccgtaaacttgaatgctaagaattttcttttgtggtgcattaactttgacatgattattgaagaactcaatcaactcctctttattgagatccctcagtgcagcaacctgcagcaagagaactccaggtataaaaaaaaatgacaccatagggacaaaattacagaaatagagcatacctccgcctcttttctatcaaatttcagagttccttccgaaatttctttccagaagaacgctgattcctctcttatattcttgtatttctccagcttcatgtcaatgagagcattcacgttgctctgcaggtaacagaagtgactgtttactctgtataatgtcaagtatacaaccatacaatagagctacagcaaccttcggccgacccggcaaaagagctacagcaagctataacagaagccaacaaatactgacagcaatcatcttaccttgaactcttcatcaggcatttggtatagagtcccttcaaacatattaagaaaagcttccactctgtcatccaggtttgatggatcctgtttaagtaacttcttagaacaggagataaaaatgatccagcagttgaaattgcattggaaaatatatttaccttcacggttgactgaattatgaattgcaatccccgaacacctgaatcatttctgggtaaacaagatagtgtgaacaaagatttagaggagttgcatgagcatgactactaagtcccattaccacataccaatgcaaaaaagtgctgcacatccttttgcaataaagaacacaattaaaataaaggcaacatcgtacctttgtgtaagcactgttatgtagccaagttgctcaactgaacgcaattggtgaaaagctggttgcttagcaacaagagcaagcaattgaagtagaacattttgtttgagatcatcctgatgaatctgtgcagtggaaacattgttatagcattgaaatgtgtattgcaggtatcttccaggaaaaactagatatggttgatgagaggctagagtaagaaaaaaaactggatgttcaggtattcttctgtaaatgcaaaagaggtccacagagaaaacatcaaagaagtgcaaaggcatacctgaatataatgcaggatggaagaatttttttcatcctggtgatttaggcacaatgctggataataatacctccaacccctttcaagttttacaattcgctttgtaagatgctgtgatgggggtaatgctttgcagaaactgatgggtgcattgaataaggtgtcttcaacatgctgtataacactttttgcttcacccggttccatgttccctaatatagtaatatcgatcacatacagaattaagaacataaaataagtacacccttcttaatgagaaagaatcaaaataatgaagttagttattaaacaaaccagcaaaatagcattcaataaatgtcttgcccagaagacgaggcaaaaaaatctgtagatcgcttgcttcaatatgagaaactgcagcaagtttttcatcccatgcccaagtttgttcctctaatatcaatgaacaatagtaaaatgcctgctcatatggttgtcgaaatttgaaattctcgtagtcctttattatagtttcctgatgacagcaacaaaatatgaacacacgcagctcatgtaatgtaaaatgcatagaatgctaagttaatattgcataatcaggaagatagaaggtacgctagacatcctaggcagacactcttttgtccttcaagacatcctaggcagatagaaagtacgccatatttaatccaattagaattctatagatagaaatgcatatattaggaaatatcacaactgttgtttatagctttttagtcccgtttctgcactgttttttcctaaatgaaagtagctcatgcttctgacaaggaatctcctgactgttttatacatgtccaaatgacaaccaaaacaaaaattctagcaggtctgcagaagatattttaacaaagaaccacatgtaaactgagcatggccgttacctttataacagcaaaacggtcaaccttcacttcaaactcagcaatttttccaatgacagtatccagaagggttctcattttgtcattataaccgaccatagttatctgtaaggaaatcataaatattggacggttagaaaataagaagatttcataaggaaaagtctcataacacgccatgaattatgactcgtttagaaggaacagttgagtgatagatcgcaatttacaaacatacataacaaagttttacaaacatgcaacacaccaacagtgtcagccactcagcctgctaccacacagtatacatgaaaaagtaacagggattaggtaatattgaccatttaatctaatatagaatataatgccatttgtatatgcacatatgaaaaaagaaaacaaatggagaaaaagctgctgcaagactgtaacttatgaaagcacatagccatgtacatgttctaattacagcactaatgatgactttattgcaaactagtgcagttaagaaaatgtacatctgaaccaatatgtggaaaatagttccaagtgtcaagactgatgatagcctacttcttgcttctatatgcaacaggaatcaggattttaatattaaagattaaatgagaatcgaatggcaagcatctgcttattagtaacacatattaccatttttttcatacttgcgcaaatacagtatgtgtttaattaggagaaacaaaaaagtttgagtatagaagcgctatcggtattgatacatattgactgaagagcttggtgtcatggtgtgcatcatgcatgggttatgcgcatcagatggaacacattgtatgaatatatgatgcaggaaggcctgcaccatagtacgattgtcacatgacaaccatatcagcagcatgcaacaagtaccaacatagatgggtataagagtgttcgtactggtttaggtgaaaacatggctaaaggcaactaacatgatgaataaagtaggtggtataaaattattgtgtagttggcaatgggcatgtggtatgtgccacaccacacaagtttaatgtcagtggaaaaccttttatttggtaacttccaagctgcgatgcaataaccctcgggcatttgaccaagaatatttttcaaaaatatatgcactttgtgatccccaggcatatttccccaaaataccccttctgactgtacctatctccgtatgtttcagtgctctgttgattgtgagatattattaaagggtactttcattacattctaaataaattgttttttcgttttgagagggtaagccagtagattgtaattacttggatatatgcaatttagtcaaaagtaataaatattcaaagtggaggggagttaacttatatcaatgcaacagttcaatttccacaacaaccaggaattccttctgaacccgcaggaatatcatagaattttcacataaaacaggaatcggggaaaattccgtatcccaaacagagcctaagagaagtatgaacagcaggaccctctttactaaaaataaaaagaagattcagcaaggacaattattttcaataatccagtataattaatgctcacaaggagtcaagttattcaatcttttctgatataattagtgtgatgtttccatcaacactgcatcatctggattagcaatgaagataaacaatcaattatgtcatgcaaactgtacagctaacctgaaatcagtgtcacttggcctaataaagtagtaaagaccagcaatttgagcatcataagctgaaagcaaaacaaagttggtggattattgcaacagataaatgaaccaaaggcaaactaaccagaggatgaccatgtccttagtccctctattttctaggattgataactgtatgtggagaacgagttcttgtttcggccaacaaaaagaattttccaacttctccattagtatatgtcaattttatgatagaacattgtatgaagagaagtttgaaatatactaaacaatttcatgaacctgtgccataagaatcataaaatattgagatatctcatgtattactacataccaaaatcattcaaataatccattatcaacctcgtgaacatatcagtaagaactgtcgattcaggagagctattggacagtggacagtggaaatccatcttgacgtaggccttgggtgtgaagaacattgtatcaggcttataccatactcttgaaaacattgttttcctaagcatacaaggaaaacttccctggataaaccgaaaatatcaataaagtttcacaaaataaaattatgagcatttttttttaataaaaaataccttttcctcaacatttttcaatgaaagatcacttggaatgaagatattaggttttggaatgtgcaaatcttccatgggagccatatttacccatttctgtacaaattatgttagaaatgtgtacaattccaaatatattaaattggagaatatgataggaacagtaacatccaaatgtacacctgtatgatggaaggagtgactgcttcaactgaatatgatgtaccataccaaggctctgttaagtttgtttgcccttcaaacttttttgattcccagaatattctgaaggagatgaagaagataacccagaagtattaacacccgtaagtaaaagtcacaatgaaaataaaatctaaacaaacagatcaagtgtgtgaaaggaaaaaataaagcaaatggccataagaggatcaacgatgagtgaggagcctgttgctgctttttggaagttaacaataaaaaaaatgcaaagggacaagtaatgaaatttcttccgctttctctgagaaaaaaagctcaaatttatgaaaagtagtgaaagttctcttggctgtgccatccttctagaagagcactatagtgttttataattgattaggccaagaggagtgtgaagcgacagctaaatgcaaagaccgatcattttccaaactacatgcagtagttgaagagtcacaataataagcatatgcatacattatactgttattgctgaaatgaacaaccaactcaaattggctagtccccaattctgtatgataacattaaatgcatgagattactgtcgtgaatagaatacacattgttgtatctttgcagtctcatactgatccgaaattttccattcgaaattgtgggatacaagatgtgctggaagtgctcctgaaaaatcctaggaatcatgtctaacctaagtgtacgggaagaagcatatgaagattttacaatgtggtacatgaaccattcaaggcatcaaagatatgtagcacaaatgaattaatatagatatgagtttcctaagaaagtaacttttgaaatactccaaaaaagagagtataatacataaaatataacttttcaacaaacatgtgctgaatattaaaacataaaaaactatgactaaaccttaaaacagaacaggaaaacccaacaaggccatatggcctggatgtactcaaaacctacctaacattatctggagtcaagtcatttaatatattctgaatagcatctggagaaaactttgatggcacagatgatgcaatcagccaatcttccggcggaaagatctataatagagagagatcatgagatggtgatact

SEQ ID NO: 54145 - DNA, 1837 bp, Oryza sativa
  unsure (1)..(1837): unsure at all n locations
nnnnnnnnnnnnnnnnnnnnnnnnnnnnnnnnnnnnnnnnnnnnnnnnnnnnnnnnnnnnnnnnnnntgatacattaaatgcatgagattactgtcgtgaatagaatacacattgttgtatctttgcagtctcatactgatccgaaattttccattcgaaattgtgggatacaagatgtgctggaagtgctcctgaaaaatcctaggaatcatgtctaacctaagtgtacgggaagaagcatatgaagattttacaatgtggtacatgaaccattcaaggcatcaaagatatgtagcacaaatgaattaatatagatatgagtttcctaagaaagtaacttttgaaatactccaaaaaagagagtataatacataaaatataacttttcaacaaacatgtgctgaatattaaaacataaaaaactatgactaaaccttaaaacagaacaggaaaacccaacaaggccatatggcctggatgtactcaaaacctacctaacattatctggagtcaagtcatttaatatattctgaatagcatctggagaaaactttgatggcacagatgatgcaatcagccaatcttccggcggaaagatctataatagagagagatcatgagatggtgatactgagcagaattaatttgcaatttatgaacaaacattttggcataatttattaggaggaactgatcatttcattgttcaatgaaatatcatgagctggccttcttgttaatttcattttgtgtaacgaaacaaagtagcctacaaacataagttaagaaaagctaaacagtttttagatatgccactccacttcctcccagtcatacgcatgtgaatctatggggaatgcagatccgctcatgtagaaagcttcaattttgtgaatttggcgatattctgttcaaatttgactaaaatttgttcaaaattttggtatatcagcaccctccaatagaaacgtccaaacctaaagattaaaccctggggggggggtgcatatgcaaaaatttcagtcttttgggcctctgaaaactcggatattttggtcaaactacaacaggaagcatgaaaggatcataacctacacagaagcctagagcctcattagtggaactatgccccactgcatccttgctgacaggatcacgttttctctcagggaagtgttatggtagatgtgactatcacctccaaatttatcgatatcattcactcataaattaagaggcaacccatataatatgtcacatttagtacacaagcccagcaaaaaacatttagtacacaaatacattgtaatatatctaatactctcacacccttcttgaaatttgtgtggaggttgcctcttgatttaggggtagctcatcatctctctcctcacttatctccaccatctcatcacttaatccaatgtggcactcttaggggcagcatatggagcattatagtacttgccctcagcgacttctccctcctcaccgtgatccaacttaccgctagtcgctagagagtacaagtatctaatggctatgactagagattgccaagctgatccaggcattaccacattggtctcttacccctagaagccacattaatcaccttgacacataagacagtcgtgcaacatggagtcagtgacaaattgcagaaagaagggagttatctggtggcatatagttcatattctcacttcatttgtgagggatcccacctaatcacatccctatgaattcaaccgagtcttatccaacaactcatannnnnnnnnnnnnnnnnnnnnnnnnnnnnnnnnnnnnnnnnnnnnnnnnnnnnnnnnnnnn

SEQ ID NO: 54146 - DNA, 899 bp, Oryza sativa
ttcgagcttggtacccctgcatcctcttttttattccgaattatcaacaacgggtcgttgctttacattttacaactggtgcaccgcccttcttttttaaaaaataaatgcatgtagaatttgagacactgtcagtgcaaaagtaagacacccaaggagaaccacaccaggtaaaaaggtagaaaatccacttgtgagaacaaaaaaaaaaacaattttaactccaaaatactcctacctttgaatgcgatgcacttgaagcagcatcaggattaagctaagcacagaggaggagtactggagtacagtaccattttgcaggccgggtctccctgacatcaactttggagtacgccaaggaggatgaacaaaagaaaagaagcacagccttttgccgaagcatttgatcctgccctcacctcgaaatccgtgccgccccccgcttctcttttgcaattcgctgacacccaagtcagcaatggcggccaaatcgcgctccggcacggccgccgacgagtccgcatctcgaggcgccgagtatcccggcgatctagctttgctttggcttcgattcgagccggcggaaaagccaatcctccgtgccggccatcgccggcggccggtctctcgcctgaagcaggagggccgaagtgatggcgcacctcacctcgccgtggagcaacggcatcaccaccgcgcgcggcctcacggatcgatcgatcgatcgatctcatggcgccgcgcacccggagacctcttccctcgccatcgccggcggcggcggctgacgcactactcccaccaccgacaccgacaccacctagccgacgatctcaccgggaggccgcgcgccatggcggtagaggggggaggcgagagcgaaaaaaaatgtcacaaac

SEQ ID NO: 54147 - DNA, 751 bp, Oryza sativa
cgatcggatatcatgcgggatacttaggctaaagatcaatgcacgtggttggtgaatattccatatgacatacgatggagatattgtgtgcgtatgggatgcggaggccattccagggctgtcgaaccgggcggatctataccggtcagaccggcggcacaagcacgatcaaactggcagatcaacctcgattagaccgatctatatcgaaattgagggtaacttttaattccgctaaaaattttggtttttgggtacaccaaccattcaccccctatggttgacttaattctttctacggagttgctagaaatatggcgtcatatgctacagtcgattttttttcagccacttacacagtagttacacctcatttacatcctacttacatatgtaattactatgtaatttttgaatttacatatgtaattttagtacttacacatgtaattttgagacttacattgtaaatacattaaaattagatatgtaatttagggacttacaatgtaaatacatgccgactatttttttttgatgaaaatatagtgccataaatatagctacacccttctttctattcgatcctacagttgtgagggtgacgcgcgccgatactggcggcaagctagcaaatcagaagtccggcgatggcatccaagcgggaaatcaatgtgcaaaatccggcaacaaggacaatagaaaggtcttggttagtgtgcttgactaggttgccgttgatttgtgtttt

SEQ ID NO: 54148 - DNA, 1767 bp, Oryza sativa
  unsure (1)..(1767): unsure at all n locations
gtacattaacttgtttaatgtactgactcttgctgttgatataaccttttgtttgcaggtttagtcttagtctttgagtgatgcgggttccgattgcttcttctaggatgagaacttaatagggtaaacccctagtcggtgtgcttgtgattgggtagtcaagcttccgctgttctctaataagtctatttggccggttggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgcctttgagtggtttgacgggcacatctcaggctgaagttgactggcaggctaagggcccagcaatgtctccaaaattcctctctcgaggcgtcggatgtttcattatgcttgtttgatgacttgaattattcacttcatctctcaaatataatggaaggtctggagagcctacgacactaggcaaggttttcacctaaggctctctcgaactgctccacctcaaaaccctcgtcgcgttgccgggacgttcgttgagggtcatcgttgccgagcttgcaagacaagcagctccaactccacctcaacagccaaccctgcagctcgaccagagaccacctcacacccaggaacccagctgcagggaaacaacggcgcggccgacgaccagcgaacaggatgccgaaacaacttcgcacgccacccctaccgaaccacggaactccccggcatcgactggaagcagcctagcctaagaagggaggagcacctaagaagaggggagcggacgccgcaccgtcagagagcaccggaagaaacaccactgaagaaggggagaaccggatctggaggaccaggagggagggagatggaggcgccttccccgtcgccggcaaaagccgcagcaggccggcagcccctggccaggaccacgcggcagccggcgccggagcaccgccgccgacccggtgctactcctatagggcgaattcgagctcggtaccctgctggccacctgctacgtccgagggcgccggcgtcgaccgagaccgtcgccggccacgccgagacccgccgccgcgccgccgtcgtaccccggccagatctggcggggctaccagatctggcgacgccctcaacggagccgcgcagagccccaccgccgcgctgccatcgccgcggggagccccaccaccacgccatcgccgcgacctcgccgtcccgccgccgcgacctcgccgtcccgccgccatcgtcgccacacccgcgccggggcgagatggagtcgagggagattaccccgccgccgccatcccagcgcgtcgcccggctttgccggcgacgagctccggcggcggcgaagcagggaggagggaggaggaggggcggtggcggctagggtttcgcccccgagccgccgcgcgaggtcgacgcgagggacaaacttcgctttgccccatgtatatgaattttaaaccatgtatttcgatgtaacgagtttaatgagtcgacttgggctttttaacaagtcgagttgctttcatttttaactnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54149 - DNA, 2292 bp, Oryza sativa
  unsure (1)..(2292): unsure at all n locations
nnnnnnnnnnnnnnnnnnnnnnnnnnnnnnnnnnnnnnnnnnnnnnnnnnnnnnnnnnnaaatttatcatatattaacataataataaacacaaactaatgaagaactcactaaatacgaataattttgatgtaattaaaaatctaagcactagttaagaagtactaagtatataaagatgtggtgatatcttgtactaacaagctaaacgaggagctcgcgagttagctcgttaaggttatgagttaaaaatctaacctggcctgactcattaagattacgagttcgagcctatctgagtcgagatcgctacaagctgatctaagccatgagctttgcgctttttgtccacctctatgctacgttaaggcacaatttgaattaatagagccgcctacaagttaagctatggcacgcaattgcgactatatccattttgttgatgaatgaaccagattattggctacagtgccaacacaaaagtaaacaatttttgccacagtgatctacactaccagggtgcatattgaccattggacccaatctaataagcggtcatagattgcataaattgcagtcacactatcacatctgattcaaatccatgttaagtctcgcgcacttctttcagacacaatattggtaaatgtttaattttaaaactgttgtgcagttacaccggatcatagcggtaatggggaaaaaggacatttagaagaaccagggtgtcgaaacatgatttcggcaataataaaacggggtagcgcacgagacctaaaagtggatggatgtggagacaaaggatttagacaggttcgggccctctcaatgagaggtaataccctactcctgtttggggatttgaatccgccgggtgtattatagatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattctatagatataagttatcccctatgactggtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatctgagtaaataaactcataaaggatttaccaaccgcctagaaaatgaccacaatatataatcagcctaagccataacattggtcaataaaaatgcacacttacgtggcgaaaagcaatgatattgtatctaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgatagccctt

SEQ ID NO: 54150 - DNA, 1064 bp, Oryza sativa
gctcatatgaatagctcctgatctgaatgattatccctatggggatactccaaaataaatataataatgaatccccgactggcgcaagtatcgggttgatagcccttacgggaaataataattggtccagtctttgagcatagaaaatagactcatgactatgaatccatgtgcaatgtatccggaacaagtccaaattggagatataatcctcacgcttgagctgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaagcgaagaaaccagtcggcaacagtcaggtcagctagcagtgaagatgtaggcgcccaacaacaacgaaagatcagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattgaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttg

SEQ ID NO: 54151 - DNA, 1663 bp, Oryza sativa
  unsure (1)..(1663): unsure at all n locations
nnnnnnnnnnnnnnnnnnnnnnnnnnnnnnnnnnnnnnnnnnnnnnnnnnnnnnnttttctttttataaaacccttttaactttgtttatttcttttcacttattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgagttttagagtcgttttgggacgcgacagtacggttctttctttcgggcaccccatttgattggggtgaatagggaggcgtcatctcatgaataattccaaactcttcgcaaaaagatgcaaactcattggaaaaatactccccacctctatcagacctcaaccgtttgattttcctttcaagttggttttctacctcagctttatagattttgaagtaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaacctttgaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccttttgcctttcccttgcctttcttcttaaaattggttgcagctttgggtttgacatcaggcttgactttcttgttgttgtgggatgcatgagggttcttcttctgtaccatattggcactagaacctccctcaacctttttgccccgcacgtcctttgccctcgccttctcctcaacacccaaagagccaatgagatcaggaacactgaactcttgtctcttgtgctttagagaagtggcaaagtccgaccaagaaggtggcagtttggcaataatgccacccgccacaaacttgtctggcaactca

SEQ ID NO: 54152 - DNA, 8480 bp, Oryza sativa
caggtttttggattgttggaaatatagtcattattcggcatattttaatccaagaaattgaaacaatgatcatggcataagcagtgtagggtgatcttaacataaccagtagcatactatgcgcatcatgaatgtcagaaacaggaacataccagtaatgcgataacatgctagaggcatcatgtagaacaggaacaagaacatagctcacacagtatagcgctaacaacagtagtaggaggagaagattataccccgagaatggccctccgctggatggtgaggcagaattgcctccgttgttgtagtcgttcacggcacctcctcctggcgcaccagctccggatccagctcctgtcggcggcggcgcaccagctccggatccagctcctgtcggcggcggcgcaccacctccgccagcaactccagacatggcgatgagcagtcgtgcaggaggcactccccaaaaacctgatcacccgcctacccggtgcagatctcaggcgaaggtgtggtttcggaggcactgcttcttccaatctctcgtgcgcgcaagagatcagaagcggggaagggagagagcaactcaggcacaggggagaaactaacaccggggaagcagctaagaaatcggatcagactcgcggcctccttttctatcaggagaaagaacgtggacgcgctgttgcggagggaatcgtgggaacgtgggttagtggctgcaaaagagcgacgtgacgcacgcccgccgccagccagccagccagccacgccacgcctcgcccacgcccacgcccacgccccggcccggcgcgcgcgcgcgcgcgtgtggcattccgacccccacctcaactggtcaacagggagcctctaataactccctatttaggttgagatatttctcgcttaaatcctgaggtggtattattatccttaacatttattatgggcctttgagatttaatagaataaattgggcctagcccaattattctaacaacctcgacccgcgcgccgctctccatcagcggcgacgggaaagagaggcggtgacgacgggcggtggcgagagagatgaccccgccgacgccgcttgccatcgagcattgcaagagagagagagaggcagtgacgagagagagagagagggcgtggggagagtggatccggcaccgacgaggtagaaggcgacgagaagaggaggaaacggagcagcggcggagagagggagaaaaatcagcgcaggaaatggtgggcggaagagacgagaagaggagaggaagagataggagcagcgtcggtcaggttttcccaaaccgcaagggccggggttaccgcgccccagcggtaagcacggttaccgcgcggtaaccgtgaaaaatcgtgcaaaatttatcaaaaatttaaattattttttaaattcatttgaatttaaggaggttaccatggtttttctattaccgtactccctcggtaaggctggtaaccgcgataaccgtgcggttaccgacggtaatgtaaaccttggcgttggtgggctgatgggcaatggggaagggtattttctcacttgaagctaccttgggccgggataccctttgtgggctagagtatctttatcaaatggcctcagattttgaagaacccatcagaggtattcttcattggaagatgagttctctaagtatggctttggttgtacttccttcattcccaaataagtgcagctttgctatattcatcttcaacgtttgactactcgtcttatttgaaaaatttttataattaatatttttgttgtcatttgataataaaatatgaatagtattttatgtgtgactatttttttaaactttttcataaatttttaatatgaatagtacatgccgtactgtactcgtcatgcattgacagtattgaaggagaagctactccaactagtactagtagtaggagtaggagtaacacacatcacggggccgtagtacgctttagcccctgtcatgaatatcctgtctcaaaccagaggccagcaatgacaacaccacaaccggaccaatggtacccagctactcctactgcaagtcactgctgcctggtgccaaaaggccaatgctacagtgaccggagcacaggtgaaattgctgccgccctctttgggtcagctctgctcagctctcagcgactgagactgagctgagctgactcgcgaccgctcgccggcgggaaggaacagtggtcagtgcgctcggacatcgccggcagagtgaggccacggttgtcgatctcatctcactggaatctgtccctgcagggtggggacaccgccccatgccggtgggcccccaccgttggaggatccgatgcgtacgttatgctggagggtggggcccttcccccgtgatgtggggccaaaaggtggtcagctctgatcagtggtggcccagctatggttgtttgttctttcggagttggcgccatctggaagcgatgggggcgggtcagcctcatgtcaggtcactgatggtggggcccaggttgggcacgggtgggccccagcgagtttgctctcgtttcgtgcaactcgtgttggtagtggtggcagtggtgtcatttcgctggctctgcagtactcactccgtcaaaaaaaaaaaaaaagtaaaatctgatttttcgtgtccaactttatctgtccttcttatataaaatttttttataattcgcattttcattgttgttagatgataaaacatgattaatattttatgcgtgacttgtctttttaattttttttataattttttcaaataagacggacggtcaaatgttggacacggaaatcagggtttgtcctttttttttttctttttgatgacggagagagtaggaaaaatgatggaacagtagagtcagcctcggccagtagctgtgctgcttctttaccattaccggtggagttgtgaaggatttgggggttgattgacactgtggacaatgaatgcagctgtgaatctgtggcgtcatgtcagtactcaagtactcctaccaaactagtacggattattacttgctggattggattggttgctcccgttgtttggtcggatccagtccagtgtccgtcaaaactctccgatgcttggggattttgtgggtggtggttgggcgaagcgggcgtcccggcgttttgccgcgcggagcacacgcggggaggagcgcggacgggacgtaacgtaccacgttgtagtacgcgctcgcgcgggaatcgatcgcggctgccgccgtatcgatcggtgaagaggcggcggcgatgaccggaccgcgcggcgcgcgcacgtcgtgggcgcgaggcgacggcgaagaggtctcttgcggggcgcggtcgacgggcggtggtggcaggtggagtggaagcggatcgtcggcggcgtcgactcggctaaagctctcgctatgctccgcgcggttgcagcagctggtgtctgtccgtctctcgcgcgcgttggtcgatcggattacagacgcggcgcggcctttttgtagtagcggcgctggcgcaaggttgcgtgatctcggcgttccaggtgtgcggtgaaccgggggtaaagtagtctaggctatattctttttttttattagttttagttagcatgcgagagtgtttgaaaatgttaaaggatacattccgtgctaaaattttctatagaagttgctttaaaatatcaaatatatatattttaagtttataataattaaaactcactaatcaggcactaatgatttttttttcgggccctaacttcatcttcagtcttttagtaaaaaaatgaacaccaactctggccatctagaaatcacctactccctctccatccgtctcaaaatacaattatttctaaaatttctcataaacaataagtaaggaactagaaaaactaaaatcgagatgattgtaatagattgagatgtagaagtatgtatacaagttgttatattttaggataagttttaaatgatactaccttcgtttcagattataagacttcctagtattgcccacattaatatagatgttaatgaatctatttgtgtctagattaattaacatttatatgaatgtggaaagtcttgtaatctgaaatggaggaagtagaaacaaaggttacaaatgcattagaagcactctaaataaattttgtcggaacaacttgtaatgcatcgtcaccttcttcccaaaatatttattgattgtaacttagattgaaagaaaaaaaaatgtccgtcaaacactacaatgtctaaagatggttacaccaaacgatatcccattgtcttaaaaacagttagaccaaaggatcacttatataatccactgtaataccaagcaaaagcttggtgtaccgatttcggtccgttgagcgtcagtgatgacggcaatagccggcaacctcacatccacgaggggaaaaaattggaaagtaacaacccaaattgtttacaatgactaacttatctactcaacttgtttgccattagtcgccgtatgaaaaacaagagcctgaccaaatgggtcatatgggcaggtaaacgactcgggcaacgaaaaagatacaccttctacaacacatgctacggataattagatctacgtcaacattagtaaacagaatcagcatttgcaggggaatcggtaacttgcagggaacagcttcgcttgttacgtcaatgacagagagagcattctaaacaaaggcgaaacaacaaactttgtcctcctccatcaaaaagacaatttgcatgtttgatagggaccacaatgtttgtgtatgtggatgtgtgtgcatccataggattttctctagagtaggatagaatccattgccaatgctgatgagtgctggaaagctcatggagcaaaagctacttgtggtaggcattcaaaaaatccggcaaggcaaattaatgacatgtcaccaactgggatcaatggatctaagacaagggcttcaggatgatatgagaacacacagccccacaatctctctgaaatttagtgaaggtggcaacaccgatgcttgtgccaagaaagtgaagccccctggtgttatacttttcagcctgcacgttgaatggtgttcagtccagacacgtgtgctcagctagagctttaaaatgcgatatccatcaagatagtactagtagaagattgtccatccacagaagttaacaaatgcaagcaaccacacctcactttcggattagcattgcagagactgatgacataatagaccaggaattttcaaccttgatttttcttttcatcagttcatttctcacttctctttcaaagctaattacaacacaacacaaccgaaaaggcaggtcatgccatgccatgccacccccctccaacccaatcaaatcatggctcatctatgggataatatgtttcttctcccaattgctaaaacaatccaagcagagaatggtgaggaatatagagggaaagaggaacaccaccacatcacaaaagttaccttgtcctgcattctaattaaattttgcttcagttaagagaacaacaaaaagaacaaagctaaagcagttgggagagggagaaagagaccagcttttgacatccatgcataaaactgctaaaaagagattctatgcacctccagctttccatcatgagaggataacctactacacaaaagtatcactcccatcaaccattccaaatacttcagttagcaaatgatccagcaaaggaatgggcgcgccgtcctcttcgattaacagccagcaaacaggctcttgcgcctgtggctgttgctgcgatctgcttcttctggggtccaagaggcgtagctccgttcgcgcatattcagaattagcagttagctcgcaagtccagagtagcgtcctgaagtccgagcatcgacatcttacttgcctgataagacggatgtttcaattaggaaaaagaattcacagcaggcttgtttcatgggagaaacatttgagcttatacagggaagaaatagaagatgtggagaaaagagcaagtccattaccagcagcaggcttctgatcacttgatggttttacagacattgacattggggccccaaaagtcaattgtgccgctgacatatgagagtgaggcacaccgctcggagactgagatgctgcggcaagatgcataaaactgccagcgggaggatgatgagtcttcatgttattgctggctgcagctgcaagaacattcactggatcagttagcattgcagttgtggaaatagacatggaagtagagcatagggagagcatagtagacgaacccgacatggcgctctgctgatggggctgctgctgctgctgcgtcttgtcagctgagcgcttctggtaaaggccaagagcaacacctccagcagctccaggggcttgtggtgtgtatgcattggagatgaagaaatgacctccttgtggaaatggctgctgtttcatcatgtgcgactgctgcttactgcctgaattagaaccaggcggcacatttggctgttgaccaaggatcgatggcataggcatactactatagtgatttgtgggagctgacttggctccagacgtcgatgctggattcttggctgattgttgttgaggtgacggcaattggacagctggtggaacaccctttgcacttccagaagccggtgggctgccaccagtacttttggagactgaattggatggtgaaccagaagcaacgggagcatttgaagatcttgacaaatcccctcctccagtagacatattagtgacaggacccatctttgatgaactctggggttggtggtttgaggtagagagagactgcataggagccttagcttgttgctgatggagaccactcttcatcacaatcaaattagagggtgaagcaccaggggaagccacaccagcaggtgcacctgttgctctggctgacgaaggcttcaattgaggagattgactaggaacacccacttgggcagcacttgatgggtacatcataccctgaaaacttggcatgttcaagcggtctgaatatccacctgtattgcttggtgcagcagatctggggcgagagttcatatggtgatgctgaatcaattgttgctgctgcttatgaagttgaaggaaatgttgttgctgctgctgctgctgctgctgctgaggaatgctggatggggatggtgctgccgctgatgtagctgccggggccgatgtatttgctgatttgcctcctagactgaaggcatttgaaggttctgacccaataaggctcaaggtgcgggatgagctatcattagtgttccataaggaaaggaggcacataagacttgttatcttgcttggagaaggaaagtgaatgctgctgtgaatcacctggatactttgcagctgctgatttctttctctcactgtcaacagtgttatgcgctgaagaatcaccagccacagattttgtttctccactgacctgacgctggggcttgtgttgaccagcttgaacagattgcgctgtggcaaaattgagctgaggataaccatgcctgcctgcttcttgatggctctggaatagttgatggttcggccccaatgaagaaaagtcaaggccacctggggcagatccaggagcacccacagaaccaaaaggaacccaaaagagggagaggaagcaagatcaattctcacaccctgccctcgactcgccggtggtagctgatgcgggtggtgatcacttaacttcttgtcactctgaccaccaccaccagcagcggaagtagggggcatcaatgcaaaatttggaagatgaactggaacggcataattatgatcataacctcctttctgagggtgagatgacttgtcatcacccgatggaccatcttgcacagttttctcactgtcctggcggtgagcaaggccaggcagcagcactggacgctggttgccactggaatagctctgggaattactggcagctgcagcagcattagcatttggtgcatatcccagtaacccttgagattgttgtggctgatgcttctgagatgaagcggacatgtttgacatggggttcttctgaagattttgtggtgacgccccttgctgctgtgatgggtgcaacatgtgagaagggtaaacatgcccattgaagaacggaacagcaggtcctggtggtgccatgcctcgataggcagcaggaggtcctccagcatgagcagcaacctggaacgggtagccgccattctgtaagatggcaaaaagctgagcatcagctggtggcaagttggcaaagctcaggttcatggccgctgcgccagggtttgctgaagaattgtgggcagcagcagatggtggcattgtattactgcccacagaaggctttgcatcacccactcggctggcagcatttgcagcagcagccacaa

SEQ ID NO: 54153 - DNA, 1486 bp, Oryza sativa
taggagtatcaagttacaaggttttaaagtagcacagcaatatagttttgcactagattctctcatacaaacatgtcactgacaaaatataataataaggtgcagattgatagtagaattaatgactggtcattcttgacttttgcatgagcactttcatgccttatcaaaagtcacatctgtctaatcagaaaatagttaggtagtaagattttaaaaagtcactttcttttataagcaaagagaagtctgctttctgccctcgattcaaacttttatgagaaacagagatggaatactgtttctcgtaaaaaaaaaagatggaatactgtgataccaccacctatcaggcccgacgagcggtccactgtataggaaaatgggcaacaatgggactcctaactctttcttgaacatgcaggaacagtcaattgcaattaaaacagatgctattattgctaacttccttttaaaatgatgacaagacatgataaagattattagttggcaattatggacatgcaatacagatgcccaaagcaatgactaaaatatacctgcatgtttgaggaaatattgacaacataatggataggaggactcttgtctcggtagtggaatcccatctcagaaatagctacaagcttgacaatcaaaacagagtgaggtagttagctgtgtgcaatgctaaatggacttcatgtgcatcattacaatttacaatgtcgcaaaaacacatagacactgtcattatcgttcaccagttagacaattatacaaattccaagcattactatagtagttggacaaaatagaatttgaaggaagcacgcaaaaacaatgtgaccctttgacaagcattactgtagtagttggacaaaatagaccctttgaaggaacctaatgcatgcagcgtacacaaaaacaatgtgagcaacttgatgatatggtcacatactcatgtttcatgattcatcttgaaaaggtaaagtataattaaatttaaatattaaatagtagctccctaaaatgccatttatagagggatattgggtgataagaaaaggtactggtcaaattacgacaaattagaccaaagatcttatgtacaatcctgaccaaaacaataatccaatttaatgacttcattaatggcctgattgtttaaatttcgaagtagcggtatcagcccaagaaaaatttgcaaagcttaaacggatgtcacgtacagcttacagttgattttggtcattataaaaaaaaaatctattcccaaaaggtacacaaatccaaaaccaaaattcacctcatcaaaaatccactgacgagttccagaggtctggagcaatgctatgtatcggaataacagtccaataatgtcctccatgtgctctatcatcaatgatatgaaataggtaaatattatatacactgtaaatcttcagtacttaaaagtaaaatttgatcttccatcaaaaaatagtaa

SEQ ID NO: 54154 - DNA, 6660 bp, Oryza sativa
atttaatgacttcattaatggcctgattgtttaaatttcgaagtagcggtatcagcccaagaaaaatttgcaaagcttaaacggatgtcacgtacagcttacagttgattttggtcattataaaaaaaaaatctattcccaaaaggtacacaaatccaaaaccaaaattcacctcatcaaaaatccactgacgagttccagaggtctggagcaatgctatgtatcggaataacagtccaataatgtcctccatgtgctctatcatcaatgatatgaaataggtaaatattatatacactgtaaatcttcagtacttaaaagtaaaatttgatcttccatcaaaaaatagtaaagtttgatcatatactatccacttagattgaaattaaggatttaccctcctgactctcatgtgagtgaccttgattaccccacgtcttttttttatgcaagagattaccccacatgtcattggcacaggagggtaaatcctcaaaaaattgttgttaaaaaggcccttcttgaatgaaactcaccatagcctacatctgtgagctgtataacaacattgaagaatgaaaactcataactccagtcaccttcccatgcatacaaactcatagcccatcctgaggaatttaacaaagacaaagttaaaaacaacaagcactatgaaagatatatacacacacccatacatagagagaaagggaggtgatcaggtgaggatgatacgtgggttatgtccacccattaagcacagtcaagtcactatttatcttctttattttgttgttgtttattattgattgttatggtggcattatcactattttcctacgtagactccacataggtcaccgagagacaccacggtttaggcacagaggggacatgtggacactttcgaaagttgagggaccaaaatcagaccaaggccatagtttaagggactaaatgtggaccttttccttttctttattgtgtattgtttgcctgttccattgaaactttactttgatttttccttgacaaacctaatgtcatttttacataacaaagtcaatagcttcttgtatcagtagccaatttttttgaggtttggctgcacataatctaaaaatgaaacctatttgaggaaggaggtcgcagtgaattattagcacaccacctaaagaggatattgctgttatacctaaatatcctcgaatgaaacattaaataaaagcaaaggaataagatttcatctccagatttttcctatataacagtacggaagaaccatacagagataaaagagttgaaaacaccacacgaaagcatatacatagaaaacacaaaagcatctggatatgtgcactacaaaatggcatctcaattggaaaagcaaagtaagactaattatatgcatttggatagtaattatatcagaccaagaaccagctcaacacgtcacctcgaaagatggatataaactccaaatcagtgaatcacataacacaatctaaagtagcattcttgaattaaatggcgctatcatgtctaaatgcttcatcaaagtgcgagtacaatcctgtattaagctgacaataaggtcagatattcacattaacagaaatacgtaatatcttgaagcaagaagcatagaaccagaggattttgtattcatgttacaccaaatagcctatggactgaccaaacagccccaaacccgtccaccagaaaagaagctgaacttctcatatatagcttacctaaattttttagcacgtaaaatagagacccctctccttcatggccaactagacgactcacatacttgcaaggcccttccttatagtgctgaatatttggggtgattggccactgtattctcaaagtgtggccttcttttatgggaaccgctttaacaatgatctgcaggtcattaactaccatattaaaacatgttaaagtatccttacatttcaaaagaagtgccagatccagtggtgcacttgacttatcaacctatttttagcaaatggaaaatataaacctggagatgttcacttgaacatggatgaccatgaaaggaaaaactttcccttccagtattcctgacatcagagaacttattttcaacaagattttgaaggttgtcaagactctctgcatacacaagttacacaacagataaaagaaaaaaaaataatttgaagaatttgtacacaaatgaaaaatataatggtgtaattcagtttgatgaaaacctttgccatacacaacaagttgcatcaaattagctgagtaatgtgaattataaaatttaataagctcttccagtgtgtccaatccttccttatttggattaaccagcaaagtgtccaggtttcctaaaataatagatgatcagaatattagtgaaaaaaatagtcgacctttctatcatgtaaaaaaatagcctcttatttggctcaagttaaaactcccacaggttttgattccagagaaataatatctaaaataattttaaggtgtaaatactccctgtcctgtatgtttgttagacttcaacaaagtaatctccaattcacatatttggccagtgacttttagtggtagtttaattttgactccactattctgaaacaacattattttttaagaacaagcacgatactgaccaacagaataaagtagaatcagagggcaggcatcaattattctcaaagtataagaaatgtcaaagtacttcatgtacaaacttgtgaattcagtgcttgttcgagcctatgtggtcctcgccaagagagggacttgatgggttagaaaaatagaggtgtatttgccagatctaagagttgcacaatctttgctcattcatcacaacctttgcccattcatataactaccatgcctcaccaccaaataaaaaaagggatacgataggtggtgctgagaaagatcagctagatgccgagtaatcttagttaggttgtgctggaaggcatgggccgacacaaggggagatgcaaaacatttgactgacaaaggcacaattttacgtgtttctatgtccttcatatgctattgtttcatttgtgaaatcagtgttttttcaaatgatcctcatggtccacatggatcaatatcaatacagaagaacttcaagaaaagatgtgtgtgagccttggatgacagaataaaccacaaatgaagagaatccatcatgaagattgagaataccataaaacaaatggaccatcaggtttacaaatgcagcctttttccttttggaatttggaaggatatatagtgagtttttttttccccatcatgagcaatataagggcattcaactagttaaaaacttaaactcagaagttcatatgacatggatattttctgcaacattacaaaacgaattcttgacttcagcatgcaatacttgtgagttgtggctataaaatgaagatagaaacatggtaccaagcatatagttgcaacatcagacactacaagaaaatgaaatgatgactaaaacacacaccagtgctaaacttgtgatatggatggctctccgagcaaaaatgtttctggagctgaaaccaaaagattatagacaacgaaattattatagcatgaaagagcatggtaacataaatgaatttgacagaaacaattgtaataaatcaaaaaaaaatcatattacaccgctcaagaagaaatgtaaaatataattaaattaggtagaaacatagatttagatgtcaaaaccactatcagagctgggttgcattgctctttaatttggggggacgggatatttttagtcggttttatacttttgttagttaaagtgtgatttttagataaaccctataaagtaaggggtgtaatatagatttatcccaaaatcaaaatagaatatgagtatgataccattcaactataacagaaaatattccactgcgttgatgtttttctaagataaaggtacctgactcattcgcaaaggatctgacaacaagtttttcttattttctgcaggtgaagaaaaaaaagacagaaattagaagttaattctctcagcagaaatgtcagttccagataagagagaagcaatatataccagagtcaacagcattaatttcccttagagttgcatcgggtgagatcaatggctttataaaaaattgtgcaaacctaaaacaacagacgagaagcaaaatgaatcagattctgcaaaataagaacaaaggtgaaaagaaagaaagcagtagaaggtacctatccaaagcatcatccaggcaactattgttcacatcaaaataaaagtttgtacgttcacgacatgtgaaggcgttggttgaaccaccatgctaaaagaaacatccatatcacacaattgatgatttcaaagtagagaagaaaacttaaataccatgatattctttatatgaatttatgaacaattatgccccctattctttaactatatcagaggccagccagacgatttggttttcccaattagtattgttaataatttaaaaggctaaacctgtgcttgcaaatctccagtagcagcataacattggagaaacccatggttcaaggcttaaagcactgaaggtacagaggttcattgggcccagaacttgacctaagctataataggacagtctatctgatacttctgcggtcgcaaaatataagtattttttaggttggcacggtattaagaaagtaggtgacaaatattcaaggaagtgagtggatggttaaaaaaagaaagtaggtgaagaagaatggttgtgattagttgagaagatgagataggtgaaaatgagagtttcattttggggcaacatgtagaggtagaaatatctgcatcatgagacggaggtagtaagagtttgtatttgagtcatattacttagtgagcttggaattgatcgcatatggattaagccactcgtgcatcattagtgttgaaccactctcactctgccactgtaagcactggtgcaccaccgcaaactcgcagcagtaaatatatgagtttactcacaagtcacaagctggatactatagttacgtgtgcctattatactgttaccaactgacaactggtactctaggggcaaaagggcagtaaccatgattaaaaaaattaaactagattagctctacagatactgaatttctctaatcgcactctgcttaaagtactataaatataaaaccaaacaagtggcatctattggcataacaggaagcatccaagaacccccaaaatgtggtacaagtctctagtcattgccagtaaattgaacgtagactggacgttttgcaaagaatgcagtatgctgaagttcaattgtccttccaattgttctgaagcatttagattaagttttgagatcaattttagttcgatctaacaaattattgaccacgacaaatcaagatcacttacaaatgtcctcttcaaattaacagaacagataagaaattggccatacatacctctgcaatatactttgagtaatcgtcttccacagggtatttctcgctagcatagaaaagcatatgctctataaaagaagaaccaagcataagtgaatcaaacaatacagagacacatacatgttaattactgcaaaacacatgccatgaagctctctacatgcgatagtacaatccaaccaagataaaaaaacaattcaatgaggtttgaacagtgcctggtgatgcattaaaactctttaaaggtacacactagaaaatatataaaagagcaacatacaaaacaaggcaaattaaacatacactaagcacatcgatagcatgacacacagtgacacaagaaagttgtgcttactttatctgtccaaggaaaaatagttacaatgactagtgagtaaattaattttctaattgaataacagtgtctccttagatttttacaatcaccttaagtatccaaataatatgttcgaagcactctggtgtcgaaatgaacctcctattaatatatgccatccatttcaatacagaggcaatatagcatgtatatgtattacaatattagtataatagtttcaatcacgaataaaatttctgaaacatctgatccttcaatgaacccgtgagtttcagataagtaagccattttaaggcccaactgtatttttctcttaatgccctttcacatgtgggctttgacatctttgcagattaatcaagtaaatgattagctcatatacctttgaaggtatgggccattgtcgcttattagctggatattctgacagcacctatcaggagatattgatactgaattgatacattgagttgcacatgtgaatcaatcatctgtatattttcctggccatgctatacttgttttaatcttctcatccagagatactcagcatgatgctggaaattcattttcagatgttttgcatatatttgtgcacatattttacttatccaaaaaaatatatgaaaaagtatattttccttgcatattttctatgtgacaggggctgtgagaaaaatatgcatacctaaatttcaaccttcttcatctttattacattatcaattcaacaattaaacaactaaaaagggacatgtacatattgtaacagaaccaaaccacaacct

SEQ ID NO: 54155 - DNA, 2570 bp, Oryza sativa
aggagcctctcggcatcgcagaagtagcccacgagaccattcattaacgccgccgcctgcaatcaaacaaagccggaattcacccatccaagccaaaaacccagaagccaggcacaaaaacccccggcacatccccgatcgaaggagccagcgaaagcacgaagaccttgtcggtgtcggggtcgctgacgagaaggcactcgagggcgttggggagcacgacgcgccggtacccgcgcttgtcgttgcggggcctggtgatctccgtgtcgccctccgccgccgccgccgcggagggtgcggccgcgaccgcgccgtcggacgacggctcggcgggggcgtcggtcgtcgtctcgcgcgctggcctcgaacccgccattgcggccgccgcggattcgccgccgctggcggtgggtggtgttggagttggagtggactgcgtccgcgaagacgcgaagttggcttggcagttggaacggcgagtaacaagttgtccccggagacaacgcgagagagggtggcacggcagcagtgggtggacctgcagcgcgggttggtggacttggtagttgggcacgtcaggagtgggcaaatgggctgggccggaatgccggatttgtgcacggcggcgtgcaccgggacatctttctgtttgaagtccggcgtgtaccgggacatcttactgtttgaagttcgaagtcaagtaaacgtctactcgaacgttcggaatttttacggaatgggaagaaaactactccctccgtttcataatataagccattctaacatttttcacattcatatggatgttatatgcgtagattcactaacatccatataaatgtgaaaaatgctaaaattacttatattatgaaacagagagagtagctaggtgtgccatagcagatgcagcatacaaaagaggcagcgagtagaaaactgaaacgcagcgaggaatgtgacacacatgcagagttttcaagcaaaatataagcgtcgcctgcttcggcagctttgctatactctccatgtgtagattgcagtgggagctgaatgtaactttctcgcggcacatggttccatttttcaggaagagataacgtccaaagaaacaacagcgagctcactgaaacggaaataaaatttggagctaaactaaggatctgtaggtggaaccgtggaactgtggaagcacctctgctctggtggttacgtcgtagggtctgagcccacgtaatgagaaaccacaaggtgatctccagtcgtcagtcacccttggtgccagcaaaaaggagaacgaaaggtcgtggcgatagaaaatggtggaatggaaatgcagaagtatcaacatctgtccacaaaaaagtttctttaataatgatcaaaattacacgtaaaaggattattcttttggaatttgcaagaatatcaaaagggttgacttatagcttcatctgaccaacacctcccttgtatgaaccatataaaggtctcgacctcctgaagttgaatatatctgttatttgataggaatttggtcgtggctcatcgtggactatcttttcgtactccgaggaatggagaccgccgtaaacttgaatactgagtatcttcttttgtggtgcattaactttgacatgattgttgaagaactctatcaactcctctttcttaagatccctcagtgcagcaacctgcagttacagaactccaggttttgaaaactgatactacatcagagggataatgtaaatatattgagcatacctccacttcttttcgatcaaatttcagagttccttccgaaatctctccccagaagaaagctgattcctctcttatattcttgtatttctccaacttcatgtcaatgagagcgttcacgttactctgcagataacagaagccactgtttagtccgcatgatgtttacaagtacaaaaccatgcaatttagctacggcaagctgtaatagaagccaatgattaacagtgagtcagtgacatcatctgtccaaccttgaattctgtatcaggcatttggtatagagttccttcaaacatcgtaaggaaagcttcaactctagcatccaagttggctggatcctgtcaaatcaatatattagaataggagaatgattgtttcagcgggtttgaaactgcattgagaaatatatctaccttcacggttgactggattataaattgcaaaccacggacacctgaatcatttctgggtaaacaggatcagtgtcaatgattttacaggaattgcatagtctacatatagaacaccattcttgccaaccaaggcaaaaagaccactgtacatcctatcaattacgtgaaggttgtacgtacttttgtctaagcagtgttatgtagccaagttgctcaactgaacgtaattggtgaaaagctggttgcttagcaacaagagcaagcaactggagtataacattttttttgagatcatcctgatgaatctgcgcaatggaaacattgttacaggatagaaatgtctattagatgtatctttccagggaaaaactataataattcaagcgagaa

SEQ ID NO: 54156 - DNA, 19810 bp, Oryza sativa
  unsure (1)..(19810): unsure at all n locations
cgatctctcgactctcgtgcgtcgcgttgccccggtgcggcggtgccctcccataccgtccggcttgcgtcggcgcgatcgggacacgccaaagccgatcgctagatcgacgccgtgtctcatggccatgcaccatccatcatccatgcaaggtcgcataataaccttgcacgatcgattcaaaaaggaattgggttacctttagtttctttttcctcctttttttgcttgtttggagcctgcctagcaatagcacagccattatttgctcgtctttttaattttctcctcgtgtaaatccccatgaccactatgtcaggttacagtcatacaaaattctctccccccgctaatatattgacatgcaaagctcttatgcgttaaaaaaaaaattctcctcatgacctgtgtgggacatgatccacagccagttacaattcattcagagcatctaccaactgacatggaaacttggtggcaatcttctcaggctgccatacaaaaatcatagcagaaaatcttcaacgcacaagtgatcttgattacttagggagtgttcgttctggtgacatagggtgagaaaggatatcgtattccacgcgcacgcttcctaaactactaaacggtgcgttttttgtaaaaaatttctataggaaagttgctttcaaaattcatattaatccatttttaaaatttaaaatagttaatacgtaattaattatacgctaatggctcacctcgttttacatatcttaccaatcttctcaatcccctcctcaaactcacccttagatgatttggaagaagagaaacaacaagatctttgaaggagtgaggaaaaccgccaccgaggtctcctaatgcataccagaagaatggtgagcacggcaagctgctagttttgcaggcatcatgatcaaagagatataagacccatttgttatcctagttgtgccatgtagttaggtatttaccggcaaaatacattccttatcttaggattgggttgtttccacaacattcatgtttgttgttttatgtgacaatctcctcattttcttcatgtaattgttcggggctttcctccatctccgacccggcgaaaaagaaaaggaattgggttactacttactactcgaactaggctttcaggaagtcgtaaactggtgggtgtttcagagttgcaaactttcactagaactgaaaacaagcgaggccattcaactcaactcctagtactcgtttcagagttgcaacattcaggaaatggaagttatttaaagtgtaacggatttggttggccaccatgaatgtgagtttcccattgtgccagtagggagcaacatgacagctactgcctgacccgattcatgcgtattggagtgcggacattcatttacgccggcgctgccaaagccaatgccaagcgaagcaaagcctgccggttcgttccagacttggcaatttggcatagccagcattggcacatttctttcctcacaaccatcacagccaagcataagctttcgagatagctgaaattgatggataatctgatatttgtagtatccatttgaggatatcaataaatgaattagctattttttaatttattcatacaaagttgaaaaaatgttttagagaagtatgccaagaaaatcttacatataaatattttgtatgaaacacatagtctagcagcttaggaagcgtgcaaacgaaaatctaaaaattcaggatcagaaagaacagggcgcagtgtatgtggcgcatattgctagtcaagctcgtctgaattcggtgagcgaaatgtggacatggaacagaacaagtccttgcaaataatgcatcatctcccatgtcatatagtcagagcgtgtagactggcattgattattggtagctcgtggtggcacgcagccaagactgaaggaaacaaggaactcttctgaaagcgaaatgaccctatcggaactttggacagctgatcatgatcacattgctccccgtccttgggtgatacaagtagtaagcaaagaggcacatggctttgtcccacaagaagaacaggaacaagatcaagagtactgccagactaggtgaagattaagaacagaagaattgcagaataggaagcagaatatgattatgtccccggcgtgtacttgtacacattttcaacgcaatttcgctcattggtcagagagcactcatcagtgacaagtgtatcttcagtactttcttctgattaagtgattatgacactggcatgtgacaaactaccattaacagtttatctgatgatgttgttaaaagttgggagttcaccacgcgagtgatcccaagaaacgcggctgttctctgcatcgtactacgcactgcagctgatcggctccggtaggtagtagtacgatgctgccggtgtcggtggcgccgcggcgtaaggcggccggcttgctgattgccaacggcgctcgacgtgctctgctggaagctagattgcagcaaagaccaattctctgaactctgaatgaggcagttaccgtattcatcagcttaagtaaacaaatcatctggagtctgaaacatttctatggtggatccgtggagtctacagggtcatcgttgaagctcaagttctaacaaaagatgagacacagttctcctggtattatgtctagtgcatttcacatcacttttaactcaggcaacagtaagttcagactgaatacaaaacgaccaagctctcatcactcaactcgttgcaattgcaggctttgcattgtcttgctggcttttgagttcttcgctgtggtgttttgcgtcgttctggtctgaatatggtgtgctgctgtctgttgttgcctcctatgcatcatggcaattctgtgtgaattgctggatcaagtaaaagaaaacatcttcctcttctgaatttctgcaatttttacccctgctactctgctaaaactgtggcaactgaacgaggttgctctaatttacctctgatttgttctccatcagcacgtggcatctgacgaagacattctcctgctcccaaggtacaacaatttctggcgcatttgcaatcaaggtgctctctgctggatgcctgcaggtttgccggagtaactacagagagtgaaaccgaccagttcatcggcaattcatggccctctgaacagtgaacacccggaaccttcagaattcatacttcagtgtatccaagcttgttcagagtgaatatcaattgcgtctttacccagcagacaccattttcatcaagtctgcaatctactgatagcaattgtcaatgtgtgtgatcaggcaaacaaaactataggagtgagagcttcatgcagaagttccttgctgcaacgcatctgaccgcgttgtgacttgtaaacgcgtatagactctgctatactgaaaatgttttgtacttacaagagaaacttcaggttccttttcctgctctaattatagaggccaaatgacacggtagtactcagactaacgtgtgcatttaacattgacttgagaatgtgcatgttgacatagactccaacgaaaatttggtcagagtcgtaacaaagtaacaggtcggaacaacgaaatcacttaacatttctatactgaatgcataaacattcagtcaagtcaaacgggcttaaagccttaaacaatgatgaatcacatgtcaatttcccaagcacacgttgttttagtcttaaacaatcaaacaaatcaaataccacgtagaaaaaaaatcaacgtaatcctttttacaacctgagcaggattctgcttttcttttttcttcagcacatgaagaataagaaaaacatgaacaaaatctgatctgctctcctcgcagaaaagaaaaaactgatgtgctaatttgtttcaatttcctgatgaattcatcagaatctttatcaacaattaaaaaattgcaatgtcgagacccaatcccaatttcggtttaatcctttcctaactgaatgatatttaccattctacgcgcaggccttgccattggccgtgaatccgacggggaagcccatggctgcgcccgccggcggcacgccgtagcaagagccgccgctcccgctcgcgccggcgtacgccggagctttcaccggcggcggcggcgcggtgtacttgacgtccgtcctcctgacggtgatgttgacgatgccgttgcggcgcgtcctgcacccggaggcgtcgaacagcctgtagctgaggcaatgcaggtggcccggcgggccgacggtgaagtcgccgacggggacgctcgccgccgccaccgcctccacctggccgttcggcctcctccggcagatctcgacgtccagccagcgcgccccctccggcaacgccacccgcagcgtctccttccagtaggggtacccgttgcagtcgccgcccgattcctcgtcgacgcgcgtgcacaccgccgccgccggcgacgacgccgacgccgccgtgcgcaccaccgcgtacgcgccgcggccgagcgggcgcctcgtcggcggcagcacgacctcctcggcggacaccaccgtcacctccagtgtcatcgtcctcgacgccatttgcacgcggcgttgcgtttgcgagcttgcggatcggaaggaaaacctagggcacgatcggtgcggatcacggcgaccgctgcttatatcgagttgagacttgagaggttagaaaccgaatcggaaatttgaaagacgaactaaaatcggtagtatttgttgcgaatttacgcgccctttgatctgatatattcatggaagattagcgcgtggctggtttggaaatatacgagtaaatgggtaagacgtgttgatgagtattcggggttcgggtcacatgtaaaaatagtataaacgtataagtggtggaattcgagtgaaatttgggcggaatttgcagggaagacgcgtgtggaactgtggacgatatttcctgcgagtcgccggtttttggtagtttttgagtaccaagtagtttaacttttatcgtcgtggtggtcgtggggcgtggttaattaacccttttaccccgtgttgaccggcatgcgtcatgcgtgtgtcttccaccattggacggaatgtttcgcagaatacatgacacactttcagagctggcttatccgtcttaaaatataattcttcattccaaaaatctaaatcatatttcattctttattttttttcaaaagtctaagttgtatttgtagtcactatatgctatattaaattttttatcaaaactcaagaagtcattttaatacttattgattacatgttcattgattttgttacatgataaatgagttaactacaccttaatcttggtgaaaaagaaataggacttagacttttggaaggagggagtagcaatttttaaatgtggatagaacatactttagaactatgaatttggaaattttgcctagattcgtaattttagaatatatttagtattcaattcacttaaaggtatatttgagagaagctaattcgcgcgcgttggtgacgtgcgttttaggcccataaggcccacgcttagcctaagtgcatgcatgtttttaatggcgtccacgtacgtgcattcttttttttttttttggaaaagctaacttccacgcgtcatttttgtttctttttgccattttttcacaattttttaattttcgaagttgaatatttcatcttaaatttcagttgaaagttttgaatttgaattgaaagcttttaagacttgagttgagtttttgaattttgagatgaaagtttttaaatctgagttaaaagttttgaattttaagatgaatatttttaaatctgaattaatagtttttaaatctgagtcgaaagttttcaaatcatgacttaaaagttttcaaatctgatttaaaagtttcaaaaaatattgacttgaaagtttgttttatcccgaaagaaaaagaaaagatgaaaaaaatagaaaaacatgtggaggattttctttgtcgtgacgcggacccgttgattcctgccctcgcacgcaacttagcctatcgccgcgcgtgcacggtaggagccccagttatattttgaaacataactggaaaagccaaactggaagttttattttcttttgagagaaacaaaagcactgaagggtggacttatgtttggacgtgattttctttgcttgagatgacctctgatattgtttccatcattccatggttcctatttgaacctccgaatttgaacggtgtttgtaactctgtatgttcgtacttcgtactgagtggagtagagtgcaggctcggatatgaaaccatgcttgactgatcagattgctctaaattattactccctctgtccaaaagagtttaatactgaaagtgtaggttcaaattcatctttagaattgtgttttttagggattggtggagtattgatttcacagctcaaattggtgtctcaagtatctagagttgagtattcagctgtttggaaaatttagcgatggaacacaaaaaaccaaatacaaaccaataaaaccattacaacatcacacatgattaaaacttttttcgctacaaaagaaaagcaaatgcgtgcacagctcaccatcatacactctgctcaagtccatatgcacacacacctaagtacgcgagcatttgatgaagcagtcaaggataaatcaacaaccatagaatagctagttcatgctaacctgttcatagtgtaccctgggatgagaatccttttgtgagcggactttacaccaacactccaccacacaccaaaattaatcccctcataattaatctaaccacacaatatttgatgaaatctgcacaggaaagtttgaatatgtttggtttcttatagtatagttctcccactttctccaacacataaataatcaccttccatcatttcaaaaaagtactgttattctctatttcgtcatgctcttttctctgtgcagataccaaagtaggccacatattagcaaaggaagtgattagcttgcagtaaacccctttttttaaaaaaattactcatcaataatgacttcattgtgaaaacgttgatatttttaactaggtatttaagaaaactgcaaaaagaaaagcaaagaaaaaaaattaaaagaacagtaattttatccttcacatgggtatgacatgtggatcacacttgtctgtgatataaagttgtacctttctggtaaaatcatatgatattatggtgatttatttttgaaatacttagctaaagctgtagcatattattattttgataaaatagttgcagctttttgaaattttatgtacattaatgcacatagttagaaattaccaagatcggttctaaatagtgaagttagcatctcaacttattttttttagataatgaattttttttattaatctagcctctatatcacacaaccataacatacaagttcttagactccaatcctcatgcagaggaaaacacacaaacacaccaacacacacacaaagcttgaagagttagctttaaaccttcaacgatgacttgaactttccgccgcaacccgagaggatggaaagggagaattggaactagtcccagctacccatcaccgcaccatctccgcctccgtggatcacaacaccatttgctgttgtctgccatcaccatccaaaaccccttacgccactaccgcattccgagcgtccccagtgcatcacgaagttgctctgttgcaccaccatcatcttttgcagatcgtcgaattcaccaggtcccatcgtttggcttattcaggcatatttgcaaacgaaaaataatttgtgaataaaacttttatatgtgtgttcttaacgatctaaaagcaaaggctgaaaaataaactttgatgaaaatatctcaaaatcaactccaaatttaaggttgaaaatttaaattttgactactaagaataagtataagcgaaaaaatgaggttgaccatctctcctagaatgacatggaaccgaccagaatgacatacacctgcctttaccgccgtttcccatccttgcctggctatggtcaaatatgggtgggtatgtcgtggaaacatacattttgataccaatactaccttcatctttatattgtagaatggagagtacgaaattacgtgaatcaatctttagtttcttttattttagatgtgagaaagtgtaacaagtttcgtgttgggatgttcaacaattttaagacacatgtaggacgaggcaaacgtgaatactccgtgatatgggcaacacatgtaagaacccactagtttacgcaacatctctgacgcctcgacgtggcaatgtcgtggacaaaattattagtacggagtactactcgttgaagaaacgcagcaagaaagatcgatcgaaaacagagggggaaaaaataggccgggccgtgcttacctgacctacagccattcgacgatgcgtcgctgtctgatgccatgtagtacaaaatacgagtagcttggaagaagaaaaatggggaacaaaagggcatccagtgccttctagtggcgatgacgtccgctgcctaacgttggctaagccagaaaatatacgaaattgtgagtaatcaatccctctctgcatggacccccccccccccctaggattgacatgattaatttgcctgacagccaaatctagcgctatgtggttcactacgtgtgttcgacacgaccctctgtggtcgacgacccagtcggtcaaaattaagaattgactcaacttctacacgcggcgtttggagatgataacttgattagtggattctgtgaacacacgattccatttccaggagccaaccatgcaaatcacggctaattgtttggaaggcctttgtttggttatggactttttccaaaagttgtactaatatgatcccttctctaaaacaaaatcacggttaattgaggctttctactctacggggctattcggcaggcgagggcagcttgctgcattgttcgtgttgactgcggctacccactagcatccgaataacccctaaatttcacaactatttctagcagcaaaacttatacatgcaagtagtataaaacatgcatgctagtgctattggatgatttcagtgttagcccttggatgatttctaatgtgtttactcatatggattgtaatcaaactgtgttgggtaaataaagaactaaaaaaattgctaaaaaggaacttgaatagtgacaggagaaagaagggggagtatatatcgccactatttctagcatcaaacctaatacatacatctagtacaaaacatatgctagtgcttccgccctatgtcaccaccatttttggcactaacacctaaaacacttgtaaaactgaccaaactgtgcacctaagaaaacaacagtttgaggtgagcaacttaataaacaccacaccatcaaggaaatgcacttctcatttccgcagcaggcagccaatacactggtaaacccaggttgcaattaccgccttaccggcatcctgatggatcttacgctgatgatttacaacaacacaatcaagagaaagaggcagacggattacaaggcgatcgatcgagagacaaggtgagctctcatctgttcttcctcgccaagaagcaaaagagcatctagtactactagtggtagtaattattatttcgccgctaattacgtactaatcataattagttgcttataatagtgtaggggaggggcaattaagtaatataggggtctagaagcttctacagggttgggggggccaactcacctggagctggacccgtcttggtcggacccggccctgtccggcccgttgcaagtgggcctgaccgcgtggtacatgggggttggccggtatatgggccacgggtgcgactccggcgacgcctccgtgctgcttccgccgccgccgccggcgggatgcggatccgccgcctccggcttcacgtccgcgccgccgtgctcggcctgatcctcgccgccgccgtcttcgtcggcggcggcggcggcgtcgtctcgcgtccgcttcaggccgatggagacgccgaacagccgcgcgctcgggtcgggctcgccgtctatggcgagccccgcagcggcggcggcggtggccagggcggggcacgagggcattagatcgagtatcgccggggggagaggcggcggcgggggaacggcctccgacgactcgccggagcagttcgctatggaggatatccccgcggagccctccacgtgctgggtggcggcgtacttggacatgaggaggaggatgttgttacagagcttcttcatgtggccgagctcccgcgtcagccgcgcgttctcccgccggagccgctcgttctcctcgcccatgtcgccgccggacgcggagccgccgccgccgccgccgggcgcagagccggacccagacgcttgccggtgctcctcccccgacccagagtttgacgacagcacctgctcctccgaggagtgcgccggcgagcccgcccgcgtcaccggcagcgccataggtatcggcgccgcggccaccgtcacagctcccgaagccaccgcggcagctgccgtcgccatccccggcgacggcggcggcggcgccgcggcagccgccgccaccaccttccggcggtgtatatcacacaacaaacgcttctcccctcgccggaagcagtcgttggcgaactcccaccggtccggcacgatcttcctaaatccctacgtcatacagcaagcaagcaaaatccagacacatcaccgacatggccaaaccaaaccaagctaaatcccaagcaaacgacgacgacgaggaggaggaataatcccgggggcgcgtacataggtgttgagctggcgcacgaagctggagaagttgttgtgcttgaagtacttggggaggaggtcccgcgcgaactccgccggccgccacaccacgaacgtcgacccgtcctcgttccacgagatcacgtcgtccaccgccgggtcctccaccagctggtacgtcttcgtcaggaacggcgtcggcagcgacctctgccccgccaacgcctccgccgccgccgtcatcaccgccgccggcggcggctccccgccgcccgcatccgcctcgcccgccccctgctccgccatccgccggggaggcggccggatctgatccggcgaggaccgaccgtagtagtagtagcttccagatgccggaagaaaggcagttttcgcgtgtgaaaacgaaggtacggaccggaagtcttctggaaacttcgtttgcggattaggaaaatttatactccaacgggaggaggagaagcaaagcaagagagaaacaaataaaaaagagggaaaaaaagcaccaaaaagaaaaaacgattttaaagagaaaacgcacgtatgtgggtgttaagattcagttgtgtaaagttttgttttttcgtgtatatcgggtattatatcgttgactgtacgtttgggtactaataaaaaattaattacagaatctataagtaaatagagagacaaatttattaagcctaattaatttgttattagcaaatatttactgtagtgtcacgttatcaaattatggagcaattagatttaaaagatttatctcataaattagtcacaacctatgtaattagtttttttttaagcttatatttaatactattttatataggtgttttagcgttcgatgtgataggttgtgtggaactaaaacatggcctatgaattcgatgcgacccaccactcgtaccgagaaagccaagctggcgccggcggtgcaggtgggcccggccgcagtgatagatatctctcgcccccgcggcgggcgcatccacgccgttgtatcggaacccaccgaggtggcacggatggccaggatgaggcgaggccgcgggattgggttctcggcggggggatgatgggatggggatggggcaattgggggtcggaaggggcgagaaggttcggtcgatttttcgcgcttcggccttctggaaggttcaggtaggcgcgcgggcggggctggatggggcccacggtagacgggacacgtgtcgattgctcggccacggatggcgagtgggataagattttatctcgtctacgatacgacgtggcctttttttttatttcgtgtatgtatacactgtactggagtactttggtatttgtgcgtttttgtttgtcgtccttttggaaggttctttttctttcaatcggcttctagagagtaaggctcacattggatagcctaatcagctaaagaaaaagccaaattttaaattttcaagcttaattttgagattgattttgatatattttcaatgtagtttctttttcaacattagcttttaagtcaccaagaacatatttataaaagttttagctacaaatttatttttatttcctattggcttattaggaagtaagccaaacgatgggggcctaaatgcttatctgccagaggagaaaaaaagtccggttttcttctcttttttttcaagagatgcacaaggtttaattggaatggacttaaacaagaggaggggaccaatgcttgataggagtagtacttatcaaaggagttactagttcatttataaatgaagttaattgaaacttaaactaaattgttgaggggggaggttaccttttaattcaatgaaactatgaaattagaaggaggctgaagcatagtaaaaaaagccggaccggtgggtgacccagccgacctctcggttcagcggtccgtcggtccgaccggtgacccaggcggttgaactgcggttcacaaactacatgtatattacatatttgctcatgtacacatgtcgttggatggcctgatggctagcacttggctctttcaacccccggaccagagggttcgaatcccacccagtgcaccatttcttgctatttttgctaaaaaaaaaaccactagctgcaccattgggcctttagacagcccatcgtggcccattagtatggctagccggtccaaccagtgccggtttagtgtccggttcgccgaaaaaccgccggttcagccggttcagagcagttcgattacatgtccggtctttaaaggaaaccgaaccgtggtcacctctggttctagttttttctactatgggttgaaggactgaatcttagtatagtggtactacatatggcttattacttagaaaaggaggtagtgtccaaaaagccttctttgtaaaagatgacaatcaagacgatactaataatgacaactgtgtctttttctcacatttgtatcaccggttgatcattggataaattactccctacttgcaaagctaggtcattcgccaaatataagtagggatgcaagtgggtagtcccgctatccgcataaaaattcgcttgcgagttcattttccacatggtaatacaaaatttagaagaaaaaatgaagtataaatgagataagcaggctaaaaaaaagcttgcctgccccgcttgcatccctaaacataagtttgcatataagtttgcatggtgacaaaccaagaaagatgtttgagcatgcacaacttaactgctaactttgtcccataataattgtatttaaaggacttaaatttgttccaaaataattgtcacagtagagtactaatggtcccattgatcacttctctctactttaccctcaactacccttccactcctatctatctcatctatatataccatttaataaggggcattacagtctttcttctcaaaccttggctctgttcggcaacgctgctatgcagctgtaactggctgcgctgtacagccagtgcatatattttctctatcatgcactgtagcgcagctacacaacaactacaatttagctgcagcgaacagaccccttaatatttactaaacaatttggattacaattattttgggacggatgttgtacataaattcttccttcaattattctttttttcgggggggatcttcagttattctttcaacaaattcaacaaagcatttctctttgaattttttttaaaaaaacatgaatattagggaatgatctaatattaaataattagaaggggacttcgaacccaggccgtctagcccaccaccttatggagctaaccggaagacccctggacgtttctccctctttgaaatttcatttgaagcatccatctgagcatttatttccccttcaaaccatgtcggatgcaaatcaacttggagcaaacaattagcaccactggtgttagataacaagccctgggcaattatggtttgagcttagcatatctgtgcatggccaaatgggttggtaacctatgaacaatataaaaaagaggaatgtggccatcagttgcctttcggcttataagtgttagccaataaataaataaattttcaaacatagttttagagttaattttccattcaaaacaattagagttatttttttagaggagggagggggttattgtagtttatttttcaatgtgatcttttaaatcgtcaaggacacgcgtgtacaatttttaatccacatattttttgctttaggccaaacattgctttctgaagttaggtttacaactagatgatacgagagtactattgtctttaatcaaagtgatgctaaacttaaccactttagtactccctccatgtccaaagctagcatcggggagtcaggagtaaaaagatactccctccatctcaaaaagtttgacgctgttgactttttaaaaaatgtttgaccgttcgtcttattcaaaaaatttaagtaattattaattcttttcctattattttatttattgttaaatatacttttatgtatacatatagttttacacatttcacaaaagtttttgaataagacaaacggtcacacatgttaaaaaaagtcaacggcgtcaaacatttagaaaagaagggagtagtaaagttgtcaaaatggaaagtaagccaccaagtcttttctccaaaaatggaaagtagaatgcagcttgttcaactattgtgagagttatgtccccacgttcctacattttcgtaacgtaccttggccttgtttagttccagagggataataattagctctctaaaatcttgctatttagagtatttaatagagtatatgtgcaaaactacttacagaacccctaggctaattcataagataaatataacgaggtatattaatctatgattagtgaatgattactgtagcgaatcatggattaattaggctcatcagattcgtcttgcaaattagcctaggggttatggaatgagttttgtcggtaatctatgtttaatactcctaaatagtaagattccagagggctaattattagccctccggatccaaacgtagattaccgacaaaactcattctagccaagcctgatttgttcatgctattgatatattcgaggtgttaagcaatattaggggaaatttgtagctgtggtgatatttaccaggtgtagcggcgacgaatggtgatattggtatacacaggaatgaaaattcgagaaatatgtgttaatgagccgtatggagaaattaacttattaatatagactactaaatagcaagatttcagaggactaattattagccctccggatccaaacaagacccttatccttttgcatctcacttgtgcatgaatgatactccttctagccaagcctgatttgttcgtgctattgacagattcggggcgttaagcaatattaggggaaatttgtagttgcggtgatatttaccaagtgtagcggcgacgaatggtgatattggtatacacacgaacgaaaattcgagaaatatgtgttaatgagcagtatggagaaattacttattaatatagtagatttgctcaatttggatagaaacaaggtaatatagttgcatggattgtgctagctaatgtttaaagacaaaaaggttgttggacaatcggactggggtgaagacaaatgtttcacctagaacttgaaaatgccaatgagatgacaaaagttgtttggttatttatatcccttcagatctttctttacacttctatttccaaaagctgcaagtgtactgtgcatacaaaattgacaatggaggaccaatgtttcccgtttgttagtacgtttctgatacaaaactaacaatggagaacaaatcccgtttgttagtacgtttctcattgtttgccaggatgatgtctatatttagtaaccattgacacttttatagtacacactagccaaattttgcattcctttgcgatgattttaatgatttgggcaacacttttcgtatttgagtaccaaatcatgtagcattagacacaattgcgtggctagaaattactaaaggctagggtagggctcgattgatggactgttgatttttttttttgtaaaatttacatgatgatttaaaaaaaataaactttgattgtgaaggtcagcttatggctcaagccttatctgcgttaggcctgcctccacccctgattgtgtttcatctttcatggatttgtggctttgtcaaatggattaggaaactgagcacttgagcagtcaatactattaagcagacaacataccgtggcccatgggccaaactaattagtatgctcctggcagtatagaataaatctagcccagcttagggcggcacagtccaatccaatccaaaaacgagccagtgaactattgttcaatttgatcttgctactagtatagtatttaaataaacctgattaacatttgccagtatctaaaatcacaacggattcgactaaataagaattggtatactccacttaagaggcacgcatgtcttattaacattttctagtcacacagttcataagaccatggacaattttgatactagtactatataagtggtaatatgatcgccctaattctgctcagcattggcgctgtatccgtacggattcttcttggcccaattccactggtccctgcacatgtcctctattccaaaccgagcactgcaatcagcacaagcataaaacaatcagcatctctatcataagcacaaactataactgtcagttgaacagtgagctggaaaaatggacagacagatttgtgtgatcgttctgtagcgaatcagagaataaattacctccatccgagctccttcttggccttgtcagtggaagcgtaaacctcagtgcaatctccaggtcttctggggcaaatcttgataggaattttctgtggtttcacagccagaaacgtcagtttcgaccacattttcagattgggatttcagatgaggcgaatatcaaccatgcacacatggatgcataaataatactacatcagtcacctttccggacgcctcctcgaacgccttcaccacctcgagcaccgttgttccacaccctgttcctagattgtaagccacacaacctgacagaagaaaataaagaaattatacatcatggatgaattaaacttgtcaaacatcaaccagtttatggagtgaagaacatgtgtgtttgtagcatcgattgatgtaccaatgtcaggagtagcgaagagcttctccagtgcggcaatgtggccatcggcaaggtccactacatgtatgtaatccctgatctgaggacgatatatcaaattgtcaaaattttgcttcgctccacgatctcatccatacaaattgatcttgaacagtgtagtgctcaccgcggtgccgtccctggttgggtagtcgacgccgtagacgttgagctcggggcggcggccgacggcgacctgctggatgtacggaagaaggttgttggggatgcccctggggtcctccccgatgtcgccgctccggtgagcgccgatggggttgaagtacctgagcaggatcaccctcatctccgggtcggcggcctgcacctgccggaagtagttctccaggacgagctgccccaacgagagaatcgaattcgatgccgttagaaacaatgcttgcatagcaaaaaagcaatggtgtgatcatcgccatcgcaattcggcatcgtaatcaccgaatcggcgaagcgaatccgaatggcgcgtgacgggtgcatgcttatcacgagcaatggatgcgatcatgtcttataccttggtggtgccgtatgggttgagagcgctcagcttggaatcctcgacgcagggggtcttctccggctggccgtacaccgtcgccgacgacgagaacactatctgcgcgtaggtttgttgatttcagtgatcgaagcatgcatcggaatggaatcaatcaggtgatcgtgtagatgtatagtactgaccttcttgcagccgtacttggtcatggcggagtagaggttcatgtgccggcgacgttgttctcgtagtacatctgcgggtgcgcgacgctctccnnnnnnnnnnnnnnnnnnnnnnnnnnnnnnnnnnnnnnatacctgatcgatcaatggacgacgacgacgacgacgacgcgtttgattacgtgtggaaacgaacgagttgagatcaaaatcaaaaaggatttgagttagatggcttgtttgatcgaagcaaaacgatccaatccggacctcttggcggcgaacaccttctccatgtcgtccttgctcttgagatccccctgaaaacgaacacaaacatgaatctcaatctcaacctcgccggctcggttcaattcaactgtgcaagacgaagaacacgcgtgctgtttgggtgagtcacgtacggcgatgaagtcgaggcgggcggagagggcggcgccggcgatgaggcggacgcggtcgagcgcctccgggacggagttgtggaagttgtcgacgacggtgaccgcgaaccccttctccagcagccgcagcaccgtgtgcgtcccgatgtaccccgctccccccgtcaccagcacgctcgcccccgcacccttcctcccctccccgttccccaccatctcgccgttctccgccgctactcctccgccgctcaccatcgccgcctcgtcttcgtgtgtgcgcctctctctctcggtttagtagttcgcagcggacgcgggggggatttatatgggaaagggaaaccgcaccgtgacggatcacgcgcggtgcggggcggtggcggcgtccgttttttctcgtgtgtggggagccgggtggatggatggatcgcgtgctggtttggaaaataaaacggcggggatcgcggcgagttcccgtgtcagctgccgtgcgcccgtgccctttttgacccgtatcaacgctggaatatcccgcggcgcgcgcgcgagccgtgtcagctgcaatggtaatggccggttgcatcggcgcgtccgcccgatcggcagtgcacgcatcgccgtcggatcccaacggagattaatacggaaggggatgagtgagaatccgggggctaactgacggtgagatatactgtatcttgtgcgtgcgtgcgtgatcacggtattctgcgagtaggcggtagtatgatcgaaggataattgcgtgtccatgtcatttgtatttggataagtttatccaaataagtttatccatggtgtttagagtgcacgtcgcttgatgacgtcattaggatatgtgttccgataaaggggtcaatttaggcctgggccggggagatcgattttttttttcgcgaacannnnnnnnnnnnnnnnnnnnnnnnnnnnnnnnnnnnnnnnnnnnnnnnnnnnnnnnnnnnnnnnnn

SEQ ID NO: 54157 - DNA, 13320 bp, Oryza sativa
cccgtgcctttttgacccgtatcaacgctggaatatcccgcggcgcgcgcgcgagccgtgtcagctgcaatggtaatggccggttgcatcggcgcgtccgcccgatcggcagtgcacgcatcgccgtcggatcccaacggagattaatacggaaggggatgagtgagaatccgggggctaactgacggtgagatatactgtatcttgtgcgtgcgtgcgtgatcacggtattctgcgagtaggcggtagtatgatcgaaggataattgcgtgtccatgtcatttgtatttggataagtttatccaaataagtttatccatggtgtttagagtgcacgtcgcttgatgacgtcattaggatatgtgttccgataaaggggtcaatttaggcctgggccggggagatcgattttttttttcgcgaacaaactaaagaattggacatcattatattataagaaatcagagttttgattacataacgcaaaacggatggtcattgtcggggccagcgagatcgagattccgagacatttatgagaatcctaaaatagctggtttttcttggtttttggtttctagtttattattttttctaagatttataaccacagatttgagtgataatgtaagtttctttggcatcttctgtcggtagtttctcaaacctggtcttaaaaccgtggcttatgatgcaactaaatttgatttagagtttaatttagacagattcttttgtcgctttcaatactgagcttttgccttgaaaccatgtgtacaaaagcctttgccataaaaatattttcattgttttgttctcctgttttcggcttataaataggcaaacctacaggagcgctacagcaaggcaaagagcaaaaggaaggtgggctttactccccactgtgcagatttcagaaagccgtggagtataagaaacaaccacagcgatagtttaatgcctggcatcacattcttgctccttttttttttctctcttcctctatcatggttggctacttgaccattccaagacttagaccctatttagatcggactaaaacttataagtccctatcacatcggatgtttagacactgattataaatattaaacgtagactattaataaaacatatctataatcttagactaattcacgagacgaatctattgagcctaattaatctataattagcctatgtgatgctacagtaaatattctctaattatagattaattaggtttaaaaattgtctcgcaaattagctttcatttatataattagttttgtaagtagtctatatttaatactctaaattagtgtctaaatatagagactaaagttaagtccctggatccgaacaccaccttaatcgcagataagcaaaggtacaaaaactaccaattgcaaggtgacggttttgatgcccaacaataattggatagacacgaaaactgattccctatcaatgcagaagatatgcaaaatcagaacaaacttccttgatgcctttaaatgggatgattctctgtgatgctttttttaatggccgtaaaataccgccagcgagatgacgtgggccgtaataacaacttactatcatgccctttccctgtgtttcttaatgggctggaacgtgcatccagggatgacaaatgggccgtaaagcccttttatctgtctttcttagtgggctggaacgtgcatccagtgagatgttgatgggccgtaaagcccttttatcatctaacttttttttttgccggcgtctccaccgtccgccgtcgccggcgttgccgatcaagcttgccattgctcgccgtcgctgcgcctgctttgcgaccggcacatagtgatgctttcaggaagcatacgttacgtacgtgcgcgcacacagtacatcccggtagaactaaagttttttatccgctgctgaagtgttgattactgaagtcgtagaaatggtttcatttcctgtgctgtgctggcgtgctgctgatgcatcgaaatggtagctccgttcagttgttcgcagatgatgtaccagaaattaggtgttcactttttttcttagtttaacttttataagtttgatcaagtttatatattaaaaaaaatagcagcatctaaaacaccaaaattagttcattgaatctaacattggatatattttgataatatgtttgtgttatgttgaaaatgatagtatgcatttttttataaattttatcaaatctaaagaagtttgacttaaaaaaaagtcaaagcgcttatgatatgaaacggagagagtacaactagaatgcaacaatggtcccagcaatggccactggttacttcttttctgtctcagtccatacccagatctgaatatacaatgtggccatccttttgatccaaccatccaggacaatgtcaaatggaaaacaggagaaaggtaactgatcatggggtctaccagatcaatccaatgattaaaggctgagcgcaaagagaatggtaaaaaggctatgcgagtgtgataattcccagagaaaagcatatgcatctttgcagatctctcccacatgcagaaaggtacgaagtttccttggatggatacatatggtggagtcctgacaagctgtcattttacaatgatcaggtttggagggaggatctaccggtacattatacctgatgaaaatgaaagcaaacaatgccatgccgacagtctgccttgtctctctgcactattcagtctatggatttcatcatagagaaaacagcccatacaaaagaagtcttcaccactactgaaacttattacattatattgtgaccagtaagaaaaaatattgataaaagaaaataaacagaaaataaaagcactagaatgtgaggtatcatattcaaagaacagtaagtatctacttttgactccaacgattcaattatcacatttccatcacatattcagtttggaatgtagctcaattgatcatgtgaagtgtggtcttaactgaatcagaacacgcttcagaggtacatatctatatcaaacttattatggcgaagagtaaagtttaaattatgcacagttctgaaccaattatcgacgaagagcggtatatagtcgccatcacctctcacgctttctcttcataggcagcaaggttttcggtttctctgaccgtacgttcactgatccttcatcttcaatcaggcgtctaccaaggtgtgatgataaattctccacttcaattttcgccacatcctttcttactcctatgtcagtgatgtatctaccagcacagtacatcccagctgtgacagtggccattccaagtggaccagcagcaaaaagcttaagtggagtggacagaagagctgccaatggcactccaatggcggaagatgcttgcccacttgttccaatgccaggttcctcaacaggaagaagcccagttttgcagtagagtgcaaagtcctcgcaattgttctcaaatatgtcataatttccaaagccattttgaagtaagtacatggctctgtgtaccacaacttctgatggatctgattgggcaatggtgcaggttcccccacgcagctttgcaaggaaaacggctgatggcactccgtactcgaagcagtatagagagccattccgaaggaagcaatccaagcaggtgaggacgacaccactatcaggcagctgaaacccacaatctgggaacgttgggcactctgatgaaggctctaataataggctggaggtggaattggatgaatctgatccttctgcttctttctttcgagtaaaatgaaccactttacttcctccaacataaatgcctgtttgccagtagaacatgaccaacagaagagtaagttcttgaaaacatttcaaagaatatgcaattaagggaacaccaaggctataaagtttaaggtgaacaattaaatccactggatgatagttatcatcccaaaaggttaaaaaaacactagatgataactgaatgaatcggcatgctgttaacctgtcaatccctttatcgatgcatgaaaaatgcaccttgatggtgaaaatagtgttttaaggagttgaatgcagacaagacagtttttcttgtatattgcagccctttcatccaggctgtcatgtgcaaaaacagcaaaacccacagcatgtcctccctagatgtggccctgatcaaatgtccacacaggaccactacaataaaaggagctctacatccgccaataaaatgcacttgaggggacatactgtccatttaggagaactacagagtgcatagcaacacagagcagaagtgtcctttacgcttcctgaatggagatgaaagacctctactgtaaaagaaaagagatgcattgcaaaatacccatggtaaatacacctgaactgaatggagatgaaagacctctgctgtaaaagaacaaagatgcatagcaaaattactgtggtaaatacacctgaaggtaaggataaaaaatgaacgtagccacgtagataagtttgacatcaactgttaatcaaagtagttatcaacttatcataggatactatggtgacttgagttttcagctactgaatcactaatagtacaatagtgtactaaacaagtcatttgtcaggttcagtacattatagaaccaaccttacagtacttattttattgcgagcaaccttgaattaacaagagggattcctataaaaaaacaagaggctaatttccacacggagataaaaaaagcacagatacaaacagacaagttggtcagcagtaggtgagcagcaacaagtgccatttgttctacatgggaagcaacaaacacagcatgtggcgtcagatccatctggaaggatttccggatagagtttgggcaattcagttgaaccctcaattctacgcataacccacacagagaagtagaaacattgaatcgatctttttcatgcatgtacccattttgccactattttacagccatcattctaccatactaatgttgtcaactctacacctacagaattaattatgaactgaagatagtacaaatgcacgatgatttgcgtgttactgctgagttctactacgaatctgtaaacagttaaaagtctgaacaatcactcaatcagagagttggatgattgacgcacttgtccaaccaaccacgtgatccgtacttcaagcagaggggtttgctcgagaagagaacatcacgcaggaagtatgaggcgaaagaaatcccaaatccgacagaatggaaaactgagacgaagacacgcccttcagttaccgatgaactaagcaagagacaaccccaactcgaaaattcagatcgcaaatgttccccccattgagccggccgaacaaaatttccagtccaactaggcaatttcgatcgcatttgttcctgacccagcaatcgcagtgaaatttccgatccagtagccgcacagaccaaaaaaaagggggaaaaaaatcccccgttgactcgccgagccagaatttcccggtcaagtcaacaaccattgatcagacgtcaatcgcacgagaaaattcgaagcagcgccggaggaggagagccacagagccgccgccggattagttcccaaacctaaacccgcaaccgccgccgccgccaccattggcgagtggcgacaacaattcaagcaaccgggatggcatccgaggaggaagaggatggagggggtgggcgcgcgcgtaccgtggtgggagtaggcgtacaccgccctccatgtgtagatgtgatcccccggcctgatctccgaccgctccaccctgttcgacagcagccccatcgccgccgccgccgccgcctcctcctccaccgcgtgtcggcgccgccactgtacctttctacccgtccatggcagggtgagtggggcggccaatggcgcggggctctccttataacgggaggaggcgcatgtgatgtgcgcgagcgagagcgagagcgagagcgcgagggcgaggcgtgggcggagaggagagggttggggttggggttgggcaggtaaagaatgtcgctgtcacggcgcacaaggcaccgcacccgccgttgcgtcgagacgagtgcgtcgcctcctcggcttcggtcgctgggcttccacttcacacccggttccaccgggctcggcggctcgaggaaattatgcgggtaacggcgaggaaatgttgcgaaaatcacatgcgtgacggcgcgcgcggagtaggtgaggttaaaaaccggcagccgtggatggggggaagcctcggatcgtgtgcgatgacccaaaggccaaattaccctctctctcttttttttcttttttttttattttgcctactctcggctgcattgcacggacaacttgttgagatgaacagcctatggtgaataatttatttactgatgttactacaggtgaaactgcacggtgatgagaaggtgaagaacaatcaggcgaggttctcgtgcagttcagctgtgcaggttggtaggatgccaactccagtcacgccatccgccgtggacgatctgatgacgagctcacaacatccaccttataagtgacgaagtcaaaaattttttgaaggctatagctaagatataacttaactaatggagcattgattttcctttataaaaattacacggtattttaataaaatttaaacaataatttaaaggtaggcctagagctcaagccctagctatccgccctgaccctaccggagtaccgggcacctggcaatctggcatggactcgctgatggagtgatggagatgtcactgatgtttctttaaggtagtgtttggttggtgggataggatgtgatgggatgggacgaacccacttttaaaggtgtttggtttaggggtgagtgggatgggttggttcctggacaggaatattcctctcagatccggaaccaagccatccggaaaaatctcgtggacgagctcgtcccacctgggacgagcgcacggcgtgaggcgcgccgcttcgccacgctcgttcgctcgcaccgtcgcacgccactcgctcgcccctctcactcgcatcttgctcctccacccatcgtgagtgatgacgatggcggcagatccggtggtggggagggtggcggcagtgaatctgaaggcagggagggcggggagggctcgtcatcggtggcgaatccggaggcggggatggcggcggtggcgaatccggaggcggggagggcggtggtagcgaatctggtagcgaggagggctgcggcggtgtggagggctccgatggcggcgacagtgatggcgggcaagggtgagtgctccggccaccacttccgcatcgtcgttgccttgactcgctcctccttccgcccgcgccgatggtagccgctcctccttccgcccgcgccgccggtcgcccctcctcattccgcctgcgccactagtcgccgctcatccttctgccactctacttcctccgcgagttgcgagctgcgacacattttctcactaacgtggtgcaacgtgactccatatgtcattcatcccatccctatccatcccttctaccaaacaaaaattgagatcattccatccaataaatcaaacaagtaaatgggattactccatccctaaaactagggatggtatcatcccatcccacgtagtccccaaactaaacatatgctaaaagatttgatcaaaatgaactgacgtttgtttagacggaatgagagtgatgatttcgacactgcactttagctaaccgaataatgatggtgccaatatgactttggaaaagttgaaatgaccaccgatcgaacactaatctcttattatcatggacgttcattgcaaacagtgtcagcatcccatagtctagctgagaaacaggagataattaaattgagcgatcaaatcatcgaaaactttcttttacctaacaatgtcgatataatacgatgggactaaaaaaatgcggcaaaccaaatttcatgcagccaccaatttgcaacactgaacatcattcggtttcagcgcgcgtcaaggactcgagtcgatcgatgtgatattcagttttagcttatctcttgcactgtcatttttctgagattttgcaaaataaatagcacgcacttacactgtaggagcgataggagtgcacagccatgcagttgatccaacaaaacggtaaatgctgcgcgccgggcgtccgacgttagaaggaaaaatcggacgcctcggacgcctgcgcctttaaaacgatttttctcttaaattaattatccaatctacgatccaatcacaccgttatattcgttgcaattaaatctttacaacaagaccacacatgattatatttcgacaaaaaaatattttagcttctctattgattttttttttgaatattgcatattatctgtttcgatgtttcaaccagtagctttacgatgtttcactatgtacggatcaaatgttgcagtggattttgatattatggaacgtgccgttgtgacaaatcacccacatattttgaaaaccccctattaagggaatttggtttattttttgttccacaaaaaatgtttcatctagtgtactcacaatatttcactatgtatagatctaatgatgtagtgaactgaaatattccattgcaacaaaaaaacgcacatattttggaaaccccctgttaagggaattcgtttcattttttgttccaaaaaaaatatttcacctagtgtacttataatgtttcactatgaatggatcaaatgttgcagtgaactgaaacattatttcgctatttgctgaaacattatttttatataaggtgaaataacacccgatttaaacgagtgaaacattttcgatatatttagtgaaacaattccgatatacatggtgaaacatcgtgcaacatttaaaaataatttaataataagctaaaaaaaatttcatcggaatatatccatgtgtggtcttgttttgaagatttaattgcaacgaatttaatggtgcaatcgaatcatgatttggataagtaatttaagagaaaaatcagtttaaactagtttttcacgtaaatcgggcgctgacgtcatgctgacgtcagtgtccgatttttctccgaacattggacatccgagcccggagttacctcccaacaaaacagatatggattaattggagagagtggataacggaagaagaaatacactaccaccagtgcgagtgtgaaaaccgggttaacaaaaacgacccattttccatgaaattgctaatggtcggtttacaaaagacggatcgatttagcaagttgactgaaagtaatcagtcttcacccgttttcgtcaaagagtggttttcacctctgaaacgggaagataaaccttggtggcaactggcaactcgatttacatattaaaaacaagcaattagaagatactgggttacattcgatgactttggagcttactattcagaggtcgagagatagaatttctcagtgaaaacactccagcattgcgttctttcactcgatctgagctgcactgcacaaccgtgataactcgatccggcaaactttgggagcagatatatgggcgtaaccaaggttgtcagaatcgagatactagacagtatcgttttgctcaaagtaatgtcatatcgtaggatcgtatcgtagtatcgggatactaagagattttttttaagtttaattaatatttatgttaattatatatagccattttgtataaaaaaatatagtaatgatatatatcatgtaaatagagatatttatcaagagaaaccacgtgggttttgatatatttaactgatttttatataaatttgagcatatttagttacattattttcaaaccatgttatttaaaataatattttgtagtatcgtagggatcgtagaatcgggatactacctaagatttcgtatgatcgtgtagtaatgaatagtaggataagatactaggtgggatcggtattgtttcggcttgataggatcgtagtatcgtaagatactaatacgaatcagggtactgccaaccttgccaaccttgggcgtaactacttgagccggaacggattcccacgtggagatctcctctagatgggcctcaacaaacaggccaaacacacttgcagtttagtttaggcccatcattctaagtccactaaactctcctggctactccaccgccgcacgtgacacgtcatacgccgcatccttcgttcacgccgccgccgcctcgcgctcttgccgacggccaccgcgccgcctcgccggtcgccgctcccacccttccacggcgaccggagccaaagacggtgaccggcgggcgcgacgacctaggggaatgtgtacctcacctaccccacatcgtccccgcacccgcattccctaaacccccaaaccctagcccgctcctccgttgtcggatacgccaacctgctatatgcgagagaagggcatccacaactgtttgatgatctccaccggagccgccgtttaccggagtaaccgtgcttacgcgtcagctggaggggtgacctcggattcggtggagggctgatggctccgacccagctggtcgatcgctgcggcggcggcgcccccgcgagtcgctgctgtgagcctgtgatcgcctgtgatgggggtgtccgtggtggcgcaggcgccatgggggaagtaactcatgagatgggatgtggccgcaggcgcgattgtcgctgtgatggcgcccttggctatgcttggggcgacgatggtggcactgatgcccctgcaagcggcttcggtgcccacgattggtggttcattcgtgatggtggacttgtgaccttgccaccgcctcctccgcaagacgaatttgtgatgatgatgcagcctatgatagtatgatagcacattcatcgatgactgcgatgtcgctgtgatgccgtacccacatgccagagctgcgatggagctgctgcctttgtgcgcaggccttccaccttattgacatggtattgcagccccaacaagctggacctatgatgccattgttggcacagccgcctttggccatggcactcctctactcaagcttcaacatctggactactttggttcgttctaacactccacctcccctgtactttacattggcaacataagacatgagatatttttaatgttgctagtcgtagctattattattgtcaggttgatataagcttcttttgtctaaaataaataaataaataaataaataagcaagaaatgaagtgagctgcatagcacatcagcgattagcctcttatattccttgtaatgttaagatgtaacccagtgattggatgtagtttcaacatggaggtatgcaatgttttgttcgttgttttgattgtagcttttcttaagcatgactgcaattgcttggtgttatctactgatcatcattgatctgtgatctttggctttgttaatgaactttagaatataagtgatcactgatcattgatctgtgatctctaatctatgtttttctggtaagcttcaagataatcttaggaacagttgttgttttagaattgaggttatgccttttccttttatgctttggcttgtacagtttttaaacatttgttcagtgtagcctacccttttcggttgttaagcaaaatggcacataaggttttcttgtagagtttcaattttgggttagggaaatgttttcaactgctcttgtgaagaaatttggaatgtctgtttggaccaaagagacgatgcaatttataatctgttgatggcgatttcacgtagatctgatcggttagcttaggatttgcatgatactgcattttttgccgctcttacttcatgcagttattgaaagtgcagtaatgcaatctcctgtttccttttaatattggagtatcatttatcgataggatgttttcttgttacacttgctatctcgaaccgagcaagagcattagtaattgccattttggcaattgtttggaaatttgtgtgtacacaattatagcgctgctgacagcatgatggttcaaataacttgccattctcagatggccatctattaatttttcaactcaatagccatatgcttatgtgataaaaatgaaccatacatattcgaaagaaatggttgtggttttcccaatactagtcaatgcctgtgtattgcaatggatttgtgaaagattaattgtgcatgtttctgtttttagcccattgggatggttttttgggttgtttttaaaaccttttttttgtggtgggtgggggagggggggggggaggcaaggatgtgccctgcatgtttatttcttcttgcattgcatgcggtggaggaaggggagggcggacgaacgattgcccttttaagtagtttagagagaaatttcagaatttgccaccgaatacgtaggcctttaaggatttgccacccaatccgcactcctttcaaaatttaccactgaggatgcgaatttcttcattccgtgccgcttcgtccacttgtgcagctgagccttctgtccttccgctggctccatcctcgtccatccgccatacacgcgaacccagctcggcgccaacgtcatccatccgctgcctgtgtcagcgtaatctgtccgcttcgagggtgtcgcgtgggcggacgtcacgggcaaggtggagctgacacgctcgtgttccctccttctctaacggctctcacctcccagcatccaccgcaggagaaaccaagctgcgacgcatggggtcccatcctccctcttccctctcgtcgatcccatcccccaaaacactcgagttacgacgcgggagagcacacatccgtggtgcaccgcgggaataggaagcggcagcggcggtgcacggactcccctcacccccattctctggctcctcacatgtgaagtgcggcgtatatgtccctcccaaaccctagaaattcgacgggctggtgcttcttccacacagttggctagcttgggatcggttgtggtcatagatggtggcgatgcacactgggctcgcaaagtacgttggtggcagatggaagatgatggagccaatgcaaaagatagacggcatgacttcacgggcaaacggagtggtatggaacgaagaaattggtaccgtaagtggtaaattttgaaaggagtgtggattgcgtggcaaaatccttagaagcctgcatattcggtggcaaattctgaaattcttgtttagatatgcaccatacacattcttaccatgatttgcaga

SEQ ID NO: 54158 - DNA, 22474 bp, Oryza sativa
  unsure (1)..(22474): unsure at all n locations
ccatacacattcttaccatgattgcagagaacctaggccattggcgaagctaggatttaaacttgagggggccaacttaagctcattaccgagtgacaatgaccataaaaaagttgcatcataatacgcacaaaattgaaacattttgacatggataataaatcatatgaatatatttgttagttttgaccatacaaaaggatgttttcctgcctattatttagtcattggctacatacatattttttgttttgaagattttagtatttcaaattaaagtgaagaggtaaataaaaataagtattagggcttacaaaaaaatgcatatttagaacacggtatgcggacattggaacaactgagctgtccaagtgtgttgtgttcttcgtgttagcttgttaggtctgcttagcctaggaagcagtcatcaccatctaaaaacgatatactgctatgtctcccaaataacttgtttgcatgcaatcctagctggtagtggtagcattggaagcctgaatacgccaatgcaccaagtacatgacataatcatgtatttgatgattaattagccggtacttaagaaaaaaaattcgccgttgggggaggcctgacctccctccacccctccctggctctgcccttgacctaggctttttctccacattaatgtatatgcactttcatgatgtattatttgatcacctccatcttgatggacacactctaaccccatgtcatgcaacaccacccggcacatgtaactgacaaacaacacatgaatagtaactgccaacaaatcactacatgtttttgcacaattaagcccattcaatccacaccaacacacctctatcaaagaaacatccaccgtatacgaatatggattaaaaaacatataccaccggtaaattgtgactcacctaatgcctccccagttactgaccacaccactgtccccatctcagtctcatcttatctgtgcctttttatgtgggcatctggtagaggtgctctcttcatctgcatccaccatttcattcaccaactaagtaggcctttttgagctaggtggttggttggccttggccttattaatttttcatgtggtactacaatatgccattatgtccctaagttgtgtccttcacattttatttagtatctatgtagttatgtcttttacatttatttacatagttatgtcttttacattttttttacatagttatgtcttttacttttttttacatagttatgtcttttatgtggttatatgatggagaagaagcttccgatttgtctttcttgccgttttgagtttcttttcttgtggtcagagcagaatgcaagaattaaaaattaggtgagaaatggaacagaaattttggatttaaactttgtttcttctcttgttgttatgccctctgatatttggccatggccacacctcaatgttttccaccactgcttctaccatgcacctgcagtttgatctctcattgttctgcatttgatgcgtgcgtttgtagcagttgttgccttgttggtactaagttgttgttgttgttgttgttgtttcttcaatgctcaaaattgcaacttgggagataaagtttggcggagaaagagaagtgtgagaagaaatatcgatcctaataacaatggatgatgcaataccggcaattttttggggcatccaaaatagttttgactaatcaacccatgttaccctgaaaattatgtggcctatatctgcattaagtcacctgtttatacaacatttctggtttcttatcctttttctttcttagtgtaaatgttgtatgctgattgttattgttagctgggcctctgttgcttcgtgtaattattcttgctttattgaggtgttacgtatgatggaaagttatagtgtagtttgtactttggagtaacatgtaatccagtgaattatcagttcttccttcataagacactatttagcattcattttacctgtcattgtttgtgggcaattcctacctatttgtttgtttttatataatggcaattccccagtacaacactaacatttctcactaatggctttcaatctttgttgttctttaaaatgaatggttacctcaattgcctgatttcataacccagacaaagaaatttctcttgtattttttttctttgctttttttagttgtttcacaaaattatattggtgaacccgtcaatttttataaatagatgccatggtaactgctatgtacaaaatataggatcaacctgtcagagatttccctaattctctagtaatctggtgcgtcttactggctggctggctggtggttgatctgctcgctggtggtgttgcagtcttgcaggattcatcagtggtgtgagctgaagtgggggttctgtggttttttgtttctccgttaaggtttctctttccgtttcccctctcgcttgaggggactgttcacatgtttgtttctgttgcactcccatttattgtaacttcttaaatggaaagggaaaaaaatgttaatgacactttacactagtttctgcctaatgcattttctccaagtgggatgtacactagtttagcattgctcgaggagagaggattgacgtgtcctttcatgtaaacatttctattactgtatttttgcaaatttagtgcatctgatatctaggaatgtgtttttcaattcacatggattgctccttttctgtgctgctaaactaagatcatatttgcctataattagtctaggtaaaaatatatcttttgcgatgtaattcatattgcacctcgttggtgcttttgccctcagaaaaatattgacgagactgttcactaatttctgcctaatgtattttctccaagtggaatgtgcatttaaatattttagcactttacacgtttgtttgtagatatgccttctggaacagggaaatggcctcttccatgaatgaatgagccccctctatagccatcacttgaatgatcaggtagcatattgattataagtttgttgatttgaggctagcaacttttttaccaacatagtaattatcttccagttgcagatgtcttatgttgctggtactaaccaaagtgcgattccacttggtgggatggccagatattcagtgggcatggacagtggaatccatggcgctacaagaactgaatcaagaactctctatgtggaaggactaccttcgaactgcacaaagagagaggttgcacgtatccttttctatgcttgtaaactaaaatcacattttcctagctataattagtctaggtatcttttgcgacgtaattcatattacacctcctaggtgcttttgcccttaactctttcttctgcagatatttttcgccccttttctggttttcgtgaggtgagattggtcaacaaggagtctaggcatgtaagttaaatgctacctgtgatccaaattttccctgttattttttgcaaagccaagcatgcttacatgtcaaatcccctctctgttttgcaggctggaagctgtaacctcttgtgttttgttgatttttcatctcctcctgaagctcgtgctgctctggagactctgcaaggtaattataacatcatattttctgcatccatatgcattgtacttatgttgccaatttcgttagatagtgcttgcgcacagtttcattcttttatgtttgtgtgcctttagtctttttaaaaatctgtttatttttctgaatatttttccctttgtcccacatccagtaggttttagtgtgatgactgaactaaaactaagattgttatttcgaaatatcatattttttccttgttccactttgaaaccagcttactgtcattctatgtgtgctatatcatatgtaataatatttgtgtgcacatcaactttagtgctttccatcataaaactagacgtttcattggtagggagagaataaactttgagcttctaatacttgttcaggttataagcttgaatttggctctgaaattatgacgttttactttgcaggctataagtttgatgaacatgaccatgagtcttccaacctgcgcacacaattctctctcactcctcgcaggaggtcaattggtgggccttgtgttagaaactaagtttcttgggtggagttgaattaataatgcagagcaaaatttgtggagaatctctagggagacttgtatacaatgctagaccaaacttgactctagggaaacagcctcttccacgaagcaatgagcccccattatgtccatcgcttgaacaatcaggtattatatcaattataagcttgttaatttaaggatagcaactttcttactaacatagtgctggttgcagatgtcctatgctgctggtgctaaccaaagtgctattccacttggtgggatggccacatattcagcgggcatggacagtggaaaccatggcgctacaaggaccgaataaaaaactctatgtggaaggactaccttcgaactgcacaaagagagaggttgcacatatcctttttatgcctgtaaactaaaatcacattttcctagctataattagtctaggtatcttttgcgatgtaattcatgttacacctcctaggtgcttttgcccttaaccctgtcttcttcagatattcttcgcccctttctggtttctttgaggtgagattggtcaacaaggagtctagatatgtaagttaaatgctacttatgaaccaaaacttccctgttcatattttgtaaagcctagcattgcttatattttgttctcttttgcaggtggaaggtatataatctcttgtgttttgttgattttgcaactccttctgaagctcgtgctgctctggagactctgcaaggtaattacaacatcatttttacctatgaaatttatgattgtctgcatccatatgcattttcttatgctgccaatttctctagttaatgtctctgcacctgcattagatgcttttctttgctgtgctttaacatgcattgaagtatagcagtttagttttcataggcacccatttcacccgtcatacactttcagccaaaaattgccacagttgtgccagccacacttttcatggcaaaaaagtgtggctgccaactaaagtgctatatacaatgattaatgtatgccatcttcatttgtggttagtacattttttttctgtcattttgtttcaccctatatagaccattgttgcatgtctacgactattaaaggatatgcttgctattctgaacaacttagtagcaagctcttctatcttaaaccacatgccaacaggcttatctactttcacgattttttgtgaaaccaggcactattttgtcatttcagtaattcagttaaaatataattatacaatgtcagtgcgcttttggagttgctatggaaaccattgttggaaacaggcaggggcatatgtacagtagtatcactggtctcagatggatgccatccaaccaatccagtgtattgctagcatttgtacgcatttacgcacttacccccggcagtgcaactgtgcaagcttgttgaccccagccgctaaattgcagcagctcagaggctaaacaatatagctccatctttgaaaacttaaacagtttaactggtgtggtaggtgctggagcccgaatctattttccaacatccttcctctttcatattataagatgttttagattttgaatagattcattcatgcatccatcatccttcctctttcacattataagatgttttagattttgaatagattcattcatgcatccacatgcgctacatatatatgctcaacttcatatgtatgttagtgaatttagacaagagataaaaagaccaaaactttttataatgtgaaacggagggagtatatgttttggtaccatcagccaccactaatgtcgcagtttaaaatatttgatctgttgactataattatttcttttagctaatgtttctatccatgtaattaggccaataattctattatcaactattaaaagttaaccatatttttagctattagtaaaaacaacttcaataacttgcttgtctgaccaaaagaataaaggatttgtatgtcttattaggttctaactctcaaagtattgctcaatacagaattaagtctaaaattaagtgattcaaaccttaaactttaattagtctcaaatgaacatgctcattgaaacaacagcaatattctaccgacaactctagctaaaaagatcagctcaaggacaccttagcttagaaatatttagaaatggagcccttccaaacaccgcataagtataagtgagtggtgacaccggtgccccaaaatcctggatacacccctggtaacagggaaaccaccaagttttggttggatcggtgtctgcatggcaaaacgatatttgaattagctccaaacttgtgctagctgatctctaagtgcacctttaaacaatgcactgtggctcaagcgctgaataacagaagatggttggctgccacatggtgcttttattgttcaagtgcttatttcacttgagaaggcatctacatcaggaagttggcctataatgcttatttcatgtggtctatcaagtttgctccttggaagtgaatttggaaaagttgggctagcttcgctgcaagttattcacttggttagctgtttaacaactggtgttggatggttgacaggcttgctaagcgaggtttatcgcacccgaatgcttgtcccttctgcgaccaggatgatgaatctattcggcactttctcatctcatgtgtatttccccgccatgtctggacatgtattctacagaagctgaatatgttggcctccgtgcctcggtctaccgcgtgtctctctagttggtggtaagttaacagaggtgttcctaaagaccaaagaaaggggctcaactccttgatcattctagtaagctaggaaatatagaagcaccggaatgcatgtgtgtttgagggaacaaagccccaatgttcaggtggttctgcattctattgcggaagagagcagcctgtggtgctgggctggcacctccgcacttcgtgagctacttgtttggtcgctcacaatagtcacctagtccgtccttatggtgttatcctcctttgatcttgttcccattggcaataggcaattgtttttagtccttttgatcttggggggggggggggggagaagggggtttatcctcctttataactttctaaaacaatcgtctaatttgcatctcatatttccccaaaggtacatcaaccatttctacgcatcagtaaaatttgtcaattggccgttgaaatggcaaaattactactacatttttctattttgttactaaattatacattcaataccctttaaattctacaacaacctgtaaccccttccaaccgtttgtaagtcagcagggtctagatttgtttttgttttttttggcccccatggtatatttctgttaaaaaaagataaaagtaataacctttttttaaaaaatcttagttctgtcacttgttcccattggcattgactgtatacagcttctaccaatgcatttgtgttttgaggaactgctaattaaagtactggagttttttatgtggtagcacgcccttagtagtattgcaaacttgcgattcttggtgagtagaagcatgatgttgttacataggctcatatcagttgctggtgtgattagacaaatcatgctctttgacatgaatgaacctatcctaatttatcctttgagcttcattaccaggaacagtagttggttgtgctgtatacttttaatcttgcgtggatattcacctagtctcaatgtttcatgaacgtgagaaccacatatggctgccaaaacatgcaagcgtgattccagtttattgaatcgtgcatgctagataaagggcctaattacctttatagatgtgttggcaagcaggagtagaaatcagtgtggttgtgtgagtttaatgatcttttgtattttactattgcaataaattgaaagtttaagttgggaagaaaggccgttctgaacattgttgttagaggtttaaacaaacgagatggtattagaaagggggtcctggttatcctgcaaccttaaccacctttaccacctgttatcattatccattacttggctgtatcttcgtaggctgatgctaggttattcaacctctggctgtttgtagcaacagggtaatagaacatttattgatttatactcactgactaataaatgaaacgccggtttccttctttgtcaagagagaagaattttgtccttcctattagacaagataaacacggcatattacttttctagcaattaactgtgggtagtgatcgtttcttctttctgattgtcgaaatggccattgccatccagctttccaccataaataaactgacatggatattgcggtaaaagaactgccattgatagcaaaattctaaaatctatcctgcaacattaatttctgactagaagaataaggcaaatttatttttttgctcctgctgcattatttgcttcttcaagttccagcatgacaatataaattcattcgactagacaaacttgaaatgtttaatggacgtagtgtaataatagtactaccatttatagcacagttttgtcactacctgcagcaattttgaaaaaaaatcaacactaatgtggttgtaactatcagacatgttgatacgaaatctattcataggatgtgacctcaacttctgcctgatacgctcaaaggtctgtgtgttttgcagtgatcaccagttactactaaggaaaggtgttcggtgatgccactaagatcatggttccagggacgatgcaaaggcaatggaacatgtttcactgaggttctcattcagggcaaaggggaattgctcttcggagctatgtgaatttggtaagtggtacccttcttagagtggtctattccatggtgcaacagcttatgcatcatacagattttggaatggttcttatgttatgatcgttttgatgtactccattcatcctaaacatatttaagcttgtctatctacttttcttttttcagtttggcagaaacactgcttcgtatggttgcaagtgtattctagcgtgaattgtattttctcaaggtctaaactgtaactgaatttaaattgtaatgcttggagtgaatgtcttaagttaaaaacttttgctttttgtttgagttaagtactccctttgtttcatattataagtcgctttttttatagtcaaacatctttaggtttagttaagtttatagaaaaaattagcaatatctattccaccaaattaatttcattatatataacattgtatatttgataatatgtttgtgttgtattgaaaatgttgttatatttttctgtaaacttagacaaacttaaaaaaagagttgattaggaaaaatgtcaaaacgaatgacttatggtatgaaacgcaacgcggggagtatatggctatggtacaaagacattgtaactacagaagtatattgatttgcccctcttttctacttcgagcggatgagatgaagtttactccgctccacgaagagttgatttttacaaaattccggacaaattagcatcatgatgaaaagatgtcgaagccatccaataagccccttgattggttgcgacctttcgttaattgcttggtggaccccttgaaaattcaactttttatgggacagatttcagttactgtcgaattcgtttcaactcggacctgcttcgttaatcatcttatgcatatgcttaaacttgtaagcaaatttgaatttggctcatatgctcaagttttggaataccgtaaacgaggcaccattttacttcttactagtagatttgctcgaggcaccattgtacttcttaccatatgtatctttcatggccttgttagtattttagtgtgaatgaatgccgcagcaaatagccaaggtcctttttaaagaacatatattaacaggttactgatctacggaatcaacggacatattagggatcgggagtgtttgaattagggagcacaaaattacaccgacgccatatgtcaatgatagagggttaaatatatcagtgataggcagttgttgtggcagatttactatcaccgactaccaacattttgtcatcaccaccaccaacaattagagcaaggtcaatagtgcagcccactactagctctaaatcatcttagctaatgtaatagccaattcatacaatagttgcttactatactatttatatctggtctcacctatcatacacatattacatcttggagttcgtactgcagctggctacagttctgtagcccgctgcccttctctctcttcctttatctctttaaaatatgtttatagctggcttatagcttgctattgtacctgctgttatagctgtgtagattagttttggcaaattttgccacaggatattgtgactttgcagttttagccgtaggacaccgcgcgaagtgacttttggaggaatacactctcaaaatgtggttatttgctggtggacaccgcacccattaaattagtaatttccggttgaataggagagataaattgtgtgaaatttctaaaatgtcctttggcccacatgtcaggtctttcttctctctatcccctccttccacactgcaatggctagcgcttctccgtcctctatgtcaacgcgaaggagatggctcgtgctgggctaacccacaagcaggaatccgaagagggaggccagctgattggagtcgtacgccggcgagggagggagcgccacgcgctgggtgacgccgtggggtcagggagcggagcagagaagagctgggcgtgggggcggggcggtggcagtcgtgtacggcggcggcggcagtcgtgtacggcggcggcggcggccttcttctgctgtacctggtgccgcatagccacgccagccgttgctccgccatcgcgccagccgccgctcctgcacgagtgcgccaccgcgtcgcgcgctgccctgcgatgcatcgccggccgcccgcatcgcgccgcacagttgccgcgagccgcgccgtccactactccaccttcgcgctagccgccgctcctgcacaagtgcgcctaatgccctgtgccgcgggctgctcgtatcgcccaatgcccttcaccggccgctcgcatcgcccgctgccctatgccgagcagccacgccggtcgttgctccgccatcgcgccgaccgccgctcctgcacgagtgcgtccctgcgtcgcgcgccggccgcctgcatcacgccgcacggtcgccgcaagccgcgccagccgctgctccaccttcgcgctggccgctgctcctagacgagtgtgccatcgcatcacccaccgccctctgtcgcgtcgccagtcgcctgcatcgcgtgccgcgttgcgccgcacggtcatcgcgagccgcgccatcgagggagagagaggaagaagataggaagagaaagaggaataaggggcaatttggtaagtcatgtaaaaaagtggagccatctcgtctactcagcaccgaaatcattaatttaatgggtgcggtgtccaccatcaaataaccacattttgagagtgttttccccaaaaaattacttcgcgcgatgtcctacagctaaaaccacaaagtcacgatgtcatgtggcaaaatttgccattagtttttcaggcttttgcttggccggctcaacatccaacgctccgatgacaactgtggctgaaggcaaggcccagccctatagacgctggcctccaccatgttccaaagaaaggcccggcccaaaaccaactgtggctgaaggcaaggcccagccctataggcgcaggcctccaccatgttccaaagaaaggcccggcccaatacccagcgaatcccatgcaaaaggaaaaaagttatacctgacttccctcgtcttgtcgctgaattacaaaatcatccctgaaccaaaaaacgagatatatagcatctctcaacttagaaaactaggctctctaggtctttaggtgattttgtctttggtttttaccgacgtgatagctgagtcagtattggaccccatatgagccatacatgttagtgactacttcccttcctctctctctccacctctcttcatctcttctccagtcctctccatctgaggtgtgcaacggtcgacgaggagaagggccagcgcggcgagcgcgaccggcgacgggcggggagaactggaggcgcgcggtgcccgacggtggccctcgctgacagcgacgacgcttgttggtgacgacgagcaaggagaagaacggtggccggtggagaggagctaggagtcagcagcgtcactaagcttgaccggtaatggcgaggaaagcgggagcccatccccccaacgacggtgggctcacgaaggatgtctgggcaggggtgccgtcagcgagagcttgatggagccggagaagagggggcgaagatctaggaggggaagtagagaggcccgctgccgccgccaatgtgtagctcctctccatcggtcactactcgtagcggcaaggaggaggaggagtggcctaaggtgttggatatcgggcggcgacgagcaagagggaggagtagtttggcggcgacatcagtgtggttggctggtcgttgcgtggccaccgcctcctcccgagctgctttgcctagcgaccagccccggtgatctcttcctgtgccgcctctcccccgccacctccgcgaccggctgactacccgtgccggtatctacctcgacgaccctttcccatgccgcctctccgccgctccccgttgctacgaccggctgcctcgtcacgccggcatctgtcgctctgcaccggcctgatgtgagaacggggagaatgagaagagtttatgtcattgacatgtaggtcccacgttaagtcagctaccacgtcggccaaaaccggagtcaatgccgccataggagggacctcaggtatacttttccccacgcaaaaactacccagcccatcatcacggcccatgcaggcccgacacgcttgtcgaaggcagcccacactgcacaacttctctctccctccagccgtcacgcgcgccgcgccgcgccgtagcgcgcgtccacaccagcgcggcgcggcgcaacgcggtgcccgcgcgccgcttgctcccccctcctcgcgctccacgcgcgcccgcgctcgccgccagcgcgcgctgccccggagcgcgacgacagctgtgtggggggcagcgacagcgccactggcgtcagcaccagtaaccgaagccgcgctcgctggctacaaaacacgcgccccctcctcccctcaccgcggctgcgcacgcattccccattccccattcccctatctctcgaaccctagcccctagtcccctcccgaaccctagcccccaccgcgccgccgccgccgccctcccgatcgcgatggccgccgagagctactggcagtaccagtacgccgccgtcgacccgcgccagcaggcgccggcgccggtgcctgtgcccacgcccgcgctcatgtggcagcagcagcagcagcaggcggggtatcagcccgccgtggcgccggtcgcgcccccgatggctgctccgccactgcccgccggccccccgccgtcgttcaagcgccagcgcccggagtacttcggttcgtgctcgcccacacattcctcctcttcttgattgttaattttgtgttgcctgctagattagtcgtaagaaagtataggtagctttgttgtgggtatccatggggtttagggctttaggctatagaacatatagatgatgatagtggaagctagtctttttttataagcagatcttgttgtcctgaacttttggggttcagggcgagaaaaaatcagaggccttttatttgaatgtatcatcatcagtaatcttaataaattgcaaatatccctcatgtttgaattacagatccagatattatcagttataagtctgaaactctgaataatagggagcagaatcacctggatttttgtgatcttgtagaaaccgaaatatcatcaagaactcgtggaagccaatctcctcaagggtataatctgttagaggactcctaaaaagggaaaacacacacacacaccaactatagaaaatcagtgcaaagctatgagataaaccaaccaaccactcaactcaaggagatcttgctgactaactagagaaactaattattatgaacaactcacaggaatgaggaattcataaccaatcaactctaatggcaatctttagaaccaaaagaaatcaaagttccatcttttttttgtcaatcttctttggggtgttattcaaccctgaagcaaaggagtgagatctaaaaaacttaaagagtacgacatatgcagtggctgaatgacgggattacatgcagcaaatgacacacttaattaggctttagtcatgctagctaacccagcgtagtttcgggaatagataagggtcgaggggaatgagatagcttcgatgcttcgtgacctgcgcagactgatatgcttgttggacatctgctaatgaggcttgggcttccaaacaatacgtgtgtggtctggggccctgactgccctgactcagggccggccttgtgttttccctgccacgctgtactattaacctgtccaaggaaatggtaggagaagttgcaggcttgtagttttgaattgttccaatggtagatgtttgtttgaaatgaatacataaaaatgaaaccattcctcatttcctgataaagcctcaatgtcgtaagatgggaactagtaattttcatatgtgaatctacaagatcatattgattctttgttttctttaaagttagatggtgtagcatggtttatatgatatgttagattgaattaatctctggttaggctaatatttcactatcattggtaggctctaggcaaaaggtttcggcttctattatagagtagtcggtctgactattttgatggctaaatggtttgtaaattctgaaatctaaaacaagagaaaaaaaaaggaatttgttgtgtaaaaaggttctaataatctctacaaaggaatttgctgcttgcatgccgttacgttgtttgccgccaattctgaatgcatctatcatcacaacaataaagtttagtccttttttagtatcattttattgggaaaatgattgcttgctatgcacagctacctgaaactatgtatcaggattgcctacctgcacatagatttggcggctttttagttgttagataatgttgtaattaccgcacatcattaattcttcacatgtttgcttctattgcaaccccatttttgtcatagcttgcttcttaaatggacagggaaaaaatattgacgagactgttcagtagtttcttcctaatgtattttctccaagtgagatgttcatttgtttcagtcaaaaaaaaaagatgtgcatttgtatattttaacactttacactttgtttgcagacatgccttctggacagggaaacagcctcttccacgaagcaatgagcccccattatgtccatcgcttgaacaatcaggtattatatcaattataagcttgttaatttgaggatagcaactttcttactaacatagtgctggttgcagatgtcctatgctgctggtgctaaccaaagtgctattccacttggtgggatggccacatattcagcaggcatggacagtggaaaccatggcgctacaataactgaatcaagaactctctatgtggaaggactaccttcgaactgcacaaagagagaggttgcacgtatccttttctatgcttgtaaactaaaatcacattttcctagctataattagtgtaggtatcttttgcgatgtaattcatattacacctcctaggtgcttttgcccttaactctttcttctgcagatatctttcgccccttttctggtttccgtgaggtgagattggtcaacaaggagattaggcatgtaagttaaatgctacctgtgaaccaaattttccctgttattttttgcaaagccaagcatgcttacatgtcaaatcccctctctgttttgcaggctggaagctgtaacctcttgtgttttgttgatttttcatctcctcctgaagctcgtgctgctctggagactctgcaaggtaattataacatcatattttctgcatccatatgcattgtagttatgttgccaatttcgttagatagtgcttgcgcgcagtttcattcttttatgtttgtgtgcctttagtcttattaaaaatctgtttatttttcttaatatttttccctttgtcccacatccagtaggttttagtgtgatgactgaactatgtagagtgtagtccatagataactaaactaagattattattatttttttgctgaaaactaagattgttatttcgaaatatcataatttttccttgttccactttgaaaccagcttactgtcattctatgtgtgctatatcatatgtaataatatttgtgtgcacatcaactttagtgctttccatcataaaactagacgtttcattggtagggagagaataaactttgagcttctaatacttgttcaggttataagcttgaatttggctctgaaactatgacgttttgctttgcaggctataagtttgatgaacatgaccatgagtcttccaacctgcgcatacaattctctctcactcctcgcaggaggccaattggtgggcctcgtgttagaaactaagtttcttgggtggagttgaattaataatgcagagcaaaatttgtggagaatctctagggagacttgtatacaatgctagaccaaacttgactctgatgcaccgttagtgttgtatgttgttgctttgcaaagattctgccgtgtaggttggtatggatgtgttgataactattggttggatggaaacaaagtagatggggctgaaaaattgtttaatcatgtgctgtgtgatctgaattacatctattcttctgtggatgattgcaatgagtacatacatggtgcatcggcacatgtatagtagtgagttatgaatgtgttatctggcttagattgtttgcaggttgatttcatggtgcaagactgctcctgtaccatttcttacaaaaaggatttcggtgagtttcattggtttttcatagtagtttttcttgcctgaaatagtcttacagtgattcgtaaggacaagagtatctcaccacctatatccttggtatttgacaaaatcaaattggaatgggtccttcaaataagctgatatcttgttcagaggctctatgtgttcttttgcagatggcaatgttggctgaaaaatgttgtgttgtgcctggaagatgctatgtcactgaatccccagcaacaacaacagggcacacctatagacttgtagcattactagaaacaacaatatgcatgtgttttctggagatggataagctactgtatgtatgggaatttcagcatgtacttagcagttgttcaatactggtttctgggcctcagtttttttttctctgtaggcacagattgagatgcatttttgttgcatctgcaggacatgtaagccaattgcttgtgctccctgatactgaagttgtaacatgtaacttttgacttaccatgtagtagtactgtaagtatggagtcatggatgattgtccttggattactttgaaataaaacctgttggtgacattttttatgcattcatctggtacaagagaattgatgtgtaccgtcaacggtaagcatagcttctcttcatgtgaagaaagctgcattgcataactgtcctgcaggttgtgattgagtgaagaaatgctctgcaaggacattaggggtctgtttggggaaggttctgacagctgcagcttcttccaaaattagaaattattgcaaacaatccagtttttcattcagattctgagaagttgtaactgtagaatccaaaaaataaactagaagctagaaattggaaaactcagtttttttatattatcaaaagctgactaccaattagttgcttgtttgtttctcggaattttaagttcctctaaacaagccctaatcatgcaactgcttgaacgtacaaagcgtgttggttaaagatagatcatatcttgtctattctagcttaattaacttggtaagtacatgtccttattggtatcagtagttcataatccagaacatgtatttctatcaaaaaataaagttgatgctcaaataatgtcagcatgatagttttgctacagtgtcgagcttagtcggcattaatttgattggacattaaacatacacgtactttgtatatgataaattgatgcaaaccttgctggtcctagcactatctcttgtatagcgacatcatccaactagtcctgacacctgcttgtacatcaaggactttgatcatttgctgagttttcaccttaattaagcgtgacactgaaatttccgatcaatttctcatctctgcacactagccattaccctcaaaatttccagaaaagaataggggaaaaatcaacctggctgctactaatattcagcaaattaaagaaattattcagacttttcacccagtcgcaggcacctgacacattctacttgaccagaaatttagaaacctgccaagaaatcaacagaatttccaccgggatcacgtacccaacatctcggttggtcccgtctcttccttttgcttgcaaattcaggaagagaataccgtatgacacgcatgactactgctgcaattgcgtaacatactggccgacagcgacggcacacttggaaggccttgcatgagaccggatcagacttcagagattcagaggagaagaaaccttggccctgtcgcaattccaaccgtgatttgttgatcggtttatccaggaaactgccgatttgtttggacctggatttttcttggtgttttctgttcttggacggcatacgtacagtgtgaaggtctgcatggaccactgctgattgacaaagcaaagatctgaattggtcactgctaaacactcaagaaggtgtggtattcttcactggttcattctggtcatcaacacagttaatggttcctttaaaaaaaatgagatttgaaaggagagacatcctttcaaatattttttaaatattttttaagaaaaaattatgagtatgtcaaggattaaatacgggacttgtactatcaagtgcatctcttaagggctccttttagaacgtatgattctgaaaataaaaaaaaaatcataggaatataatgtcatgccatattgaataccacaagaaataaattcataggattttgcaaaaaaaaaatgtttggtagcaccgtagaaaaggtaaagggactttgagtcacaaggatgagaaaacatgaggtctagtctcatgttaattttcctctaaaattcttacaaaatgggtaattccataagaattttaaaggattttggggaagctattccgtccaaaggatcatgtagggaaatttttctaatggatttgaatcttccaaaatttctctatttttcttttgttccaaaagagcctgagtatttttttgagacagatgtatgatacttttttgtggattacatgtaaaaaatgtcacttccataaccacagagagattttagcgtggcacagtagcattgtggattacgttattatatgggaaatatatatttttttatctacaaattatattttgatcattacttcctccgtttcacaatgtaagtcattatagcatttattgatgttaatgaatcgagatagataggagggagtaataagtattgcacttataatccgttggaagtgaagcaatgagactgctaataatatctggtttcttgatacgtcatcatgttgggtctttcagttcttgagagctcctgcaacttgcaatcacatttcagactttcgatcgaatcgaatagcataaaatgtgatgtgaagtggcacggctaagggaactacttcctccgtttcctccgttttaggttataagactttctaacattgtccacatttatatagatgtttactccctctgtcctaaaaaaaaaagcaaaccctagttttccgtgtccaactttgactgtccgtcttatatgaaatttttttataattcgtatttttattgttgttagatgataaaacatgattaatattttatgcgttacttgtctttttaattttttttataattttttcaaataagacggacggtcaaacgttgggcacggaaaccagggtttgtcttttttttaggacggagggagtatgtgtctagatccattaacatccatatgaatataggcaatgctagaaagtcttactccctccgttttaaaatatttgacaccattgactttttagtacgtgtttgaccattcattttattcaaaaaatttaagtaattatttattcttttcatatcatttgattcattgttaaatatactttcatgtacacatatagttttacataatttgttttaataagatgaacagtcaaacatgtgctaaatagtcaatggtgttaaatattttgaaacggatggaatatatagtatgaaacggaggtagtagtaataagccaagttggtcaaccactgctatataattcagctatagtctcgaacacttgtttaatcataataacaaaaggtcttcatgttgccctgttccttcactactttttctttccttttctttttctaaaaagcaaacagtctcctggcactgtttcagtttaataacatacgtactccgggtaatctaaacagaaagaaaagatagtctagtactactctactaatggtaaattaatggagattaaccacagtgcatggtaaagaatttctggctttttattattaacacatgtatgagatctaaagaaaaaaagtatgatatctatctattgtacccttcttaaaccggaagcaacatataaacatttttgtaatatgtccagttgtctgcacaaaagttaaaagcaaaaggcaacaaaacaaggactcatcttgatttttttttgtttcttttaaacaaaaaagaaggcctgggtattagccaagctaggtggccttggaatggacagcaaaaggcagcgatgatagctgcagcctccctttgtgcagcacacactgcactgcagcattgcagcaatcctcctctccaaaagcaggacacaccatcactagggtagtagaccaccagcacaccgagcctccctcaaaagcaagcactgcatgctttcaacataagcctagcctctagccatccatctagctcgatcaccacagttcttagccgaagagaaagaaagttaattagagagttcatatatagctgaagtaatcaagaaccaagaagaggagaggaaggtgatcgaggaggaaggaaaggatggtagcggaggagaggtggtggtggtgtgggagggggagaaggagggggagatcgactacgtgttcaaggtggtggtggtgggggactcggcggtggggaagacgcagctgctggggaggttcaccaaggacgagttcttcctcgactccaagtccaccatcggcgtcgagttccagacccgcaccctctccctccaccgcaagcgcgtcaaggcccagatctgggacaccgccggccaagaacggtaaccatccatgcacacaccgatcatcttctttcctcgcaaacgcatcagttcatacgcagttatctagactcatgacttagaaatactggaaagatcatttttacttgtgataatactgatagtatatataatagagcaacgcaatgatagtcgctgcgaaatcgtgatcgttgctgcgtttttgttagcgtttacgtgttcaagctatcccaactgatctggctgttcttgcatttgattagtaatttggtactccatatacttactccatatacttacatagcgtcaatgactcatgttctgttgcttgctgcgagggagatggtgtcacatgcatgtcagccaagacaccagcttcattttgctttcattgtgattaattaagccgggagctaattggatcggtacaaggactcgtggaagattggatttgtattggttgggaagataaggatgcatgtatagtggctgtcagttttcatgaagccagctgaaattaaagctatgaaatgcgatgctactactagtagcttctgctaaaacaacgcgtcagaacagagcacgccgaccaccgaaagnnnnnnnnnnnnnnnnnnnnnnnnnnnnnnnnnnnnnnnnnnnnnnnnnnnnnnnnnnnnn

SEQ ID NO: 54159 - DNA, 5378 bp, Oryza sativa
tactccatatacttacatagcgtcaatgactcatgttctgttgcttgctgcgagggagatggtgtcacatgcatgtcagccaagacaccagcttcattttgctttcattgtgattaattaagccgggagctaattggatcggtacaaggactcgtggaagattggatttgtattggttgggaagataaggatgcatgtatagtggctgtcagttttcatgaagccagctgaaattaaagctatgaaatgcgatgctactactagtagcttctgctaaagacaacgcgtcagaacagagcacgccgaccaccgaaagtgatccctgcaagaaccactaatgcctcctttttgcaggagaagatttgatagaaactgtcatgtagcaaatcagtcattacctgcctaatctaacctgcccttggattaggcagttgtcgcctaattaagattttgatctgttttcaatgcaacaaagcgggaattctgtgtgcaattcgtgtgttcccgagggagactgatgtgttcgtggcggaaatatttgaatttttggaggaaatttgagcgaagtttggtctttttggtttcgcaggtacagggcggtgacgagcgcgtactaccgcggcgcgctgggcgccatggtggtgtacgacatcacgcggcggcggacgttcgagaacgtggcgcggtgggtggaggagctccgggcgcacgccgatggctccaccgtggtggcgctgatcgggaacaaggccgacatgccggcgggccggcgcgaggtcgccgccgacgaggccgcgcggttcgcggaggagcaggggctcttcttctccgaggcgtccgcgctgtcgggcgacaacgtggaccgcgccttcctcacgctgctcgaggagatcttcgccgtcgtgtcgcgcagggcgctggagctcgacgaggcacggcggatgcgcgacggcggcgccggcggcggcgaggtgctgtcgctgaaggggaccacgctggacgtcggctccatcatggagaccagcgccatgaagaagagctcgcagtgctcctgctcgtgagcgacacacagagactggatgttcgctcgtgtaatgtttttgtttcgacatatcgattattacacattcacatcatttcacctcgcgttcttgtcaattatagagaaggattaggcatgtaaaacattgtaaatttggtgattgacaagaaatggtttagattcttcatctgtgactgtgattatctacgcgtgcgtgatgctatgattcgtcgcttagctaacagagcaagctagctcggtttttctaatgccacataagcgcaacgtggactttttcctatttcatatacaaaccattcaggcgcacctgtgagtgggccgcgtggcctcgtgatgccatatttgggccgtttcttcactgtatgggctagaaagctaggcccaacaccagaattcggcccagagaaagttggagatgaccaggttgtgcaggtcaaagggttcggagttactaatcaactccaaacgctggcgccggagttttcatttctgaccccgttggcctttttaaagatcgaactggtgattgagtgtctccgacgagcatagcaccgagcacgtcgtgggtgactgatcgagacgtaaaaactccattaatttgtgtggagatgacagtgttgtggaggtcaaggaggttcggagttttaatccccgacccaccggagccggagttttcgttgcccaacccgttcttaccggtcagtccagcaactaggagcagctgtctgccatggcacggcagccagcaatgctttgccggtgttttaccgtgaagccatgaacatgagctagtccatggtcgcatttccaatcatcgacttactgaactgaacacgaattttcaaacactaaacggtgcgctttttacgaaaactttatatacgaaagttgctttaaaaattcatattttaaaaaaatagataatacttaattaattatgtgctaatagatcatttcgttttccgtacgaaaggaattaattcccatcctcatgaaacaaacacattatttcaacagaagttcagcgacgttattcgtattcctattcttgaccgaggcaattctgctgcatcaactgaataagggcatgtttagtacctaaacaaaatttttcacgctatcacatcgaatgtttagacacatgcatggagtattaaatgtagaaagaaaatcaattatatagttcgccaggaaattgcgagacgaattttttaagcctaattacgccatgatttgataatgtgatgctacagtaaacatttgctaatgatggattaattaggcttaataaatttgtctcacggttttctggcagaatttgtaatttattttgttattagactgtgtttaatatttcaaatgtgtgtccgtatatccagtgtgacacgccaggaattatcgttcacgaaataaaccggccctaagtgcggctgtacatagcagcagctgcagcgatcgtgttgtcttttgtgtagtgggtactgttgctgcagctcaagcagccatatgagccgaacaaatggacgcgcagaagcttttggactccttttgatccatccactccagttggcctaatggcaactggtacataactacctacctatgtatgatccacaaatcctgaaaacaacatggccacttgctcatcggtagctgttacatttgcctacttggatggataccactaccgctgctgctgcaattagcaacatcttccatgaagatcaattccacgcagtccttgccgcacgctgctccgacagatgaactgggttctgcactggtgcagcaaaaacagaaacgtgatgagcagttgagcaccatgatcctgtctgcagaaaccacacccatgaacagaattgaacctcatctcagactcaaaagatcttcgtgctagctgtatcaaaatttgggaggtacaacgaacaactcttgatccatgtacatgtgatgcgacatacatacatatacagccgaaacaacttacaactagctagaggcaaaagggagctaaaatgttgggatctcatcagggaagtcaaccgtatcagaggcattcaggctcatgtgagaagcaagcagcaagctggagagattgaccgcatctgcagtgtcaactacttaactaacatttattccaggctagctagtgagatgctgatatgctggtctttctgtagatgttgttgcatcaatcatgtgtgcgcagcatagctttggtcggtcagaaaattgcgtcatccttttcgtcagcgctttcaccacttgcatgagcgatcgatgtccaggttcagttatctacaacgcactggtcaacctggaaccacgcaaaatccaaatcagtttattgcagtataaaagaactgaattaacaacgaaaactctaaatcagtttatcagtggaaaagaactgaacaatgccaaaccctgaatcaattgtatattcatccctagtaaagaaatggactgaaagtctgaaactcttggcagtgagaaagaactcaagaagtcaaagtttcagtctgatcagttagtggttagtgaacttagtgcgattactcggttgttcttaattggttctctatatggattagtttgatcatattgcagatttttttttccagacaaaggaaactatgctactgcatgcactattctgtatttaccaatctgatcgaattggagttaatcctcctcacctgcaattgtttctgtcacgcgtttgagctcaagcctctcgcctcacaagctcgcatcactctcatcctcttacacgaagacacgaacatcctgcaattcaagatgcatcaggttgagatttccacgtttacctttagtttttgcattcgcataattttgaaacgatgatgaacagtgcaatgacgcagtttcagtaatgtataaaaaaagcgatgcggtttcagcggtgcttactcccagggcacgtcgccgacgagcatccagtcgccgtcgccgtcctcgtacacgacggcgtgctcccactcgccgtacccgtccatcagtcctgctcgatcaccgtacacaaaacattattaaccgccattactgatcaatgtttggcagattactcttgcatatacagcgaggtgaaactagcagctcaccaatggtggagcagtagaacatgtcgttgagcgcctcgacgagctcgaggtagtcgccgtacgccgcgacgtccaccttcctcaggtacggcgtcccgtccatgctcaccttcacgaagtacgctgcctgaatcctaaaccgaacaacgaaacccatccatcagaggagacgcgacattgatcgatcatcacaaaaccattagccgtgtaagaacactagaaattacatcgaggacgacggcggcggatggccgttcttcctgccgcgcctggccctgcgagcgctggctccgggaggccccagcgtcagctcggtgagctccacgccgtcgtcgccgtagctcgccatgacccaacaccgtgtcgccgccgctgacctcgacgaagaagacgctgatggtggcgagctgtgggctgcacagagcgagctatatatatataccgttggtgcaagcgcggaggcggcagcggagtgggatcctctgcgggcgagcgggggtgtcagcgtgtcaggcggcgagggcgaggcgggagcagaggatccggaggtggtggggggggggggggtgcagcggctgggacaggcggcgcatcggcggttgggccggttgggttggcaccggaggctgccggcgagggggatggcaccgtgtcgccgtgggacccgaccggcggggcgccaggtggacgccctggtctcctgcgtcgtggctgccttgcgcggggaatcaggtgtgaccgtcttataatctgtggccgccactactgttcaatgtgcattctgcaagtcaatagtactcctagacaagtgaatcttgttctggtggacgtagcaaacttgaattgcaaatctaagcgaatagaacaatatgggatacttgcaagtacgactagtataatacatcatctgttcttaaaaaaaaatactaacttctagtgataaatctggacaaatatatctttagaagttgtttttctacgtgacagagagtactccatagttctattttaaattataaggcattttgattttaattaaggttgcagagagatatactagcctccacttcttgagttcgtttgtggtggttatcaacctacatttactcgttttccgtacgcacacttcctaaactactaaacggtatgttttctcaaaaatgttccatagggaagttgctttaagaaat

SEQ ID NO: 54160 - DNA, 4604 bp, Oryza sativa
  unsure (1)..(4604): unsure at all n locations
aggcagccgccctgcgtttcgccagcgtgtgccgccggctgggcgagcagcggcgtgcgtgtggcggccgtggccaattattttttagtattactggagtattgcgttcaggtcggctttcggtttggttgggttccagaggacagttgcgctgctgtgttggcagaggatgtactaatccatctcggattttgatgagtgtgtgacatgggagtatgggactactcgagctctacaagacatccaagagctttttgatgcaaccacgtttgactagccctttgtttttttctgccccctttgggcaaaaaggtttgttggtgcttgaccggcttcacgccctcaaaggcatgagacgtgtcagttcgtgtcctattgcagagtgcatactgcatgctccctccgtccaaaaaatataaactttagttttcgtgtataacatttgaccgtccgtcttatttgaaaaaattatgaaaaaaattaaaaagacaagtcacgcataaaatattaatcatgttttatcatctaacaacaataaaaatacgaattataaaaaatttcatataagacggataatcaaaattgaacacggaaacccagggtttgtccttttttttttttggaacggagggagtactactcaactacttgtacgagcaaagtttttaagaatagatgaagctgcttacttccttttaagaatagagcaagagtgggatcttattggacaaagaacatatctagattatttatagtcctagcaaatatccagattttagttttacatatttttgaacatccagattttagatttttatattttaaaatagaggtagtagtaattaagaaaatagagcttcgcgtgttgtaatcttgcaagagagcaaaatgggaagtaaatgcttaacacagtccaagcaagcaacatttggatatacaccgaaaaaaaatgatgggtctattaatcttttgaacagtttctaatagcgcacagcagcaatccacaaaagcacaagtgacagcccactgtgcttcccgtatggcccatgtgacaccagtcttacaaccacaacacgagtacacgacgataaatagcgtccacggcatatggcatgccgagttgacatgaactcgttcaacttcagctctactagaatcatactactagcgacacaagaggaccatgtaataacacatattctgcctggctgaagaccaaagctaatccaacctcccggagagctactgctatatagcagcaaccgaagaaatgtacatcctggtgttacggtatttatttgttggcttctcgttcgaaattacatgttggcaccactcctggagaatcatgattgttgacgctaacatccacgccctgagtctggtttgtcatcagtaagggaagagcatagaccagagaggaaaatgtgagtgatcggtaaaggtaataatagatgagcccattgcattaacatggagaatgtgatgtacctgtgagtttgaaccttgtccatgagtacggacgggtctcatattaagatcaatcattttggaatcgatgttaccctggtcatcgcagttgccatctgaggctggatcatcagacacattatgatggtttgccatttgctcctttgttactgagtgaggggccttcttttgatccgtccggttttcaggatctttctgttgcatagcaacatcatccatatgacctggtttatctcctggaaactaatcaaaatttcaaacttcaagcactagaaaataaggcgtgagattacaatacgaagttggtttctaaacaataacctacttcaacccgttgccttaggagcaggtatcttccatgggttcgtttcccaccaacatgaacagtcatatcacaactaaggcaaagtgatgtaccatctatctcgcaatagaagaaggctgcatggacagcaggacataatcacaacaagctttaacaggcaaaatatgataagaaactattcataaataagaaagaataccgggggcattttcacatatatcacagcgttgaactttattagggtctgcaagcccaactctcacgtgccgcctagcaagcttgttacacatatgcacctgcatcacaacattggaagaaatatcagaaaatgcagcatgaatatttaatgggttattgagaccaaagctgtaatatttgtttttcttcatgctaatgataccacatgaaggatattgcacagctactaaaataacttgtatagactgattgttggtcaaaatctacaaagtttggcctcttcaaaccaaaatacatcttataacaatcaatggagcgagtaattttgttgatcgaagttctcatagagctgaatatggatatgcatctctaacatacagagtacaacaaccaatctggcaaactttcagtaaacaaatccatgcaaaaatgtcagctttattaacagtatctgatttcttatgttgcctgcacataatcagcatacatcgtgttcttcagcagatccattactgacaaaccttattaactcattaaacaggtgctcaactgacataaagacataagtaaggactaagaaccagaaaagatgacctttcatagttggaagagaacttaactgctcaaaacatagtcgtaaaacagaatagacgtacaatgttttaatgggtaaatcaatataatataagaatgtgagagcacaatgggatatttgaccaaaagatctgcccacgaaggatgtttcataatgtttggcctcattagggatggggccacccacatacaacaattccatttccggttggaactttcatctacaacctggttgcacttttgcacgtactgatgatttttaatcatgtcatcagttccaaatattataaaaaaccaaagaaaccagtgtcatagcattggttacggagcgcaaaactagttgagcagctaaagaatgagtaaaggatgctctcatgtatgtttttattagcaattgaaggtagcgactggaatcatgtacagtaacatagtataagacatactactctgtcccataaaaaagcaaaccctagctacgaatctggacacgaatgtgttcaggattggactttttttgggacggagggggtattcattaactctagaaaatctgcaattcagactctgcattctgcaattaaagtgaggcagaagcataatcttggctacaaataacagtaaacatatggactgaaaaatcgtgtaaacacaagtgcaaaatctatacctaactatttctttactattgaagaatttcaacaagggaaattcaatcattacttctacagaacaatgatcgacttaagtattacacatagccaataaggttaacagaaattccaaccaaaatggcaaaatcacgacaagctcatctcgcactgtcccacatatggccatgaatgatgatgcctggaggtgtctaacgaccaccaagctagatatagaactcagggtagtgtgatcttctaagaaatcccgttccgaagtaacccaattgctggattcaagtacttatttgaacttattatgtatgttttatgctgtaaaagtgcctccttcgataacaacatcatagaattatgctttgttttccagttctaaagttggccagctttaatttcaagtggaattctctaggcaataggcctcattttgaagtcagacaagaaataagtggataccccataaggcaatttctcggttactacccaaacaagcactacagttagtcactatcaatgcacgctggcatcctattataccataacttcgtttggtcataagtccacaatactcaacgaatgaaaaaaaaaaggccttaatgaatgaattgctccaggccagtgagcagtacgcagttgattcgcagtcaaaattaaatggctttctgtacccaaaaaagaaacacgcagatccacacgctaattcgagcgtagtaaaccatctcgtgagatcttaattgcacaatcaaacaacccgatcgcccagcgtgaaacaagcgaccgcaattgaannnnnnnnnnnnnnnnnnnnnnnntcggcaagcggactccgacgcgtgcgcgttgtagagcagaggacgaaggcagggttagagagagggggcaccttctcgtcgcaggaccggcagagcgcggcctcgtcggccacgcagaagagcaccgccggcgcgctctcgcacacgtcgcagatcgtccgcatcccgcccgcgccgagccgcgcccgctgtcatcgccccccctcccccatctccccgcccccccactccctcctcctcctcctccggcggatcggtcctccccgcctggctcttcgccgtcgtagtcgtacacacagcggcggcggcggcggcggcggcggcggcggcggcgacgaggaggagcagagcgggagtcgcggggcgagaggaggaacgaagccgggagagagattgtggcgagcgaggagggaggaactcgagagaaacaaaaaaaaatactagaaaatagaagtaatagtttttgatttcgatgtggtggtgggggagcaggagctagcttgttggtggccccacctt

SEQ ID NO: 54161 - DNA, 13011 bp, Oryza sativa
  unsure (1)..(13011): unsure at all n locations
ggggggggattttgggggtgtggctccgaatcaattgcttggctgctctgccgccaatgggcgccgtcacgactccctgtctttctctttcttcttctctccctgctggcctccgggctccggtaccctgtgtccctgtccgtgggccaccaccaccgtccaataggagtacctgttggacctagatctctgcaaaggaatactagagttcttgggctggttataggccggcccagctatcctttgcagaactcctccagtgatccggtctctaggctgagctgcatgccctgtgcagtccagtaaaccatcttttttttaatgctattgtctctattgtaaaatcaaagtccactaaacacattattctaaatccagtactttattataaatccatcctcacaatcacattccatcaacacctccaatcatataggtctaggcgtattagcccgttgaatagttgcatacttatactccattcacttcatattataataagtcgtttggattttttttccatagtcaacctttttaaaaaattgactaagtttatagaaaaatataggaacacttctaacacaaaacaaacatattattaaagtatattttgcatctaatgaaactaatttggtgttgtagatattgctatttatttttataaatttagccaaacctagaaaagtataactagaaaagaagatcaaagcaatttataatatgactaaacagatttaggaccaaaataatatagcacagacgtcactatatgctactagcttcgtttcaggttataagacattttgactttgatcaaagtcaaactgcttcaagtttaactaagtttatagaaaaacatagtaacattttcaacccaagtcaaatttattatgaaaatatattcaataattgattgaatgaaactaatttggaattataaatattattatatttgtctataaacttagtcaaacttaaattagtttgattttgaccaaagtcaaaacattttttaccctgaaacggagggagcactatgcaagcacataacaagcctttgaatgtcacccttgccgttatagtccctcatgtactaatcgttttttttaacgtaaagagagactttgagcttgtttgggggagtttctagctgctgcagattcttttagaatcagaagctccccaaacagtccagcttttgatctagattctaaaaagctgtagttgtagaatcaaaaaaatgaactagaagctaaaaactaggaaacccaacttttccatattctcagaagctggctaccaaccaattgcttctcataattttaagcttttcaaacagaccctttattaattactaaaatttggattacattccttatttaatagctcaagattttctgctggggcacacaatcttcactccaagcaaattcttgaactaaatgccagctgagtcaatgcatgcaaatgcacactatctttatgtggatcactttcacttcttgtagacgttgcatcgctcacagattattccttctcacggatgagcgtttcattgtcaagctagccacaacctctacgttgtcagatacggagtacattactaatcgtattttcacctgtgaacttctcactccttcccgtattttcagcgtaaacgattctatcgtcacatcgacaaaaacctttcgattgcactttgcacatggctggtccaatgcaactgcattttcattcatgcacaacgcttgcttggccacgttaatgtgcttgtgcagcgtcactgtgcagagagaacgtgcgtcctacctgctacacgaatgaacgatattaattacttagcgtatgtatatatggcgtaaaccatgtatcagccgtacatagtacgtggattattactgtgcgcagcggcgcttaagtcttaagtgccattttgccgtacgtacctggttgttgactgtgcgtacgtgtctctggtttagtttattatgtctcgtccgtcggccgtcgctaagactcttgctgacaactgactgactgcaatcagcggcggagctagaaaattaattcatcggtatcaccgagatcagaatacactaatcttgtttaacttttagtgtcatatataacacacaattcattgggaggattgactcaacgacgacaaagctaatatggaaagtatggacgctgtcaaaatgaaaaaaaaaaaaactttacatagctcctcattcgaaacaaaatctggatgacagatcggctgcaaatccgtcaatgtctatcagttttgctatagaaacctttaaacggcacaacaccttttcaaggattacactttcgtacatcaaatctgagagaagatctttcaacagccgagacacaatacactaaacacacacgatggcgacgagccactgcttgactggtggatcaagggacatcccaatggaaaaaaacacaaacgaaagcaattaaatcaattcatatggtggtgccttggaaaacctgatgcgaatgacacaaacgagtgttccacaatcaggagactcaattgtctcaactagtgaccaaaatcacagataagaatgcgaggctgtcggttttcttgttgttctccctcttgttcggttctttttcggctttgtctctttcacctttggtgagtctgtaaataatttctatcctacctaatataacaccagcaaaatgctagctacggtttcaaaatataaaaatttatagtgtcatcttgattgcctaaacaatataaccatagatttcgccacaggttaccggggtcagctgacctcgatagttctactgtaactccgcccctgcctacaatctcattatcatttttattatttatcatgtcgtgatttgtaattcacaataatccgatccataatgtttgtaatagttgactgtacattatttaaattaaagactggaaactctataataattaattgtggtctttttaaacaaagtccaaaatgaattaattacatatatcttaaaaaaccctcaaaaagaacacaaggaaaataagcgagatttaaccactgtaccaaatgttcagcaatgaacagtgaccatataatccctggaaatccgtgcttaaaccatcaatcatattctctccgtctaaaaaaactcaacctataagtgtatgtgacctctcctacgacaacgaatgtgggcaaaggatagtccatatttagggcccctttgatttgtaggaaaaatgtaggaattttggaggatttcaatcctatggaaaaaaaatcctatgaaggcctttgagacaaaggattgaatcctatccaatcctttaaaattcctatggaatgggtaatcctatgcacattttggaggaaagttagcaagaggtctaacctcttggaacatttcctctgagtctatctctctcatctgattcctgcgttttttctgtggtccaatcaaacagccattcctgtgtttttcctgtgttttgcaatcctctgttttacaatggtattcctgtcagaatcctgtgtttttcctattcctctgttttttcattcctacgatttaaaggggcccttatagtcttaggagagatcacatcccctattaagttggattttttctgtgatggtgggagtatatcgcaccccagactggacgatgaggcactgattgtagacaggtgaaagttaaaagcgagaggctgaatgtttggtaggtaggttggcaccagtacttggccgggtacccatctgcattcttctgccttcactagttcactgccaatataatgcgacatctgcgacacagtactgtacgtgcgacgggctctgaagcagagcaatggcaaaagcaataatgtcactcatggacatggacggcgagcgatctgccggagcaaagcaaagcctagctcgcccccacagggacagcattcatggcgctctcgtctcgtgtgccccccctcaatcgccattgccaaccagaaagatcgtactcttcccgtggtttctactgctgctctccggtggccgccgccgcctccatattagggccatcgccttcctggcgcggccaccggtcaaaacggttatttttggtccggtctctcctttttcttttccttttcttaccaagtcttttttttaaccattccgtgagcttcacatggcagacaggtgggccccgtgggagttagccccaaccaccgtccactctgctgcctttttcgcggtaaaaaaaagcgagtaaaacgaaaggggaaattcacctgccccattgtgaatagtcccgtcgtccccttcctcctcttcctcctccctctctcctttttcttcttcttcttctttcgaggagaggaaggaggcagccgcgcgcgcgcggaggcgggcaacctctcctcgactcctctcccccaccgtttcgtcgtccccgcgtgagaggtaaacgagctcctcatcgatcgatttctctctctctctcgccgcgaattcgcttggtagccatgcacgcgcgcatggagggaaaccttttctcttttgttgttgtcgtcgtcgttggtgcatgtagcttcgccgtcgttagtacgtgacaacctccggcgacggatggatggatcggtggcggcgaggcggccgcgcgccggccggcattttgctatttttttttcatcatgatgacatgagcgcgactgcgtacgtgcttggtggtgcaggaaggggaggaggcggagatggcgggggaggagcggccggagcggatcgtggtgtcggtgcggctgcggccggtgaacgcgcgcgaggcggagcgcggcgacggctccgactgggagtgcgccggcccgaccacgctcacgttccgcggcgccgtccccgagcgcgccatgttccccgcctcctacagctacggttcgtacgccgccgccgccgccgaatgcaattgcaaaccgctctcccgctcaccttctcgccgtggtttccagacagggtgttcagccatgagtgcggcacgaggcaggtgtacgacgaaggcgccaggcaggtcgccatgtcagtgctcagtggaatcaacggtaaccaaaaaaaaaagaacaaatccattacttgtttgcaacgacgagctcttcgtcgtcttcttcgtcgcgatgaactcactcgcgagaatctgctctgacattgctgcagcgagcatattcgcgtacgggcagacgagcagcggcaagacctacaccatggttggcatcacggagtacagcatgtcggacatctacgactacatcgagaaggtgatcaatcgcgttgactgaattactgttgattttgtttgcataattgcgttcggtttttgatttacgagtctctgctctgcagcatcctgagagagagttcatcctgaagttctcggcaatggagatatacaacgaggctgtcagggacctcctgagctctgacgcaacgcctctcaggcttcttgatgatccagaggttacctttttccttgacatggtttgctgattaccttcaacaaaaatcctgcaaaatttatcacattttgctgttctttctgaatgcaaacagaaaggaacagttgtagaaaaactcaccgaggagactctgcgagacaaaggccatcttctggagctccttgctgtgtgtgaaggtgtggaaatgaattttctttctttcttcccagtgaacctggatatagcaataagagtagcagctcatttgtttcttcagtctggtgatcattttgtttttgcttgtgtgacagctcaaagacagattggggaaactgctatgaatgaagcaagctccagatctcatcaaatactcaggatggtttgtgctcatatcaagctaaattgtttgcaacagactttttttgtaaaaaaaaaaccggttcttaacctgctttgttaactgtagacggttgagagttcagctaagcagttcttggggaaaggaaactcgagcactcttattgcttgtgtggtattgatgaaatacctgcatcttgtaagctttgtattattttgcacatgtttttccatagaatctgagtttcttgtggacagaattttgttgatttagcaggaagtgagcgtgcatctcagacggcatcggctggtatgaggctaaaggagggcagccatattaacagaagcctgcttactctaggaaaggtcattcgccaactcaggttcacagaattctcttctgtgtctttcaaatcattctacaagttcatttttctctctctttcttttgaaacaagacatcttcatttcatttaaaatgatttctgaacaacttcttggtggtgtagcaaggggagaaatggccatatcccatacagagattcaaagctcacccggatactgcagtcatcactgggaggcaatgcaagaacagcaatcatctgcacgatgagcccggcacactgccacatcgagcagtcgaggaacactcttctgtttgctaactgcgcgaaagatgtcgtcaccaatgcacaggtcaacgtggttatgtcagacaaggcactggtgaagcatcttcagagagagatcgctaggttggagaacgagctgaagtttcctgcatcagcctcttgcacttctcatgcagagattctcagagaaaaggatgaactaattaagaatgtgtgtactgctcttggatccttctgttttgatcttcacatcgatgataatttacagttcttcactttcaaatgtccccaagaaaagtactgaagttcttttttttggggggtgaattttcagctggaagaacagttgaaggaactgatggagcaaaaggacaccgttcaatctcagcttgataatttccgcaaagttgcgagcgacggggatatcaacaatcacttagcaaggcgatgggtacttctcttatgcactaatgtgttatctaaaaaaaattaacaacgcaacagtgttttagtatccaactaatttaaccttactctgatgttcttcacagagtcggtcttcagactcgattccgcgcattgtgtcagaaggtgcattttcatcttcagatactcaagacattgactatcaagatcaaacaatggatgaactgtcagtacctcactcgtttccaccaagcagccaaatttctgacatcacagaggaacacgaagcacagagagtagctcatcgagctgaatctgagccccctgaggagcactgcaaggaagtgcagtgcatcgagacaaacaagctcaggagcaggagaagccaagaattcttccaaacacctgaaaagaagacacacactgatgatcaaaagcatagcgaaagcatgtcaaattcagcagaaaatgccatcaagctatatgcgtgtgattttgagccgtcatttgatctcgagaagcctgaaactgaagaatctcttgccctgaagaggtgtgtggttagctccagggacagtgcgcttactaggagtagaagctgcagagctagcttcatggtcattccgaacagctggttcgatgactcggcgagcacgacgccgtcgtccgaaaccttcagatattctaccagaaggccagagaaggtgaggaaaagcctgagtcctgatgagatcgcagacaagagcacgggcaacgctgaagaagacaagagcacctgcaatgctgaagaagagactgctgtgaatgacatcggctgcgtcacagaagtgaagcagaagacagaaatgaaccatgcaccccaatcttcagagcaacaccaggtacagtaaaaatgggaaatctctcttgagaattctctctccataaaaaccattgactgcaacatttacatttctcttgtcaagccgatttcactctggtgtactgtctgtctactattgattcatgcagccgaaaattgctaaagaagttgccacggtctccctttcgaaatggcacatcgatttcgagagaaagcagcaggagatcatcgagctgtggcatgactgcaacgtctcgatcgtacaccggacctacttcttcctcctcttcaagggcgatcagacggacagcatctacatggaggtagagcacaggcgactctccttcatcaagaactccctcatcgcagacggcgagctccacgctaccaccgcatcaaggttcagagacgcatctctgaaagtattctgaacaccgtcttgatgagcagcatgacaaacaacattcttggtggtctttgcagcttgaggaatcttcggcatgagagggacatgctgtacaggcagatggtgaggaagctgcacctggccgagaaggagaggctgtacggcaagtgggggatcgacatgagcaccaagcagaggaggctgcagctgtcgcggcggatctggacgcagaccgggatggatcacgtcagggagagcgccgccctcgtcgcgaagctggtcgagcacctggagaaggggcaggccatcagggagatgttcgggctgagcttcagtttcaagccacgcagatctttcagctgggtcggcgtctactcccgagactgaattcttgcccggccatggcgatgaactgatgatgatgtctcagtggtagatggatgcgtagtggaggagacgatgctgcatgtcaggaaggagaggagagagattttgccgccggaattgaactgatggattgccccgttctatctatgcatgtgaattgtgattcagattttttgcttctggcgtgagttcctgagttgtggaaaagaatcggcgtcgagctcctctccggcgaagttgtggcacgccgccgccggaaccgcgtcgctggcggcggcgcggcttctgctcggcggcgaggcagcaacaacgacttgggccggaacgagcttctcactaacgtgtgggccgaaatgataattgggccgggcagccgcatggacctaactgttaattctaagtaataggagggacctagtgaaaataatgcagccacgacgcttcctattcccaagcccaatctgatccgcacaatattagatcggacagtacagatagtagcgatccaaaactggagggtataaaaagacaaaatctaatattacaagggccttatgaaaaaaattccaaccgtacgttctttgacccgatctgagccgcacatccgagatccaacgtctcacagaacaagccaattcatattgggccaatggcctatcagattcgactgggccgagaggacacggacaagtgggcctttgcttaactcgacgtgggcccaaaaacccttcgtccctctcacttcgcttctcttgtcccctcccccatctctgcgatccaaaggcggcggcggcggcgagctcggtggcatggcgatgcggctggcggcggcggcggcgttcgtgcgacgcctcgtgccggcgcgaaatccggtgatctcggcggaggcggaggcggtgacctgcgggcgcggggacaagaagaccaagcgcgggaagcggttcaagggctcctacggcaacgcgcggccgaagcgggagaagaagatcgagcgcatcaaggaccgcgtcgaggtgccccgctccaccccgtggccgctccccttcaagctcatctgagccaaagcccagcgcgagctcccccccgtcggttcgtgaggctacctagggttttcctttccctttttcgatttggtactcttgtccaactcttgcgcctgcgcccacgcttgcgtgggcacgcatcgtttttttagttcctcatattgggctgtgtcagatatgtattgtcgaatcaagctgccatatcgcaacattgtagaatgcagtccatatggacgaaaatatcatcaccatgtttgtttgtccagtgtccttttgctgggtgtcatctggatggtgataatacgcagtttatgataattggaaatggaatttacggttttggattgattgttttgtgcagttgctgataatgtgatccacggttgttaatacgaacacaaaatggatgggtaacaaacgacttagccaattagccttgttttgtttcgtttggcagttgattagcatatattcagtgaattatattttcttttaagaaaatgatgcctggtactttgatcaatttatgttgtaaactgaaataggtccgagtagtagcgagcagccaggcactcgaatcactagtataagtctttgtttctttgttatcgtcataactggattaatatgtgtggattcatggtgataaaaaaaatgttttggccgaagccaacatttccgtgcattgatgtttattcataactggattgtatcaaacttctgatcttaggttattctgcacatcgcatcttgatattcctaatgcattcctgatagattagacttgaagcttgccctgtgttgagattggtggatttcataatgataaaatatgttgactggtgtttaatataccatcatcttctagtgcatgagcttacgctccgctatattggtaattggtgataacttgtcttgacattcatgtcgggctaaagagacaaccttactgtttattaatactacttacttgattgtctttacaaagtcagggaaatgtatattattttgttgcacgtttctagctggagataggaccccgacactttatactcagctctcacatcatgcttgaagaaacatattcatctcattgcattgccaatccgaagctctggaagaattttagtgactctggcagtacaaagctctagaattccatgacattcctctttgcttagcgatatctgttgccattgcaaaatagacaaaaaaagaataatgctatgtgatgtgtaccaatggcttgctttgcacgtttcacgtggtgaaactttgtagcgacaagctgacactctaatgttagtttaagctatgctgcgagataaacaaattttttagtctcctttttcagtgctagatagggaaatagggaagagttccagaagggtaatttgttctggtcttttggtagatcaacttttgtgcatgcaacagcttacatatgcagatatatgctcatattagcaagtgttcctttatgcttttctttattgttatttgagacatcataatgtatactaattactgtaacagtgttccttttcaacaaatcctcatcacaattgtgtttgtacaagaataagagctaatagatctaaagcataatgaagaatcaacacacatattagtgtctttacatctataagatatacatggtatggagattttaaagaaattaaattatgtttataagttcagattttcagttcaatagcaattaagaatactaatggaataccccccccctctcctttctctcttttttaatttctaatgggtaacacagactggctgcactttatatagatcacaattgtgtttgcttccatctctagttacaacgttacccctatgtagatctattccctgctgtcggagaacctgttgattctgcatgtttattatgtaagaaatagtaaatcatactcgaacccgtttttccttccaaaactctacttggtacctatatgggtttgatgctaacatggacaaggtactggagtggcagagcccggatgataattggcactagtctatgtgttactttttatgtgctgttgttatcagtccatgtcatttgacattcacatttcacgctgaagttgtcggtaacaaattcggtgcagtgaagattaacatcttgaatgcacaatttgggctactctgacatgttggcaagttgttgatagtactagtaaattctactgcaattttctttgtgaagttgacaacttaatgtttagaaccaagtcttaatttacaatttatagatcatgctgtgtcaaagcttctgattacatatttggctgtgtactactgttagcagtcatcaccacatgtccacacactgttttgttgcttagatttgcaataattatatgctaggatcccaggttatccgcatggaaatttaacacgcctgtggattagcctggttctgaccaagaatccgaccaatcctgttcaagtacttactcgagtgaagtttagacattacataaataaaactaataacaatctgtctggttttgtcaatggataatggaggtgtattactgacgagtgacgaaccaagatggttgccgtcaggtatggatcatagatcgatgaacagctcctgaccatgacaggccagcgaccacaatggaaagattacgccgtacgtacgatcagtcttcattcctcataatttcattgttcgtactcctttttgtaacaccatttctcgtagcaaagcaaagaaaagcatcatgcgaattgactaacagcagcacacaccacataaattctgctcgatatttcaacgtcaccattgtcacctgagggccaatgtaagggggtgtttgtggttatcagtcacattttgttgcatctagtattagggaagtttaatcacactggcagttgtttagttgtagctatagttgtgacaagatttttttttaatatattgggtcaacttaaaaaagtttggtaagattcacttagacttgctaatgtacgaccaagaatttaattgtctcaacttaaacaagtgtaacaatatttattgacaaatggacggagctcctcttacgtaaagtcagagggacataggtccctgataggtggggccggcccatacgtcggtgaccatgtccctctaactttacgtcagaggagccctcaatggtgataaagtatgactgggaaccaaatacaaatactccgtgctttctccatcctaaaatataataacttctaatatttactccatccatttcataatgtaaaacacaactattttttttcatatatttcataatataagatgtgcatacatacaattaattagtatcttctcaccaccaaattattattnnnnnnnnnnnnnnnnnnnnnnnnnnnnnnnnnnnnnnnnnnnnnnnnnnnnnnnnnnnnnn

SEQ ID NO: 54162 - DNA, 8880 bp, Oryza sativa
tactccatccatttcataatgtaaaacacaactattttttttcatatatttcataatataagatgtgcatacatacaattaattagtatcttctcaccaccaaattattattttttttaaatcctcaatcttcaacatctctaattttgttggatgcagtattatatttatcacgatgatttaacttaggagatgataataattgtttcttggtttttagattaaggttgttgttctatatattttggattgtagggagtaaaatttaatttgaatatagtaacttcttcacctatttcagagtacgagacttaactgctgtgcaacagtgctagggcattttctttttgtttttgaacttaaagatgagaggaaaatcaagataaaaagatgtcgatttcatttgggctctccatatacggagtacatcttgaattcctgagatatcctctacatcggatgagtccagatgagtcaaacatgggatcaatcgtcgtcatcgatccgtccgacctgcaggataggagaggtcgagatcgaataggccggcgttgacgcctcctgttcattcctggacatgtcactggtccgagaaaccatgtccattccacttctgctaaatccaagctttttctctgcacatacacatgtactgcatgccaatgccaagcatctctgcattcacgacacggatgcgaccctgttcttttctccaacaaaatttattggataaatttttaaatatttgtgacacgtttttcaaactgctaaatgatgtgttttgtatgaaaacttgctatatgaaagttgttctaaaatatctaattaattcatttttcaagtttgtaataattaaaatttaattaattacatgttattgccgctttcttttacgtgaaacacttaacctttattttatctttagaagattcaaccaccatcgcatcgcaatgtaccgccacaaagagagatcactgttacactgtatcagtctcaagaacattgggatggagaggggaagaaaaagactgagatcactgtagtggtgcatatatatatatacacacggaggagaaaaaggcgatgacagagatgaacattggatgccagtactgtatctactagttgggtcggcatggagcgtagggctcaccggcggtggccaccaccacgacgtacgtacacgacgccggtcgtagcaggtggccgtgccgtcgtagcgtgaccgtgcacgcaactccggccggccggccgtccgcgacactgcagtacgcagcactgcactgtagctaggatattggtaagatcggtatcactttggcgtgacaggataccatgtatcgtaagatatattatgattagtgtcaagatactgacaaacttggtaggcagcattggcactgtggctagtataaccacagaattcttaggtccgtttgcttttcgattaacacatactccatccgtcccataaaaaacaaactttattactgaacatttgaacatttttttagtacaacgaattttgataggctcctattcggatttactacctccgtttcaggttatgagatattttgacttttcagagtcaaactgcttcaagtttgacttaagtttgtagaaaaaaataataacattttcaatccaagacaaatttattatgaatatatatttaattattgatttaataaaactaatttggtattataaatattacaatatttgtctataaacctagttaaacttgaagtagtttgactttaaccaaagtcaaaacgttcagtaataggttggtttttttaacaaaaagtagattttacctcaatttacattagcacatttttttaaaaaaataaatggtgtatttgtgcgaaaactctagacaaatattttttaagtttaaagtaattaaaagtcaattaattattcaacaatgattttctcgttttacagtgcactaatgactattatgcagtaggattggctaggatatgcggtaaagattggtatcattcagcttgataagatatgataagatactaggatacgtgttgggacatggtaaagagcctcgcaacactgttacttctttcatcttaaaaacaccataaatctaaatatagactacatttagggttgtaagcgggccaacccgcgaacccgtttatagacaaaatttatgagtaacctgtgggttgactcgcgggttaactactaatttggcctgtaaataggtttatgggttgatctacttgcatctctacgacgcggcaagccgagccatgacgtgaaaacctgcagattaccctttatttaacatatatgtaggttcacggatcggcccgcttaccttcctacctacctatattagaatttagtattttatatatgcgacggagggtgtaaccgtgtaagcggccgcagttgccagcaattctgcatggagggtcgagggatagaagcagtatacaagaaggtcacaaagctgtagaaggagctagggaaggttggcagcagcagggcggcatggggggggggggggggtgacctgaccaatggggtagagaaaggtggacggcgacggcaacggcatcatggaatggcgatggatggggcggagctaatggccaaatccacgcactgtggacggggacggctgacgagatggcgccacagtgccgccgcggcaatttgtcagattccccgtcctacgtggaccatccgcgcacggctcgacctcctcccaacgaccaaactccctccgtaaaaaaaaaaaaaaaaaaaaaagaaagaaagaaagaagagagaggagtaagagacaaaccttgagtttccatgtccaacatttaaccatccattttatttaaaaatattatgaaaaaaattaaaaagacaagtcacgcataaagtattaattatgttttatcatctaacaacaataaaaatactaattgtataaaaaatttatataaaacagacagttaaatattggacacggaaatacaggcttactttttttttttttttactacgaagggagtacacagctcgatcgacgcggtcgagctctcgcgttgctggccgattcctcgcctctcgttcgattgtcgtcgccgttcgcaacgcaaaagggagatttgtatatagtacaattttggttagtacggagtattagaaaatcttagcagtggagatcttacaaagttcggtcgactaggttacaagatgcgatcgggagtcaaaaaccgattcctatttttctaacagtttcatcgatatctatgataatcaagcgtatatggaaaagataagataaccgatgaaactttttttagtagaataaaaaaccgatgaaacttaataaatattgctactccgtcctaaaatataacaacttatatcatttaaaatctaccttaaaatataataacttttcaacctgtcgaggggtgaccctctctagcgggaggctgtgagatcccctttgtgagtttagtcgggggaccgggtgcaatactgaagagcgtgttctcgtgcgagcgaagtgagtcggtgggggtcaagcttgcgaggcagaaggcgagagagcgagagagagggattatacaggttcgagccgctacggagcgtaataccgtactcctgtttatatgatgatcttcgtgtggttacaaagacttcagatcctaggagtgctagctagggcttggccggtctcttcccagaatccggttttctaagagacgtctctttactcgttgggtacggtcctcctttttaccatatgcaccgcccctacgctctcctcacaggaaatgggcccacattgcctatattaacaagcatctcatgccttgggtcggaagcgatccacgcggccgctcttgggtggctcccactgaagcttttcgtctaacacgggagacatcccctgtcattccctattaaatgtttggcaacttcgtaggcacacgcgcgtgggaggtggcgacctgcatgtccttcccttgcgcatgatgggacggggcataccagctcccacgccgcctgacacgaaacgggacatggatgcgttgcctcctgtcccatccatccgtcgccgggtcacagaccggtcaaaaagtggtcgccaggcgcacgtctatcggcgtgcggcgcacgacctgccacaccgtattaaatgcaactggggcggttagggcgctgcccataaatgcgcctggcggacggtactcccgcccgctcaagccctcacacagctgccacgtggcagccgagcgagggcttcggggcgatccaacccctcgggcccgaggggtgtgacggggcacccttgatcccgagagtggggggggggggatggccgctccttttccgagggcgcgactcactcgggggaactaggcccaccctacgtgccatacggaaagggatttctttccccctagaccggggaccccgtgcccatatcaccgacacaacctatatttttcttctcaaccaattataattttctaccatttaagttcttcgtccacctccttccatcagcaaaccacaaactctttctatttaatttcacatatttattgatatccgtgtctaacataaaaacccttatattcttgtaagaggtagtactaaattttcgaaatttagtttcttttacttttaatttttttgccattttagtaagcgatttctaacatggtaatattaataacaagtagttctcgtcgcattttcaaacatgtattcttgtcaagttataacctcgttcagattacctgcacgtgcgacggtggtgttatcgcgtcgtgtccttcttataagtgtcgcttaggaggtttgttattgcctcttcgccataagatagttggatcgatgattttggatgcggctggtctatacaaaggatgagtggatctttttctctcttgctctctccagatgcgatctttctctctcgctctctttataagatagttgtttggaggcgttggtggacggtttagtggcggctgtgttataggtttggcagtgtccatctcgcattgtcaccacaaattggtggtttttcttttctttttcctgttaacaatctctcaaggatgtagttttcaaaaaaaaaaatactatatcgatataaaacattgcaccatcttatactatttgttttaaaaaaaaacactaagatgcatatacataccactatacatgcaagcacccatgagtgtgcacactttaccatacataataaatgaagactagcagtaaatttctaacctccatatctcacaaagttttgattgaaaatatatatgcatgtgtgcaggggcgttcctacactatactacccgggtaatgaccccgggtagaattttaatatttagatggtttagtctatattaactatattattagttaaaaattaactaataatatacatgttatgacaggtaaaagacctcggtaattttcgttctggattcgtcctgcatgtgtgaaattctaaccattaggtttttttaccctgatcaatgtactcataccatcacgaaatttaccactgtcgcttcttctcttatcaaattttcgaggatgagaaacatgttagtaaaccttttcttgcttgcacaaatgctcgaaaatgacatggatgagacatatgttatttcggttgtgtatgaaaagcttttagctactgcagcttatccaaaatcttaagcttcccaaatagtttagattattacctaaatcctaaatcaatactaactacaaaatccaaagaaacaggctagtgataagaaaccgggaaacacaaccttttagattcttactagctggctttttattatttcccgtcccaaaatataacaacttttagccttttaaatttgtcccgaaatataacaaattctgcatcaatattcacttctcaaccaataacaacattccactgttcaatttacccacctacctattatcaaccaatcacaatctcccaccatttaattctacttactttctaaataaccgtatacaactctaaaactttttatattttgagacgaaaggagttattgtttttcataatctctagcttctcaaacataaccttgtaaaaaagggcagaaaaggaggcatttccttttcttagctgtccaaaatgagagcaaaataagattaaacacggcagaaaactcaactatatgagaagaacatgacacctaaaggaaaccttcattgcggctggtccataaaaaacaaaaggcaaaaacacatgttcagtcaacgataagtaacttgccaagacacgaaatttggagtgtggcgccgataactgataagataggaactggaaaagcatcaaaccagcaaatcactaatcagcaaacagtccagctttggttagtggatctaaaaggaccaaacccaagtgcgtcgtcaaacttttctgcttaacgatcacacgctgcccaaacaaaactcgccagcggcatcgctgggaaaggacacctggtgacatgtgcgagactaacagcaaatgtggctatctttcactgaatttccaattcaatagtaacactggaagagtgagagagcagcctaatccacctgctcactctacctgtctttttttatgtcagggataaggtacctgtgtttacaaattacacatcaataaactgaaaattaatgctccacgtgggcaccgtgtccacataacatagtgtcagtcaacagagtatttgatgttgattacacacaaagatgattttccagagtacagggatgattactgcacggaacgtacaaggatcaagggctaattaagtttggtactgtgccaggtagtacttgagggtatatttggttgccaggcaggttgtcgcaatttgctgacagaagtagacaaacttactcaaggtttggtgttcagagttcttaacaagtctaacagaatcttgtttcttttttaacataagccagcaaatgcttatgttatattgagcagatgagtagtagaaatatgtataacttcaccaaagatgaagaaactgactccagtagcccgaagacagccgagaaaagaaaaacgcacacatatgcatcagttttgtaagttattgatgcctagtaatttgttggaagtgaattttcctacaaatatggctaaccaaacagctaatgtttcaaatcacttatcatccaaattttgtttgaagttaaaacatttatatctttgactatcaatatttagatattaatatgatttaacattacaatatttatcttttttcatcatgacaagtatttttcataaataatattacaattcatatgttgttaagctatataatttttttaaagattgatagtaaaaaagataacatcttttacttaggacaaagctaaaaagataggtaattgaaaaaaagagtatttaaattagtttaactttagacgcatcagattgtgacaagttagcaagcaaacatcccctagctagtgagcctgagtgtttgctcaggtggttagtgtcgccggtgggcacactacctgcgagcgttcgaaccctacgttcgatggctcgtgctctcctggggaggttttgttttccctttttttcccgagactgacttcggttggttccggttaggtataagggtaaacatacacgtgagcgttcactggtactgcacgtttccggtgcctccaatttcattcttagcgtgtgttagggatacgcaaacgtgtgtgcgtgtggcgtggacttgtggtgtatgtgtggtgtgtgttcatgtgcatcctgaattttacttccctctaaaaacacatcccctagctagtagctgctggtaaactaccgtcctgagcaacagagaagcaaagcaatgagttgacgcgaccgaatccgcgacgccgccctcgcaccgcaagggccacgccaatttggtgctcgatcgatcggaacgcgcgcggcgctccacggccatgtcccaccgcacgaaccgcgcggccgcccgccaaccgagctagcgcgcggccccggccgccgccatgctaacacacacccgatgcgttgcattgcatggccgctccacgacgcctcccgcccgcctcgcgccaccacggccacgcggtgcaccagctatagctagctagctaggcgcatggggagacgctccacgacgcccactgcactcccgacacgtttcccccaaccaaccaccacgcaccaacccaaaaccatccatccatccagccagccaagccaatctcccggctccctccgctacgcgccccacgacctttttcccatcacccgcccgcgcgcgcggtcgagcgcaacgcaacgcaactccaccgtaccaaccgcggcgcggccgatcgatcgacgcgaatcccgcatgcgtatacgtactattctacgtgaagtatatgtgtagccgatcgagccgtctcccaccgcgcgctccctccctgcccccgcgacagcgacgccgagcgagcgagagcgcgcagctagccacagcctccagagctatagctacagcgcgatcgagagagaaggggggagacagtgaggccgagagcgagagggccagccacgcacgcacgcacgccaccgcgctccattggccaccccctcgccatcgccacgattaaactactctcttgctactccccctccatccatccacacactccaccatttcctcttcttcttcctccatatcacacggttttcgtccatcgatcatcagagctcgatcgggcgccatggatggggaggaggacagcgagtggatgatgatggacgttggagggaagggcgggaagggcggcggcggcggcggcgcggcggacagg

SEQ ID NO: 54163 - DNA, 4377 bp, Oryza sativa
  unsure (1)..(4377): unsure at all n locations
nnnnnnnnnnnnnnnnnnnnnnnnnnnnnnnnnnnnnnnnnnnnnnnnnnnnnnnnnnnnagagagaaggggggagacagtgaggccgagagcgagagggccagccacgcacgcacgcacgccaccgcgctccattggccaccccctcgccatcgccacgattaaactactctcttgctactccccctccatccatccacacactccaccatttcctcttcttcttcctccatatcacacggttttcgtccatcgatcatcagagctcgatcgggcgccatggatggggaggaggacagcgagtggatgatgatggacgttggagggaagggcgggaagggcggcggcggcggcggcgcggcggacaggaagaagcggttcagcgaggagcagatcaagtcgctggagtccatgttcgcgacgcagaccaagctggagccgaggcagaagctgcagctcgccagggagctcggcctgcagcctcgccaggtcgccatctggttccagaacaagcgcgcgcggtggaagtccaagcagctcgagcgcgagtactccgccctccgcgacgactacgacgccctcctctgcagctacgagtccctcaagaaggagaagctcgccctcatcaagcaggcacgcacatcgtcgtcctcatcgattcttgatcgctttctttcttgcttgccttttgcatcgattctgacgcgtgatcggtgcgttcttgcagctggagaagctggcggagatgctgcaggagccacgggggaagtacggcgataatgccggggacgacgcgcggtcgggcggcgtcgccggcatgaagaaggaggagttcgtcggcgcgggcggcgccgccacgctctactcgtcggccgagggtggcgggacgacgacgacgacgacggccaagttgatgccccacttcggcagcgacgacgtcgacgcggggctcttcctccggccgtcgtcgcagcatcatccgccgccgccgcacgccggtgccggcttcacgtcctccgagccggccgccgaccaccagtccttcaacttccactcgagctggccgtcgtccacggagcagacctgcagcagcacgccatggtgggaattcgagagcgagtgagcatccacactgttactactaggctactcatggatgatccatcgatcgccacagatcatgcatgccacgatcagaatttcaattcgccgcgaggacggatcaaacctgtactagatcggatcagagcaaacatagcagagaagatgatcaaaccaacagtgatgtgtacatagctttctgtagatcaaaaccccaggcagtctcctctccatccagccatcagcatgcgaaaattctctctctctttttttcccctccaagtcttactcgacttcgatgttgttatcacaacaccacatcatgtaatccagcaacacgccgagatgaaaaaaaggttaaaaagcttatagagttcgttcatttgatggatccaatggccgcttcagttttcgcctttatgatttcttccaatggatggatcaatgaatctttatgctttcttccaatggtggatcgatgaatgctacaaaaaaaaaaactagataggttcaagaaagaaagaaagtgaagagaggaaaaggatgtgtgcatccatgtagatcaagattcccgagcaggtgaggggatgagaatcgaacaacacacattcgctcactcacacgtactacgctacagtacgggacaatacagagtggcacagatcacagaacatgcgagccgccattgttaatttcaagcaaatgtaagaggcgcgtgggattagtcagcccaaatatatatatatcataccatttgatcggagattgattttgtagtgtagtgtagtcctgatcagtttagcacaccccatttagacacaaacctttgcagagttgggacaaattaacccgaactcatggcacctttggaacctaattaagatttctacagagttttcatatatagtagtttgattcctacgaaaatctttcaaaatcctcctgttccaaacgagcccttcagcttgctgcgcttacaggataaacgactgatgagtagtcgcatttttctgcaagatcagaaggccattttttatgactaaagctagaattttgtgagaaggctgaagagtgcaaggctgagtaatcaatccggatacaagcagtagcagttttagtcaaagacaagacccacccaggacaatgacagccaccatgttaatccttcgtttatcctaggtagaagtgatagtaataatttacccggcatacttcttttccatcctgacagcgaccagctccaacgtgtcaacaatccagtacatgctagctcacccacaaggccacaaactaaaatggtgatccaaaaccaaaatttcacttatcaattaagcaacttatttacttacagtaattaatggcgatggtatcacccactgtttcttgggcacgtacgtaaccccggacgaattaggttgctttctctggcgaacgatcaggtctctttctttcgtcttcaactgttgtgtgggctccatggcataattacatgtcactgttcagacacagtgacgatcagaatcgttgaacacaaattctatgttcgatgggcactagccaagcagccaagagtatgaaactctgaaaaagaaaaatggagaggaaaaaatattgagttgagcttgctagctccagaatatcacaggcgcttgtcgtgttatcttgagggtggttagcattgcttccatctaaccgatatgggttccactcaaatgtgacaactcatgagcccaacatattataagcaaattgcaatcctgtcaagaacaaagaccccatcagtgaaggcaaagggcaaagcaaagcaaatataatggactagcaatatataaaaaaaactcttcacctagtcacagaattgtagccacttgtacaccctgtgatgtgaatgcaagggttctgtcatcaagccgttgtccacgtggattgcttatcacttactcgtgtgacattaccttggatgagttagaatatacagaggcttttctcagtggatgcttgatacactccaataagagactgaaagactccaagcacgcagtttcaatttggatattcaactttagatgcgattaggtgtcaactccagataagttgcagatcattcaaaagatgagcaccacgcatggtagtacatcaatttactacatatctggaacacatgatttacgtaatactagtaataattaaaacaaagatttgtatggaattcctagagatgaaactcagtggaacaaacagggtcttgcactctcatcttcatccatggacgtgttgtactgggagtttgaaaccaatagcatctttgacttgattactgatgcacaacgactaaatgatttggactaaatgatttggatacatagcttttgggacttatctgggcaggcgtgactcgttaatttaaaaagctcccatgcttggaacaatccaaagactggggtagtacagccatcaaagaagaaatatgagaaaatgatctcaaattattctcacatatctttcaaaataaacatatggactacatcatacgatcgctcgctacaagtcactgttacgtcctaaagatactctgcatctcatatatgcttatatacataatattccaggctgatgtcaagatcaaggtttacttctaatttaatgcagtcttgtattcataatatatcttccgtccccttaagttccattagaccatagcaaattccatggtagctcagtagctcaccatcatagtatccacgtcactttaggagaaatcaccaaacgatttaagtacctgaattaattgcattcatgtgataaactggtgataatagtcaaaatcataaataggaaagattagacattgaagcgccccaagtatacagatgaatttcctaatttcaactagctgacttcgaaagggaaatcgaccagccaacacagcataagacaaccgtttctctgtttaacaaaccagaaggcaatctatcctatgtactatataggaccatagactacattgcagaaagaatctaggggcaactgccaactggattagcaaatgaatggagtacacagcagtatccagtaggaccagaatgaggaaatggttatcagatcagacgaatgataagatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaccgagctcgacttcgccctat

SEQ ID NO: 54164 - DNA, 1109 bp, Oryza sativa
aaactaaaggtaacccaattcctttttgaatcgatcgtgcaaggttattatgcgaccttgcatggatgatggatggtgcatggccatgagacacggcgtcgatctagcgatcggctttggcgtgtcccgatcgcgccgacgcaagccggacggtatgggagggcaccgccgcaccggggcaacgcgacgcacgagagtcgagagatcgaaagcaaaaacagccgagagatactgcgccgcgccgcgcgcgtccgcccatgcatcccaattatggcgcaaccgcccgcgccaccgccgccgacgtcgcgtcgcgtcgttcgttcggtacgcggtgcgtagcgtacgtacgtgctccgcgccacgcaccgcgcgcgcgcatcacgcgtgtgggcgatcgatcgatcgcgcgcgcgcgcgccgagctgatgggctgatgcgccgcggcgccgggcggcctcctctcctgaccaattcaacacacacacacacacacacacatcccgtagcctcatcgcagttaacgcgcccgtgtcccgccgccgttgcggccggtcgcgccgagaaagtagtggagtacgtgatcgatcggctgccgaattctgataggatcagagtatcagacagacgtcgtcgttcggcgataatccctatgcatgccaagacctgcaggtcggatatacaaacacatatttaaattattaaacgtagattaataataaaataaattacatattccacgtgtaaactgcgagatgaatttattaagcctaattaatccgtcattagcaaatgtttactgtaacatcatattgttaaatatggagcaattagacttaaaagattattatcacaatttatacgcaatctatataattagttatttttttcgtttatatttaatacgccatgcacgtgtccaaatgtttgagtgacaaggtgaaaaaatttgccggaatgtaaacaggtcctgagatcaaagccatcaaacacacattgattctctctgagcaaaagaagcatcttttaatttagatgctgggagttaatagagttcatgaagaacactggggtgactgccaatctcaattggggggggggggggggggggg

SEQ ID NO: 54165 - DNA, 6772 bp, Oryza sativa
  unsure (1)..(6772): unsure at all n locations
caaatagtgacctcagtcctactgtacagcgtatgtctttgctagctgctttagtcattacatcatgaacgaaaacataaaaataagacatgaaataaacgcgataactttacaaagcatacaatcaagcaaaaagaaagtgcattctcttgtaggccgcacgcctttcaaatgatgccaagttcatctattcaaatataaaaacgatgggcatgatgtacaaattaattgagacgcacaatttccacatgatttcattactagcttgcatttatgcattccatgcatcgtgttcataatcccaataaattaacatataaaatcgcaagtgttcactgattatattaagttttcgttcgtcataattggtaatcagctcatatatctcttgattgaattccattataaaaaaatcaccttatgttgtttttactcatctgtcctacaaacttgtcgtcctagtgggcattcataactgttaggaattattcgcttataaatatcatacaaaatggctttgatctcagaccctgtttagattcccggcaaaatttttcaccctgtcacatcgaacatttggacacatgcatagtgtattaaatataaacgaaaaaaataactaattacatagattacgtgtgaattgcgagacgaatcttttgagcctaatttacgccatgatttgacaatgtgatgctacagtaaacatttgctaatgacagattaattaggcttaatagattcgtctcgcagtttagaggcggagtctgtaatttgtaatttgttttgttattagtatacgttttatacttcaaatgtgtgtccgtatatctaaaacaaattggcacacgaactaaacacaacctaagctgaaaaggaaggaaggccgaggagagataggccagatagaggtagaggactgctctaggactgagctgaaaaggaaggaaagaatgaatgttcggtctaaaaataagtaagcattcagtccaaaaccaagagagtataatgtataggacaaaaaatgtttttacccattgcaacgcacatgtgttttttctagtaatagaaaaaaataatatattacaaccatgtcgtattgtggttacaatagctgaaaacaaaaatatcccccaaaatgaaaaaagggttgtacatcctgtaatgccgtaagagatgaggttgtacatcctgaaagccaaaaactatcaactaccatattcattcactgaacaaaataacaaaataggtccatcgaacaagttagcaacccagaccttaaagtcaacctcgcagattcgatcatcgatgaactgacaaaacaaacagtactaaatatcctttgaggatcctatgtactccatctagttttgtactccatctagttttgatagtcatattttatcttggcatacagaccaaagataagtaattatacttatcatccatttaaacatgatattattggttattcctcgtaaacaagcgattcattaatatttatatttctcaatgcacatgtagccaatcttatgtagaagagtggagagtcatacattaaatccagaaaaaatcattaagatgataggttgttggattgaaatatatctatcaaaaataaatttttcagatttagaaatatgcatatgaaaagtagatggacggagtacaaaatagactcgaacaaattgaatagatagaaaaaagcacactgaacaaatctaactctatcatgaaagacaaatcataaacatggagtgaatgtaagggttttttcagaggaccttgcggcagctttagtttctctcgaaatcaaaatttgacagatttgcgaccaaaatttatgtcggatgttaaatagcaaatccgataattgaaagcatattgatgtatgcagtcacaagaccaagcaaggagtactagaaagttcagtgatacgaatattggacgaatacctgtttaaatgtagcgagacgatcaacgcctgatatgatcgccactactagatctatatagcgtgcagcggggacatagtcgtcgatcagctgcttcacgcacgcatgcttgtgcgttgctcatcagctatgactacatatgacacacaccgtgtgtccgtgtgtgcattgcgcccatcatactgtccatcccttgcagagtcgtcctagtactcgtatattattacgtcgacgccgtacatggcaagatcagtccatatataggtgctgtacatgccagccagccagccagcccaatggggaaaaaagcggcatatcgtcgcattaatccagcgtccatactccatactactgtacgcgccaggcatgcagccagcatgtcgaccagcacgcaccgaacagttacaccaccacgtcaatgaacgtccaagcaacgcatcccaacaccaccacgttaaccccgcgacgacttcctccgatcgaaccacgcgcgggccacccgaacgaacaagcgaacgaacgagcgatcatcacccgcgcgcgggggcctcgcgatcacgtacccgcgcacggcgcacggttgccaccaccagctaggtagctgcccgtgccgtgccgtgccaccaccccccacccccgcgatcagtcgatcgatcgatcgatcgcccgcgcgcacaccggggccggcatccgcatccatcgtcacggtgggtggcgcaacgcaacgtaacgcgcggggccgtgtgaccgtgcggctgccggcattaaaaacccacccccgttttgccagcgcggccccaccgcaatcgatcggcaagcaaacgcgagccgcctccctcccgcggacgttgcaccagaaaaaggaaaaaaagaaaacgtcccaccccgtttactccgttcccgcgccgcaccgcacaccgcgtccatttactccgctctccctcgatcgcacggaggacgggtcgggcgggcggggggcgcgtttgggccaaaatctgttgcgtctcggcgcggtggcggtggggggaccgtgtacgggcgtttcggggggcgtcggattcaaagccgcgcccgtgagaagtccccgtcgggcacctccaatcccacgcttttttccacggtatcgcccgccacagttctcctcttcctctctctcaccacagcacggctgacaacgagtggcgaggtgtcaccaccaatcaagggaaatttaactatttgccactcttatgagtgccaactctccatatgccactattagatttggcctaacatatttgccactagagagagattacatcctaattttttgccactttcgctgagttggagcgccacatcatcatgccaatgtggactggcctggcgaaattacctttgtgcccttgtgcagaaacgagaaaacagggggaaacagaaacgcatcggcatccatctctttctctcgaccacagctgctcaaaccctaccgtcgccgccctgaaactctaccgccgccgccgctgcgcttgaaacccccgccgcctccgccgccgcctggatccctattggcgccgccgcctgaaccctactgccgccgccgcctggaacccacacgcgccggccggccggcgaggccgctactgcgtgacgcagagcgagtcccgtcgcggccggcgggagcctcacgcggccgccccgctgccggccctgacgccactgcgtcgcggccggctctcacgacccagccggcagcggcagggcgagtccccccgctagctcctcccctccaccgcgcctgcacgcgacgccaacgcatcggccggtcatccgggacgtatagctggcggaggtgaagtggatctgatcgtgatgaagccctcggagtgtcctccttggtaaattcattccccttctctgtattccccttctcttgactttgtgtgaggtgtgcagcatgctgttagaattgatcctggctccattttttttgtcaggattgatcctggcaatgctgttagagttgttgttaaatgtgcttcatatgtagcaaacttagagtatggattgctatcaatgtcagagcaagagcatgattggtgggttgataaatgcaaaggttatagtttagataaattctgtgatgatatgactagcaaggtaatatgggggcctagccaagaaattgtagtgtggggattagactttgatagtgggattgaatggaaggtaaccaacaatgaacagtttgagaagtggtttcagtctgggtggaaagagaaagtggtatatcttggggtaaaagtggttactaaaaagggatacaagcctgctggaagctatgtaggtcgagttgagtcaactctcaagttgtcactagtgttttaagtgtagatcttggggttccatcaattgctgaaggtagtgtgataagtgcaaaaccaactggtcagtcaattgctagatgtgtgtgataaattcagattcaattgatatttgctctccagttcaaatgaccaatgaagaagatactggtgacacttgtaaccatgcaccaaatgtagaagactcagctgctcttgtggactggagtaagttggcaatcattttggatggcttagatggtgatgctcatgcattgttggatgaggatgaactatttgatgctatgggtttcaaaaaaacagatgagagagcagcagcaacagcaatacaagaagaagctgcactccctgttattccaattgagattcaacaagatatgatagatgcagccattgtagttagtgatgaggtacctgctgacccagaacttgtttgggatagggatgatccaccaatggaagtagggacaaagtatccatcaatgaatgagttcagaatggcagtgaaacagcatgcaattgttagtgagtttgagcttgagactgaaaaatctgatccagatagatttcgaggaaagtgttctgcaaatggttgcccatggaaaatcagagcaaagacacaggctgataaaagtgtcagggtattatactaactatttaattgtaaaaaaagttttcccatgggctgaacaaagagagtgctttaggcacttgatggagaatatgaagaaattgtttcatgggaacatatatgggaaaaagatgtggcctgcagctaggacatacatgcctcagaagcatcaaatgtggatggatgaagtgtttgaatatagctcagatgtcaagccatggcttgacgaacatcacaacctactgtgggctagaagcaagttttcatgtcagagtaagtgtgaatatatcaacaataacttggcagagtcatggaatgcttggatcaaaggtttgaaggacttgcctattgatgctcttgctgatgcaattagggagaaaaccttgattctttttgagaagaggaggaggatctctacagccctcaatggagtgattcttcctgttgtgattcaccagttgaatgcagcctcaaaggggttaggccatctaaaggtcactaagggtgatccttaccaagctgaggttacagagatacataatgatgaggagctaacaaggcatgtggtgtaccttgacaagtgcacttgcacctgcagggaatggcaagttactgggaaaccttgccaacatgcattggcagtcatcacaaccgtgaggcaaccaaatatggagaaatatgttgataaggctttctctgtgctcagatttcaggcggcatatgcatcaaccatccctaacattacagacaagaagcaatggcctcaagttgagaaagaattcaagcttcttgctcctgtgtccaagaaaagaaaagtgggtaggcaaaggaagaataggatcccatctgctcttgagaagggcaaggggaaggctacaaggcaaattaagtgtccacaatgtggtgtctttggacacaggaagggaagtgctagatgtgaactaactggcaccaaaaagaggtgtgctgtattttcatctcaattattattcattttcttgctgctatatgctaactgtttttcttttggcaggaagaggaacaagaaaacaacatcaaacgtgggaaggaagaaataaagggtgttactgatgaacaagtaactacaccaagaacaagagcggctacagcttgagaatgagctgcagaaacacttgtgcattcgtcgcaaacaagcgagcctggaacagtcactaggaggtaagcaccattatgctcttttcatttttctctagctttcattacttattatacactgaactaaacttcttttattatttacaccatcacaaacaccaggaggttggcattggagcttgaccaaagctctcaagtagctccagctatagtggagccacccaagaagcttacacccagaaaaaagctcgcaagcaagaagaaaagtgcaacaccacctaaacttttggattgaaatttgtcaacctgctagtgaaattggttatttgtggtctactatggcatgatattttggaaaactaattgcaagtaatgtgcgatgatatgtgcactttggtatggcatattttgctatgtggtgtgaatatcttaagtgtatggcctaacgaacttaagtgtatggcctggcctgatgttgctatttctattattgtgcttttgtaatgatgtatggccttgcgtaatggcatgtaacttgttatgtatggccttcacagtaactctgaacttgatagtggttatgaacttggtagtactatttctaacgatgaagaagttattatgggatannnnnnnnnnnnnnnnnnnnnnnnnnnnnnnnnnnnnnnnnnnnnnnnnnnnnnnnn

SEQ ID NO: 54166 - DNA, 4759 bp, Oryza sativa
ctactatggcatgatattttggaaaaactaattgcaagtaatgtgcgatgatatgtgcactttggtatggcatattttgctatgtggtgtgaatatcttaagtgtatggcctaacgaacttaagtgtatggcctgcctgatgttgctatttctattattgtgcttttgtaatgatgtatggccttgcgtaatggcatgtaacttgttatgtatggccttcacagtaactctgaacttgatagtggttatgaacttggtagtactatttctaacgatgaagaagttattatgggataaaaattgatttttgttgcgcatgtgtgttaatgatgcagtatgttatgtgttgagttgttctcaagttattatgttttatcatttattcatgtgtgcgtagttgatttaattgtattatgttggctattaaccacttgagaatggaggggtaaaattgtcatttcactaggccggtccatgctggcatgctgatgtggtgctccaacccaacgaaagtggcaaaaaattagggcgtaatctctctctagtggtaaatatgttaggccaaatctaatagtggcatatggagagttgacactcgtaagagtggcaaatagttaaatttcccaccaatcaaaggtagtagtcgcagtaacacaacttttcacctatttccctttttagggggtgtttatatggggctaaaactttttagcccatgtcacatcggatgtttggacgctaatttggagtattaaacatagactagtaaaaaaactaattttataaatgagagctaatccgcgagacgaatttttttaagcctaattaatccataattatcaaaagtttactgtagcatcacattgtcaaaatcatggcgtaattagactcaaaagattcgtctcgcgaattagtccaaggttatggaatgagttttgtaattaatgtatgtttaatactttaaattagtgtctaaacatccgatgtgacagggacttgtatgtgacagggacttgaaataagtccctgaaaccaaacagacccttacactacaagtctatacacaaccggctgcgggtatggagaagtactctgcacacgatatccgaagctgatcgaataaaataatcgtcgttattcgccgggatctgaggcatataaaaatgggcaggagtatatgcatggacctgcgtctgcttacgttcgttcatcatcggtgagtgagggtgagagtggggggccgcccatttgactctcgccgtcgacgccgcgtgcgagtcagccccacttgcgattgattttttttaccccgtttcatcctctgatcgatctttaccgctagctgcagttttcttgggcggtaacagcagtagcggcctctgttttatctgcgctgctcgtggactctccacatgtccagctttatctaacacgcttgttattatagccattctctccagccaccctctcgcctctctcctctcatcatctcatccttcctcctcctcaactcctctcctctcttcgcttcttctctcatgctagctactactactagcttctccttctcctgtcgcacggtgcggcggaagtggtagtagtagtagctttcttggtttaagcaaggatcggcgaggacggacgccggcggcgaccgagcttggggtgtgtgtgtgtaaagatgtcttctccggcggatgagctgttgtttcttggctcgcgcctccggcgtgtccggcttgttgccttccatgtccgcgacgctgcaataattcgcttccatatttgctgccgccatgccatgtatagccgcgctgctgatgcggccctccagccgttttaatgcgtgccaaatcctctcccccaggctcataaaaattattgaatggttgggatctgaggggatccgccggagttggtaggatcacggtggagtgattttggccggaggaagaagaagaagaagaaaaactggtgtttgttttgtcatttgtagtgagctcgcgtgatgagcttcggtggcatgttcgatggcgccggctccggcgtcttctcctacgacgccggcggcggcggcggcggcggcggagtacacaactcccgcctcctccctacgccgcccgtccccaagcccggcggcgggttcgccgctcccggcctctctctcggcctggtagattctcacgagcttttccacttcttttgtttgtgattctttgccgtgcttagatattgatttacttttttaaaattttaatcttgtgttggtttagcaaactatggacggtagccagctcggcgacgtgaaccggtcgcttgccatgatgggcaacggcgggagcggcagcggcggcgacggcgactcgctgggacgcggccgggaggaagagaacgacagccgctccggcagcgacaacctggacggcgcctccggcgacgaactcgacccggacaacagcaacccgcgcaagaagaagaagcgttatcaccgccacaccccgcagcaaatccaagaactcgaagcgtaagcgtcaaactctcgatgacatcaggaaaaaaaataacgaagcaaattctgatttttgatggttttttttttctctacgtgcgatcgtgcagcgtgttcaaggagtgtccacatcctgacgagaagcaacggatggagctcagccggcggctcaacctcgagagccgccaggtcaagttctggttccagaatcgccgcacccagatgaaggtttcgcttgctgttgcacagatcaatccatgatgatgtttgattcttctcgtgttcgtttgatcatgattttgaatttttttttggttcgatttgtggtggtggcgagcagacgcagatcgagcggcatgagaacgcgctgctgcggcaggagaacgacaagctgagggcggagaacatgacgatccgggaggcgatgaggaacccgatgtgcgcgagctgcggcggcgcggcggtgctcggcgaggtgtcgctggaggagcagcacctgcgcatcgagaacgcgcggctcaaggacgagctcgaccgcgtctgcgcgctcgccggcaagttcctcggccggccaatctcgagcatctcctccccgggcccgccgtcgctgcaggcgtgctccggcctcgagctcggcgtcggcagcaacggcgggttcgggctcggcgcgctcggggcctcggcggcgatgcagtccatccccgacctgatgggcggctcctccggcctgacgggggggcccgtgggctccgccgccatgcgcctacccgcgggcattggcggcctcgacggcgccatgcacgccgcggcggccgacggcggcgccatcgaccgcgccgtgctcctggagctcgccctcgcggccatggacgagctcgtcaaggtggcgcagatggacgagccgctctggctccccagcctcgacggcgggttcgagacgctcaactacgacgagtaccaccgcgcgttcgccagggtggtcggccagtgccccgccggctacgtctccgaggcgacgcgcgagtccggcatcgccatcatcagcagcgtcgacctcgtcgacagcctcatggacgcggtacacacgcacgcacgcacgcacggttaactccaaaaacaacgcatttgtttaagctgtgtactgacgcaatgcaatccgcggccagccacggtggtcggagatgttcccgtgcgtggtggcgagagcgagcaccacggacatcatctccagcggcatgggcggcacgcgcagcgggtcaattcaactggtgagccatcgatctcccccctctcccctcgccgcgagctagctgttcgtccatggcgtctcgccggctcagacacgccatgccatgccatgcgcagatgcacgcggagctgcaggtgctgtcgccgctggtgccgatacgggaggtggtgttcctgcgtttctgcaagcagcacgccgagggcctctgggcggtggtcgacgtctcggtcgacgccgtcctccgccccgaccagaacggcggcggcgggtcgtcgtcgtcgtcgtacatgggctgccgcctcctccccaccggctgcatcgtgcaggacatgaacaatggctactccaaggtaattaaccaaaccaaaagcaagcaaaaacttctacacctttctcccgtcgattgtgtttgcacttgcacgcacggcgcagcaagcatgtggcggctacagtggtggcctggcccgagagagacaccgccattaagaccttgtacagctcagtattttatgctgggtgaatccaaagccgcgcgcgccgcgacgacggacgcggcgcgccaaccgatgcagcgtcgccaagtgcccccaagtcaatgcgcccccgtacgcgcgcatggtggtgatgaccgccgtggacgcgcgcgcgcgcgcgccgaggcgcgcgtaacaacaacggccggtttcgccggcgacgactcagcgactcgtcgtcactcgcagcagcagccagcaactgctgcttgcttgaccttgtactgcgagagagctaggcgtacgcctcgttagatgagctctcgattttgaaatgtttcgatgcttccgcagcccaatattctcgctgcgtcgtccgtccgtgcgtgcgtgcgtgccaccaagatccagttttttagtgtttctttatggagttcatcacagtatttttatacgacctcgaactcttggttgcactgtggtagtagtagtactatattactggttctttggctcatcttctctgcg

SEQ ID NO: 54167 - DNA, 7913 bp, Oryza sativa
  unsure (1)..(7913): unsure at all n locations
nnnnnnnnnnnnnnnnnnnnnnnnnnnnnnnnnnnnnnnagcaactgctgcttgcttgaccttgtactgcgagagagctaggcgtacgcctcgttagatgagctctcgattttgaaatgtttcgatgcttccgcagcccaatattctcgctgcgtcgtccgtccgtgcgtgcgtgcgtgccaccaagatccagttttttagtgtttctttatggagttcatcacagtatttttatacgacctcgagctcttggttgcactgtggtagtagtagtactatattactgtttctttggctcatcttctctgcgatgctactgtggtggagtagagcttagctagggttttttcgcagcggtcaatcctgaatttctggcgacgcatgccgacctctggatttccactatgctaacacttggtgtttgttattcatttcgactgatactaacacagtagtctgtcctcttgtgcgatggctgcttccggtgctggggttttaccatggtcattttgtttttggggttttttttgcgtgccttttgctgctagctgcaaatctgcaatgtctagttattgttactgctacgtgatgaggatgaatgcacccgtctttttcacctgcctccgccattactgccttgtcgaggctgtgacgaagctgagctgagctgagctcgccgtgatggcagtaactgattcacctgccggtagctaggctaatgtgtgtgtgtgtacgtgtgggcaggtcacgtgggtggttcacgcggagtacgacgagacggcggcgcaccagctctaccggccgctgctccgctccggccaggccctcggcgcccgccgctggctcgcctcgctccagcgacagtgccagtatctcgccatcctctgctccaactccctccccgcccgcgaccacgctggtgagctcgccgttcgtgctagtgctagctccggtggccggagttcgatcttactaatggttcttgtggttttgcagcgataacgccggtggggaggaggagcatgctgaagctggcgcagcggatgacggacaacttctgcgcgggggtgtgcgcgtcggcggcgcagaagtggcggcgcctggacgagtggcgcggcgagggtgggggcggcggcggtggcggcggcggggacggggaggacaaggtgcggatgatggcgcggcacagcgtgggcgcgccgggggagccgccgggcgtcgtgctgagcgccaccacgtcggtgcggctccccggcacgctgccgcagcgcgtgttcgactacctccgcgacgagcagcggcgcggcgactgggacatccttgccaacggcgaggccatgcaggagatggaccacatcgccaagggccagcaccacggcaatgccgtctccctcctccgtccaaatgtaagtttttttcatcttcctacacatgaaaatctctactactcctacataaaaaaaaaacctggcggtggtgatggtgattgtggtgaatctgccttctagagttgataggatcttttaaggctagataaatggggtatatatatatatatattaaaataagttgcaatgtacgtattttgttattgcaagttacaacaaaaggactatgaaaaaaagacacgaatattaggaaatgatctaatatcaaataattagaaggggtgaggtttcgaattcagatcgtctagcgtaccaccttgtggacctagccagaagaccctgggcgtttctcacaaaagaactatactagtgtacataaactagaaggttgtagtaaatttatcattaggttcttttggttgcaattctttagttcttcaaggatagcaagaaaaaatattgtacagggccctgcaaaagtgataaaccctaaatgcaaaagagggagaggcactataattaagctgaaaacttttacctaattaacatggcactgagtgagcacagcctatgcattagctgcacttggcagttgttgctaaagctttacaacatttcaattagtagtacctagtactgtactaccatgagggtggctggttgtatgcctgtatgggtaatgcatgggctgagactgatgagctagcttagtgagtgacagaagcaagaggacaattcggaaaaggataaaaataccgggttgacatttgtgagagaaggctagctgttaactttctccatgttttggaagcttgcttgcagcctagccttgctgagttgctgcccttgtcctggctcagaaagcctgtcaggctttaccccgtgtctcttttttatcttttcttttttattactttggagaggatgacatctttttcttgtttttaacttgcaactcctgatttctgactgcattgattctggcagttgctgcaagcacatactagtgctccatggttccaccaagactgctgttacaaaattgtctccaaaagtttaggatattttatatacatgcagttgttgaaactagaatgtactattatgatattatctaaaaaaagaaactagaaagtaccactctctccgtttcaaaataagtcaatttttatatataaatctagatataggctatgtctagatttgtgtacaaaagctaacagatgaattagatatgattcatataccaatttttcagctttgcattttcaacgaattttcatggtatggcaagttaaaattttccctctagattggagaccactttacaactttcatctgcaccagctcattctatctggttaatttattcctgaacaatgttcgaattcaccaatatatgttcaaacccaccaagaaattcttgccttgaattaagttttgttcacttctcatatcttgaaaaaacaaatactaatgtctctcctgcaggccacaagcgggaaccagaacaacatgctgatcctccaggagacgtgcaccgactcatcgggctccctcgtcgtctacgctccggtggacgtgcagtcgatgcacgtcgtcatgaacggcggcgactccgcctacgtctccctcctcccctccggcttcgccatcctccccgacggccacaacaatggcgcctcgccgtctccggcagaggtcggcagcggcgcctcgccgaactccgccgccggtggcggtggcggtagcaacaacaccgggtcgctggtgacggtggcgttccagatactcgtcaacaacctgccgacggcgaagctcaccgtggagtccgtcgacaccgtcagcaacctcctctcctgcaccatccagaagatcaagtcggcactgcaggccagcatcatctcaccatagataagtggacatttgacgtggattccgactcgaccatttttgagtcgaatcggatgccatctcaaatgtctaacttttgaaggttagaagactgagaggacttccgcggcgggcgatggccgaccgaaactggctgatggatgcaactcaatcgttgatcaggtagagttttcgagaggcgatatgcgagcgaggataaaaataaaattaagttatatatagtgtgtggagtatatttgcatagatgagcaaattaaatggggtgagttgcagagggatcaagtcaagaacgaaccttgcgctaggcttggctcaagctgatgtggtggttcgggtattgacttagtctctggtgaaaataaacccctagggctttgatctcctatatatatctagcagtttgcttaatttaaccattttgtgaagttttttttaattctccaaaatgggggaaatatagagaaacaatactgatcagatccccaagatcgttggtgtttgtttagtttgcataatgttggaatgagttgatatataaacatgtttattttggcatactatgtttaatcagaatgccgttgatagattaattgagaacatcatcaaaatcatatttaaattttcaattttattctatgtttgtttatgcattttttttggaatcatttttctatcatggtatcgttttaaattgtgaaggaaaaagtctatgtttttctattttagaggtttcctccttgggaggtctcccaactattaattgagaagtaaaaaaatagagctgtttcattgacaaaatacatttctcatcttaagaggtatatataaagcgagatatgcatatctcatattattggtcagaaggtttattcgtcttgatagagccacaagggtatgtacctcttgaccaacagtccaacactaaatacctctacatctaaaaaggctcgaaaacaaatacaaaagagattttacaattttactcccagttattaaattaattttgatactcacttgattttttaataatgaaattaaatcccagcctctatataataagatggacgtacacgacctttactatatatcagagtcctggtttatcacaccataaaatggtatagatgctcaacaaaacttacttgattatagggaatatcaaacacatatcgtattagtaaactttcatgtatgcttaatgaatatttccagcaaacaagtacgtatttgcaaactaaagggagtgacgataattagagaaacagtgagaatccttacttatttaggttggattgaatttctaacctcaaaattttagaaatatgttcccgtcagttacaacttactaattacagtgttaacttgaaaattttaaatgaagtaaaaaatggtaaatagaagagggtagtacaactttgtatgtacgtctggttagctagttctgtgttagagcaggtaattaattgcagcatcacttttcggccccctttgattcaaaggaaattcataggaattttagaggatttctttcctataggaatttttcctatatagccctttgaatcaaaggaatggatcttatggaatcctatgaaattcctatggattgcctaatgctatgcaaattttggaggaattctaacatgaggtaaaacctcttggaaactttccttttaagtctttatctctcctctaattcctgcgtttttcctgcggttcaatcaaacgactattcctgtgtttttcctgtgttttgcaatcatctattttacacttacattcctatcaaaaacctgcgtttttcctattcctatgttttctcattcctgcgattcaaaggggcccttcctatccaaagcatacatatatgtacgtgaaacataagttaagagacatgccgtaatgccttgttaattctctgtaacacatctgtcagtaagtcctttgttgcttgtctaactttgtagtatcaagctgattaatgtgcatcagttgtccgatatggctctttaattatgtacatcgacattaataatgtcgagctacgtgtgtatccgcagttagtgtcaacagtgtggccattgttcatgacagcaacatactgagatacccacatttagtgtgatgctactttcttggtcgatcgctcatccctatccttttatatttagataacggtaagcaaccacttttgggcttttggcctctaagcacgtcatattatattgtcaataacactaataacttcctgatacctcaggtaattagatataaaaaaagtaaattttattttggatcactttttattaccaatatttcgtttcgaatcaccatttaaccaatgtttttcagtttggacaaggtatttttacttttgtgtcactttggaacatcctcaactcttttatccatctatatccaatttttcatatgttgaagaaaacatatagctatatattagagttcattgacaagtataaaccgacgttcttaggatcgttcatatgtttgagttaagatcgttcatacgtttgagaaaagagttaagtgatcatccaaagcgaaacaaaggccagattacctaggtaaaaatattagttaaagggtgatacaaagtaaaatatcggtaataaaatgtgggtcaaagtgaaatttacttaaaaaattatgctaaaaaacatggcacctcctttaggctgctcagaaagtgctactagtatttgcttctgttttatggccctattattttcgatttatccatccaccagattatttgtctgacactacaaaatataaggagtatttgtttagttcagttcttaaaacattttgtttatcactataattgagaagataatctgcggcaatatagttcactcgagatttttaacaaatctggaccatgcaccaaagtattactacgtacaacctgcgtatcgtactatctttgctctctccaattttgaaatactctcggtataagttttcgagaggcagcagtgtgcactgcacattgcacacattgaggggcgctttgaatcacaggaatgaaaaaacggagaaataagaaaaacataggattctgacaggaatgcaagtgtaaaacaggagattacaaaacacaggaaaaacacaggaatttgaagagagatagagactcaaaaggattctttccatgaggttctacatcatgttaaatttcctccaaaacttgcatgaaaaaagacaatccataggaattttataggattctataggatccattcatttgattcaaagggccatatataggaaaaaatcctatagaaataagatcctctaaaattcctataaattaccttttaatcaaagggccctgagattggcctcgagtttggctggtagcctgatgtaaacagatgactctcctcggtgatgaaagggggtacatcagctaccacccggtctcatcttttcgtttatacttatacttatacttattaactaaattttaaatttataactttaaattaaagctgatttttggaaacttttcattaaaatttattttaccgtctttacttttaaatcactaagagcacgtattttatttgcaatatatataccgtttggagccgggtaaggataagcatccgcgtccgttaactgcattggtgtgcgggtccctctgccgccgggcgggcaataaattgcgtttgctgcccatcctgcgcaagctcagagacggctagctgatcacaaattcacaagatctctcatatccttgccttgcaaagttgcaatgcacccccaccccaacatctgctgcctcctgtctctttgcgaggacgtcctttactaatacttacatattacttttttttaaaaaaatgaaaaataaatcaggaacatactcctccgtaaaaaaaaactaacctcctagtacaacagatttgaacagttttttattttttcaacgtagggagtataaaatgcaggaatacttgcagccaggaatgaatgttatacttaggatttaaattgaaactcacacgaaagttgtgtttagatccaaagtttggatccaaactttagtccttttccatcacatcaacctgtcatacacatataacttttcagtcacattatctctaatttcaaccaaaatccaaactttaggctgaactataaacagccgaactagcgctcctctttcaacaccggtgccaagaaagcaactgtacgggctgtagacggtggaaaaggccgtggagacggagcgcgcggcggcgctaagcttttacacggaattcgcggtggatccagcgactttcctagcgaacacggcgactgatcgaacctgccccgatcgggcgggtatggccgcagctgtaactgtgcacgtacggtacggcggccactgttgactgttgggctcccgcggaagatgctgcttctggtctgtagcgaaggcgaagtcacccggacaccggaagcgacgggacggccggccggcgacgtcgtccgtgcagccaggtagttcgttgtactagaatgaattatatttttagttaggttagattttttggggatggagggagtagctgcgccatccggtccagttttctgtag

SEQ ID NO: 54168 - DNA, 5376 bp, Oryza sativa
  unsure (1)..(5376): unsure at all n locations
ccctcctagtttaatttttttttgaacagatggagtacggcaaatagctgtctgattggttggctaccacaacttaccaccatgtttgattactccctttgttagtatgatttaagttttttaaaatcaaactactttatactccgtatttaattaagtttataaacaaatataacaatattttcaacaagcatagcaatactttaagacaaagtcaaaagtattttataatacgaaacagagggagtagccgatatagtaaagcggcaactaactttctcgatcacttgactactaaccttctcgatcactttgaccattgatcaactcagacaggtatagaaacatacaatatttgttaataagatttagccaaaggctacattcttagagctttaatagtagtcaagtttgattaacttagacaactatctagttatagtcagagttataacaaaaatttcttttaataaatttgatcctacatgtatatatggcaaaattcttttgggccatagttagagaagcttctagttactgcaacttcttctataatcttcaggctcgagctctctaaacaatccacatttttcaaaaaaaatgtagctataaaattcaaaaaataaactagaaattagaaactaagaaatcaagttttttcagatttttaccaaccagctattcaccagcttctcataatcaatagctttccaaacagtcttgttttgctaagatgtgacagattttagggattaactttatgcaagtttgatatttccttcgtcacaaaataaacacatctaatgttggatgtgatatatcttaatactacgaatttatataagatgtgctatatactagatgtacttattttgagacggatgtagtaataacttctattgataaatggtgataaccgcgggtaacaaacatgtcggaacatctcagtcctaacaggagccaatgaccaatgctttttcaggtttatgacagtttgacgcccctgatcgaaagtcgtccgggcatccgtccatcgatctgcagccagaacaagaaaggttggccggtaaaaaggctactgacagtcatagcggcaagtgtgaatcaggaggctcggcggtggtggttatactgcagcgtttcacagttgtgtggtgcagagatcatgcatggctgtcatgagggtaaaaggagttactatatgctgctgaattttggtagtcgtgcagtgaatgttggttgaaacagccccatgattttacaccggacccccatggcacgtacttacatataaggctttactaagtcctgtgtcatggtccaacgctatgacataagcacagccggaggatagtgctgctagagttgaggagacttacgttgggaggagaagaacatcaagagagggattgaacaaatctccctcacaaaacttacctgaatagcgatatactccctccgtttcaaaatatttaacaccgttgactttttagtacgtgtttgaccattcgtcttattcaaaaaatttaagtaattatttattcttttcatatcatttgattcattgttaaatatactttcatgtacacatatagttttacatatttcataaatttttttaataagtcgaacggtcaaacatgtgctaaaaagtcaacggtgtcaaatattttgaaacggagggagtaatacatccctctacattgctggtatgtttgggctcgagctcaagctgtgtcttcgagcttttaagcacgctcagtttgagctcagctatattttaaggatatactaacctttttactgtcatcgattgtatgaatttaccactaaatagggttcaatctaatccgatctctaactctaattctgtcggccactgttcactggactgggatattaggtttggcgtcgacctcctggcctaatgctgatgacatcctgtttaaccccaagagagggagaagcagagcagcagtagtattgcatgtcagcatgtgttagctgtgcctacagagctggacaatagtaatcttcacgtggacctgttcccaaaaattgttactattacccacatgattattccttggtactaattagttaaaaagctgtttgtaataacacccccctttttttctgtaggctgaaggctgaaagctgaaacactgatatgagtgaccaagagtggatgggtcatgtgggtcgtgcgtgcggcggctgcaatggcaattattgatgatacaaatacggccttgcattggatcaacccagcacacctaactggaaaggcttaacagcaacggcaattaatcacaccataccaaacgtaacttacgtaattcgtccatacgctcttaattccattcagcacaattaattaggaataagatgtttatgtgatgtcaacatacctgtgggccaaaagaatccagctaatataggcaacataaatgatagagatgatatttccagaataataagtgcaatgtagagaccatatatcacctctctttgctctgtatcattcaagaaaaatagttagctcagttcaaaacacccatgtaagagcacaaatagcaaaacactgcataatggtttgagaaaaaaaaaaggaatatgggtttggcgcacaaaagtaatcctgtatgtttttcccataagaagtagcaacaacaaggcagacagaaagtagaggacaaaagatatacccgaaaatgatagcagaggtacaaaagctgatagaaaagcttactatcaattgaattaaatagagcgagagagacctgcttaatatgtctgttggattgtggacaacatagattgtttttatacatttcaatcttcatcagcacttaacatcataaatgaggttatgctcgattgctaaactagacctatatcctttaacccatgctgtcatcaatacatgttacaagaatagaccatttactataagcatctaatgacactatcaaacaaataaattttcagaaaaggacataaagctagataggagacacaaatcagaactaagtcccatcacacaagaaggccaaaagaaaaatgacaagcacgattatctgatatgtacagagaatgctactactagttgatattacttgaggatcatagtattattatttgaagggagagctgacaatttcaggtggcaagaggacaataagttagttcagaattcagaataattaaagtataattgggtgttaacacttaaaaactcaaactaaaaaaagtaggcagtcaatgacataaaaaaaatcctaaaacaggttatttagaaagtaaaaacatctgcaaagcagtaaaatggagcccaatgatagcagcatatttggcagataatatcagacattataaccatgatgacatcacgtaccaattagtgggttcacaatatcatgcaagttgaaattcagaggtttcaaatgatattcagaagaacaaatcccatagtcacagaaaacggggtcggtggcagcgatcctcaatccgggaacaccgtcccaggaacacgaggtcattttcgttcccatcttgtaagtagcgtaccatgtttctcgaccctgttcctcgatcccatcgacccgggaactttgatcctacagactgccaattcattacattcagcattccagtgcatattgaagagttaaagtcttttataaaagtgcatatggcagagacagtcacaactcacaaccacaacacaagacattccagcactgtgcatttgaaacagtgagcaagctgcagacctcaataaggcatgccaactgcagtgctacatgagccttcatcattctgttccaaactgaatggacttttcctgtaatatttgttttctgatttttcatcaatgtcttttgcactgtgcattggttgccctttcaatctgtaccgcgttccttcattgcagatatgaaagccgctgaggttacattcacatgtgaaaatttgttgttttgcatagaagaatcattattaatcaagggattgcagaagttccaaacttgaacaatgttttgaagaacagtcaagctgattagtcactaagtgaaatgaaatagaaactctttttgtttaatcagtcagtgctgtttacaaccatgacgctctgaataaaagtccaaatatcttattatctttggatggtaaagaacactacctgtatggttgtcgaccatacctaaagtgaaaaacacatatctaataggttagaccttgcagtcaggttaaacattctgagaactacaaaactggcagggtaaaatatgatactaaatagtaaggttcagcaatcacaaattcacaatggacagaagacataacatgtctgcaatgtatagttcaagactgattatgcatcaaatcgtagtcggatgcaatgatccttcgttaactaagtagaaggtaaagattagtgccagtctatgagtagatacgacaacaggatccaaaaggccagtcttacttttccttgaaatcaactctggaaattaattcttttggactgtatttccagatttcttagccaagactcaagacatagcaaggaaaacataaaacaattaataagattaaatattgacattaacactgacatcaaacaattcagtttagctggagtttccctgcaacacttattacacataaaagttcaattgtttctatacgatgtataagaaatgataggtagtatagtcacagaattttgagatggcaatgccaatccccaataggtagagagagagagagagagagattcactcctagtgtgagagactgagagtactcacaagactcagtaaaaattatcagaagaacgagtgctcaaaataatgaggggttttcagttcccatgcctctctctttgttccttcttcatacaacggagtgcaaaacgaagatgccatccgaccattgcagtgaagttaaatgccgacacccagagtcttcatttgacaatatcaacagttttagcacaagatatctcactagttttagcctcgggtggcaatatcttctcctcaatcagcattgctgcatccgactgttaattcaccatcagaagaaagagagcttatagatggtgtcaatacttgttctagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 54169 - DNA, 797 bp, Oryza sativa
  unsure (1)..(797): unsure at all n locations
cataggagtaagaaaggatgtggctaaaattgaagtggagaatttatcatcacaccttggtagacgcctgattgaagatgaaggatcagtgaacgtacggtcagagaaaccgaaaaccttgctgcctatgaagagaaagcgtgagaggtgatggcgactatataccgctcttcgtcgataattggttcagaactgtgcataatttaaactttactcttcgccataataagtttgatatagatatgtacctctgaagcgtgttctgattcagttaagaccacacttcacatgatcaattgagctacattccaaactgaatatgtgatggaaatgtgataattgaatcgttggagtcaaaagtagatacttactgttctttgaatatgatacctcacattctagtgcttttattttctgtttattttcttttatcaatattttttcttactggtcacaatataatgtaataagtttcagtagtggtgaagacttcttttgtatgggctgttttctctatgatgaaatccatagactgaatagtgcagagagacaaggcagactgtcggcatggcattgtttgctttcattttcatcaggtataatgtaccggtagatcctccctccaaacctgatcattgtaaaatgacagcttgtcaggactccaccatatgtatccatccaaggaaacttcgtacctttctgcatgtgggagagatctgcaaagatgcatatgcttttcctggggatnnnnnnnnnnnnnnnnnnnnnnnnnnnnnnnnnnnnnnnnnnnnnnnnnt

SEQ ID NO: 54170 - DNA, 764 bp, Oryza sativa
atccacgccgtgtatcggaacccaccgaggtggcacgggtggccaggatgatgcgaggccgcgggattgggttctcggcggggggatgatgggatggggatggggcaattgggggtcggaagggggcgagaaggttcggtcgatttttcgcgcttcggctttctggaaggttcaggtaggcgcgcgggcggggctggatggggcccacggtagacgggacacgtgtcgattgctcggccacggatggcgagtgggataagattttatctcgtctacgatacgacgtggcctttttttttatttcgtgtatgtatacactgtactggagtactttggtatttgtgcgtttttgtttgtcgtccttttggaaggttctttttctttcaatcggcttctagagagtaaggctcacattggatagcctaatcagctaaagaaaaagccaaattttaaattttcaagcttaattttgagattgattttgatatattttcaatgtagtttctttttcaacattagcttttaagtcaccaagaacatatttataaaagttttagctacaaatttatttttatttcctattggcttattaggaagtaagccaaacgatgggggcctaaatgcttatctgccagaggagaaaaaaagtccggttttcttctcttttttttcaagagatgcacaaggtttaattggaatggacttaaacaagaggaggggaccaatgcttgataggagtagtacttatcaaaggagttactagt

SEQ ID NO: 54171 - DNA, 762 bp, Oryza sativa
  unsure (1)..(762): unsure at all n locations
attagttgcttgtttgtttctcggaattttaagttcctctaaacaagccctaatcatgcaactgcttgaacgtacaaagcgtgttggttaaagatagatcatatcttgtctattctagcttaattaacttggtaagtacatgtccttattggtatcagtagttcataatccagaacatgtatttctatcaaaaaataaagttgatgctcaaataatgtcagcatgatagttttgctacagtgtcgagcttagtcggcattaatttgattggacattaaacatacacgtactttgtatatgataaattgatgcaaaccttgctggtcctagcactatctcttgtatagcgacatcatccaactagtcctgacacctgcttgtacatcaaggactttgatcatttgctgagttttcaccttaattaagcgtgacactgaaatttccgatcaatttctcatctctgcacactagccattaccctcaaaatttccagaaaagaataggggaaaaatcaacctggctgctactaatattcagcgaattaaagaaattattcagacttttcacccagtcgcaggccctgacacattctacttgaccagaaatttagaaacctgccaagaaatcaacaaaatttccaccgggatcacggacccaacatttcggttggtcccgttttttcccttagcttgcaaaatcaagaannnnnnnnnnnnnnnnnnnnnnnnnnnnnnnnnnnnnnnnnnnnnnnnnnnnnnnnnn

SEQ ID NO: 54172 - DNA, 3732 bp, Oryza sativa
cctcttcataaagctaatattgttttattcactgaaattgtaatgttactttgaacatagtactttcagtccacgaagacataagacgtcttgagtctgaacatggcaaactacatgaagcgtctacatctcaagttaccaataggatttagggacttatattgcaacactgtgtctacatctcaatttttctttccaaccatgtctttgaatctatcggttctgattgtcccaactgtatgaactattttgacaatttcaatctatcaccaccgatttattgggggaaatatataatacccatacaatgaataaaaaaccacaaaaagcaaccaattaacacacaccttatggatcagttttctccctcactctgcatgttgtgccacgcatcgaggccgctgcccgcagtggccgacgattcaccgtcgccgccgacgatgcagccccggccgcccgccgtcaccgacgaatcatagcttcaaccattgccgggctcccgccgacgaatcgccgccgccaacgatgcagcgccgcctacgcatcgaggccgctgcccgcagtcggcgacgattcgccgccgccaccgccgatgcagcgccgccgttgcatccagaaaagtcgcgtccgctgtcgccgacgaatcaccaccgccaccgatccagcgccgccgacgccggccgtagccgtcgaatcgccaaggcttcccgatttgggccgccatcgctcgcccttggcatttagggtttgtttgtctcctgctcctgcccgacgaatacgaggctctattctctcgcgatacagagaaggaaacagataacgcgaaagtacaaaactaccctcccacacacggtactgttgtgatacgtacgtgcggtacgacgaggtaccatcgattttggaccgtccgatgaggccagatcaatggtcaggatttggtaaggatgggaaagatgctcttataattgagggtcgaaaactaaattaaaccaatccccaaaaaaaaaggtgccatctaatcctcagcaaccacaattctagctggagatcggttaagttcagttgcaatttttggacgccgaagccaattcaaccagagttaactgctaaatggcattcccaattgtgagaaaaatattatactgctagttccatcacacgatgaatgggagattctccagagtatcactcgcatccgccactaataattctctaccaaattacagaccaacggagatacatttcaaaaagggcgataaaattaacttacccttggccccccccggcggtttcctgttcagggaagtggtcctcaatggcagccgtacccgggaacctcaacctcgaacggcggccccggcaatggaagtccttgacgttggtgcccaagttgccaacccacgtagaagatcacttccccttagatcaatacaggggtagctccggcggagactgcaggcggcggaggcggcggtgatggaacgggccggactgggtcaactgataccagtagtttaatcgaagcccaacatggccacgtgcgtgattacaggctactggcccagaacactttgggcttcaagcccagtacacgttggtgtctttctaggataaaagaagtaaagaaggaataagtttatttgtcatccctcaactttacgtcgagtttgattgacatccctcagcggtgattttgcttcacatgttcttccgaagcaccgcaaatgtccccaaatactgcaatacattgctaccctgcataggacatcgcaaagcagggcattgcaaagtaaacttacatctacaaatattcctcagtaaaacggcattgtatttgtagatgtaagactaggctaaaaacaatggcaagactaggttaaaagaaaaaaaaaactcctgtcttttgatcgggaaacaatagggtggtaagcactgaaaacctgatcactgatcatgatgccctctgtgaccctgttcgttcgtccatcttgctcccgacagctttgtattaaaactgtaaccctgtgtcgttcgtcctttgttcttcttttccatggcgcgtcgcatgatcaccgtagctgcatttggctttagcttacccagctagcatctgttacaactttctctgaatatataccatatcctctttgcctctttgcagcatatgctctgcttcatcatctttttccgctgtaattaacctgaagaaacgtggctggagatgatgcagacacgctggtttcatctagaagtacgcacccagccagaaacgaaatctgaacaaacagcagctgccagtctgccactgcacggtagcagtgtgtgacagtgtgatggatactgtcgtgcatactgatgcggtgcaaagcgaaatgcaggattccatttagcaatgatcgccactgcattgctcctctcgccatattctgtcgcccggttgccggacacccacaactgtactcactccgttaaaaaaaaacgaatataatattagatatgacatattatcatagtaaaataaatctaaacatgttatatctggttctagattgattttatagaacgaaggggtacgtatcagtagcatttttttattaagatatagagtacatattttatcttagtttctattaacatgcttttaacatgttaaacgatgtttttttataaaaaactttttatatagaaattacttaaaaaatatcaaatctattttttaaatttataataattaaacctcaattaattactctcttcgtctcaatatataaatatttttagcatagtgtcaagttaaacatttttaactttgactattaatagaaaaaaaataaaaagatcaatcatttaaaattgatgttacatgatttatcattaaacaaactatgataatatgcaactcttttaatttaaaacatcttatttttacaggtattgttggtcaaagtactatctcgaagactatattgaagtctaaaaatacttctattttaggatggaggaagtatatgtcaatgaatttctcgttttgaatgtgctgtctttatcttcattttaacatatctcaaagatagcatctctgaactagcatcatctcattactcttcctataaattggttgccaaaactcaaatttagagttgatgtttgggagttcttattttccatgtggcttacttttcggtgttaactcaattttaaactacgaataacacaggttaaaactttttatttgtttgttcatatgtcattttacagtttatctgttgtagactgaagaatatttttaagttttatccacaaattattattattttattgcttatatgcagttttacggcctgtcagcggtagaccggaagaacaaatcttactagtaaaaagaattcataaatacaactcaccactgagcaacatgtttcaaagttcataggaattttgcggggttacatgctcgaaaagtccaaatgggcctaaaatatttgtatatactagtatagcactatggagatactcgttaataagttcttttttggtgagacagtcaccaaccaggcaagtgaccacgttcagacaaagtcagatacgcgcagcaataatttactcccgtccggggggacacgcacccggcaactatttggcgcgacagcgcggcgcccgcgtgcgcgccatgccagttcggttcgccgccgtcccgcgtcccccaccacgtgcgccggcaatggcggcttc

SEQ ID NO: 54173 - DNA, 3324 bp, Oryza sativa
gcccaccggaggggaagctgctgccgccattgccgccgccgccgctcgacggcttcttgcggccgcgccagcggcggcggcggtggcgcccgcgtcttgggaagagttggaagcacgacacggcggggcgatgccaaagggaccgggaattatgcacgacgaggaggaggaggaggaagactggccgccggcgagggcgatggggtccgagatgacgtgcgccggcgtcggcgccgtcgggtcgcacttgagcgagaggtcgaagtcggtgagcatgatgtggccgtcggcgcggacgagcacgttctccggcttcaggtcacggtacacgatgtccaccatgtggacgtactccagcgccgccaccacctccgccgcataaaacctacgcaaaacaacacattatcaccatcattaacaagctcccaaaactaacattaacttttgaatcgtttagcaacttctagcatatgcaaaaaaaaaaaaacaagttggccatggaagataaattccattgaaaatcttaaccttcacaccaaatttaagtttgtgttattaaattaagcattcaccaaacatttttgcttttagagaattcaccaaccaattcttaggctgtgtttagttctctttaaacttccaaaaattccatcacatcaaatgtttcgacacatgcatagagcattaaatgtggacgaaaaaaacaattgcacagtttgcatgtaaattgtgagacaaaacttttaagcctaattacgctatgatttgacaatgttgtgctacagtaaacatttgctaatgacgaaataattaggcttaatagattcgtctcgcagtttacaggcggaatctataatttgttttgttattagtctacgtttaatacttcaaatgtatgtccgtatatactttaaaaaaaattgaaatggaactaaacacggacttaacaactttgcaactgtatacaaagcaaggctattgcatactgcaactgtatctgaagcatggaagtgaatcccttgactttattcacatgtcacctcaaccaacccacatatttgtgtatcaactaacgacaaatccaactgtatcaactatcagcactatttgcattgatacacagacatgcatggatgccacagtgtgatccagtacaacaaaggaaaaggtcacaagggagcagaggagtgaaaaggtttcagacagtactcgaactagtgcatcattgatgttggaggtttgcacgttccaaagctgattaggataacttaatggcataaaggggatgcagctcatgtgtgtgcactcaattgttaattccttgggttaattagattaatccttacagcaagtaccatactggctactaggctactaccccatgttgatctcgactgaatccatttattcataggctcgtatggttggctgtgattaacactcatcacatgggtgttagttaaagtttctctgaccaatggcatctataattctctacttatgaggctatcagagagtgatttatcatgttctccgaacggttcttgcgccgtagtgcaagggctttggctcgtgtcacacaggcattagcacaattaatctacctgaccgtgcggttgattgcaatgttgttggtcctaggtaggagtgtgctgtgcttgtaccatcagaattcacaattcacaaacgccgttgtaaactgctactgctcatctactggtacaagtgtacaattatccccccgtaaatagcgggattggccattgattcatcttggtaggaaatccgtgtcatgcaattctgtatttgaggccgtacgtactacaactcgtctaataaatcaattcttgaattcatggatcgctttgtactgccaaagtgtcaataacttcaaaaaatatatatatgttggtctatgatgttgtggtgtttttgttagttggtcttagattctagcaacactgttaatatattgtgaaatgaagaaaaaaaaataaaacattggtaattggggatgatctggcaaagcatgtaggttgagttgactacagctctgcaggtgaatgctatggccggactacttactagtctgtctaaatgaatatagccacatgatgctgtaatggagcaaacgtaaccgaataattctaccagtattttctatcagtacacagcttagtaaagttgacgtgtttttgtctcgtaatctctggcatggcctacatcaaagatattgcacagggaaagtacggcggagattaattctgtgtcttaagtttattctggaaggaaattactacgacatcagtatctgtgtatagtgggaagataataatattggcaggcagtgatcatcatcgatctaagaggcaagtaaaaaattcagatttgtgatgcaaattaagcagcctaatttcctgcaagggacaaagactgcaaactgttcatgcgacaacaacagcttgacttccatatgaacagtcttagcttcagaaattcagaaggccactgcagccacaggtgtggatgcacaagcaaacacaccaataccaatagtgattagtgagtgattgcaaggtgatatgggcgtgcgattgtgtgtttgaccgcggtgcggctcacgatatggcacgaaaacaagaaactgtacagtgacagtgacccagtgatcgagctcccatccatgatgctcaatccttcacaatgtctacaaagatgcttttttttttcctttttctgaagaagaaaatattctcctcctcataagtcagattcatgcattaatttgaggcactcttaagtgtaatttttttggggttataaaagaatgaatccaaagggcagctatcatcaaacagcattatccatgttgttatgatggaacacaattctggcaaaaaaaaaaaaacctattcgataaaaacggccgatgcatggctgacagaagacacacgggccaaacaatgcacagaagaagtacagaacaagtgttgcttcatccactactagatcattaataaaacaaaatataatttatacgaaaaggaaacaggaaaagaaatgcagataaagtgaaaccaaagtcaagagaaatcgcaggaaatcagccacattcttctcccaaaagcctaagaataagatcaatcactaccttactactccagctacaacttcagtcacagtccacgccttaaaaacggcataaaaaaagtgatttgatcgaacatttttactagcatttaaaaaaattataaattaacgatgtggtgatcgatcgatgccacagaaatcgagcagttcacaaaattgtttcaaaaaagaaat

SEQ ID NO: 54174 - DNA, 8287 bp, Oryza sativa
cgtggtggtggtggtggtggtggaggtggtggtgccggtgtatccggtaaagcgggagcgggagcgggagcggtcggaggaggcgaagctgaggctttgcagctcgtcggccgccggatcgggctcgccgccgggaggcattgcaatgtgctgtggtgtggtgggtggtgttggaaatggcggaggcagaggaggagatggatgggttggtgcgttgcgtttttaatttgaagcggagaggtgaggaggcggaggttgacgacgatgggctgggccggatcatccgcgtccgttccgcgcttgattttttttttattttgtttttctggatttccgggcccctgttctccgggatgtgatcaaggaacaccaacattgctaatttgcagcttgatccgattattaaatagatatttaactatctttactcttatacgcgtggtatttaacaatttaccatcagacccacatgtcataaatacataaggatccacttgtcattgacatatgagcagtgacaaatgcagctttaaaatatagatgggacggagaatagagatgttcactccataagagcaggtataatagctctattaagttggcttcaaaacctgataatcagcctaatctgagattagggaaagaaattcaccaagaatgaaacaaggcgcttgttttagcgccggcgcttgcatagcgccccacaccatatagctcgcatgcagccaggagagacaataaaaaatatgttatgtgggtcccaacagctgatgtatccatacaagtatttaatgtatgtatgctttaaccaaggcagctcataactaacttgtagttagcttgttgtataagttagctctacttgacatgacaaaattttagagcttgctgctagctgcactattaatcttgctctaagagcaatcgaacaaaacacatatcgtatttatagtcaatcgcataattatctcgatcattgtttgtggcgtgtgtatgttttgaagaaacaaactaatttgttggacgttcacaccttgttatacctaattttgatagcccatgactgctataaaggggtagggggtcttggggtgtagagcgatacgggttgtagctgggtcggtcgatctactctgcctaatgggtagatccgcccctgcatatgagtagcaaattgttaaacgtcaaattaaaaagtgataaatagttaaatgctcaattattaaatccttgctcaacgatgaggagtttttcttccaaatacactcatctcatcaaaataaaattctatacatacaccatattcctattaacgttttttattggtttggatatgtctgttttaaatgtctccctatcgatgtgtatgttacatttcataaaaaagaaaaattagctgtaaacgcgctgagtcgaaaactcgaactcggataggaatgttttaccataagaaagatatccaattgagctcgctcagcgcgtgaacgctgcggaagtttttgatacgtaattgcaaatccaataacgattcatggctcaagagaatggaaggtttaaggttgacgtcgatgagttcaatcaaatcaaccggaagaacattgtgcaaaaatcaaataaacaagcagaagcagcagccgcggcgaatgcacggaatctggcaaataaaggcgaaattatttgaggttggcagtttgcgtttgaaatcagacgtagcagggtacgcagccagggaggctactggctatagcaatggctgcagtttgtgaatggattggcctgcattgcgtggttggtgtggaatggattcgaaggcgtgagtccaagtgtagccgggacaaccgactggaccaaaggaagggtttgcttgagaagcatgtgatatctgcagcttcactcaaaatttaaaattcatttaaacagtgtaataatatgcagactaaaaaaatggcagtttataaatctagaaaataaactaaaaatcagaaattgcgtttttccatttttcagtttctccagattcttataagtctttttttttgaactaaaggcaaagcttgcctattcattgaatatagatggcaaatttacaggtaaggaaaaagtaatattagattcttataagttacttcctccgtcccataatataagggattttgagtttttatttacactgtttgaccactcgtcttattcaaaaaaattatacaaatataaaaaacgaaaagttgtgcttaaagtactttagagtaagtaaaaaaaaaaataaataataattccaaaattttttgaataagacgggtggtcaaacagtacaagtaaaatctcaaaatctcttatattatgagacagagggagtagctaccaactagctatttatcataattttaaactatttcaaacatgatcgaagaaaagtcctttatgatcgattgagctacgattgataaaccatagaaacataagcaaagcaaccaaaaaaaatagtttataagtaaaaatttttacatttatattcttaatggtttaaaaaccaaggctgaaaaattgaatatgatggaaaaactaatgttagattcaattttaaattttggttacgaagataagccagcaagaaaacgataaagccgatgagctcctccccattgcagaccttttttctcttactttcttttaaacagagtgttctaaaaatctcaaggtcccatgttaggattggcgtatcatatatttttaaaacaatgatgattggatggatgtgtcgggggttcagttcaggagttggtgtgatagtctgatactctgaaatggggtcggtttcttcaagacaaggccatatgttttacaattcagaggttcatcgatcatcgaccgatatgcaagcctcagaggacccctcgcacaaagtctgagaggatcaattaaatcgaagtcaatctattattgtctgattgtctcggtgagagtagtcttgagacatcgaagacaaaaatgttgggcaacttgcattggggtaagccacgcaggagacaggcagaatcaactggtaacaagtttgaggctgcaaattatacctgcaatgttggatgatgcttctacagtgtttgtgggggaggttgttacactccatggccgatcaggatccggtgtagttgcagtctgtaactgaactagcaccacatgatagcaaatcaagggttcaggttgatgcataactgtagcacctattcattgtagtaaaatttattaggccattttggatactaccaaaataatgtgccctaccaatttattggtagcttgaatagtaatgttggatgtttggattgtagccaataatttggggtctgttcactttgttgccaaaaaaaaaaaccttaccaaattttgacattgctaaaattttggcaacttaccaaaattttgacaggatatcttatatagttaccaaaatttggcagcaaactaaatgtagccacttttttgacaactttaccaaaatttagtaaggttgaaaatgacatcaaagtgaacaggtccttggtaatgcctcaattgaacttgacagttggcactaatctagaactttctcctctgtaacatcaaattttggcttcatgttggtagtaatccaaacatatgcattgcaaccttatcataccaaaatttaccaaagatttgatacggtagcaaaccaaacctatccattattttacgtttcttgttgcaacgaatctggactgttggatcaaaacacaaatggccgagcggtatgtagttcagacattttgtacttgaggttaggggctgtaataggcccaatacaaagcaactctgaactcgcagaacccaacccagtagtaaaataggctgaaaatgaacactacaagaacaggcaccacaagaagcccaaaagaaagatcctgcaaatttgtggccccaaaacaccaaggaaaaagtacaccgaaggtccctcaacttgtcatcgggataaaaaacgtcctcgaaccgcaaaaccatacatgcgagatcccttaactatacaaaaccggtcacccgaggtccctcggtggttttgaccccggttttggtctacgtggcggctgagtcagcgtgggacccacgtgggccccacatgtcagttggccacgtcatcactctctcccctcctctccctttctcctctctctctcactcttctcctgtctgggtaggcagctggggaggacgtcggtgggttgctgccttcggtggggcgaggagggagagggcgagggcgtcggcggccggcgacgggcgacacgacgacggcggctggcgactggcgacgcgccgccgccattgctctcgtccgccattgcagaagccacaggcacggaggcggaccgccatcgagggatgaggtaggcaagcaaggggggcggggaggccggcgtcgacctcctcaccggccgtgacgtcgccatcaagtccttccccaaccggcgacgtggcggccagcgaggggagcaaggcatcggcgggggagcaaggcgtcggcggcggtgaggcggttcttggccgcggccagcttgacccggagtttgaggttagaaatcaacacgaagaatcaatcaagaagcattcagattagcacattccaattggcaacctataaacgaaagagtgctcctaataatcaagcaaaaaatgtgagaggttcaacctctgaggttagaaatcaacatgaagaaagaagcattcggattagcacattccaatttgcaacctaaatgaaattgtactaataatcaagcaaaaaaaaaaggaagtgagaaaccaaatgggatggatggatggagtactgactcggtctggcggatcttgtctaagaaatgggcgttgtagacaccggcggcgtcggcgaagtgtacgactccggagaagtagtgcttgtcgacgtgggcgagcgcggcgttgcgccgccgccgctcccggccgcccgaccgcatcgtcgtcaccactatcagcatccacctcgacacgctgccctcctactcctcgtcgctcacgtccaccaccgcgccgttcccgaccccggccgccttcgccgccgccgcatccggcacaaggctcacctgctggttcacggcgacgtgggacgcggcaagctggtggtgcggctggaataggagaagaacaagtagcgcgaagaaggagaacagcgggcagcgtgacgcggcgacgaggacgacggcgcccaagcccgctcgccctgcgggcgccgcgaagaacttcatggtgccaacgatctccgcggcggcggcaagccaggcgcatcgtcgggaggcacgaatcctacggggacgacggcttcccaatcttcaccgagaccaagtgcacatcggcgccgcgtcgtcgccgccgccgccgccttgctcccctgctctcgtgtcgtcgccgtcgccgtcgccgccgccgccggccgccggacctcctctcccgtctcgccccgtcggtctcctccccacccgtcggccggcggcgccggcctacccacagcaccagagagaagagtgagagagagaagaggaagggagaggaggggaaagagagaggaactgacgtggacaggctgacatgtggggcccacgtgggtcccacgctgactcagcgtcacgtcgggctaccggttttatatagttaagggactccgcatatctggttttgcggtttgagtactttttttttttatcccgatgacaagttgagggaccttcggtgtaatttttccaaacaccaatggatattatggacttttggcctttcaacagttaattattgcttttataaactttgttttgaatctcacaaacacttcgggggtgtagctcagatggtagagcgctcgcttagcatgcgagaggtacggggatcgataccccgcatctccaacgtttttaaacaaatttatatttttttcctgaaatttcttaaatccattttccccccgaatcatattatctgctaagctggaattaaatttcatgactccatttttttcctcctgaattggggagttgaattgcattaattttctttattttttttctcttactagaaaaaatacttgtgcgttgcaacggacgaatgctattttaatcttattattgttatataatttagatatggtaaaattcactgtggaaattcgcttggatttttctttttttgaaaatcatgagctgcaattaggagtctggcattcatctcaagttagcatgcaagttttttaaaaaagatttcttatacgacttcttttgtatttacaaaaacaaacaaacttaaaatccgactcaaacacggatgacattccaaaatactagaaaaacatcttcaatttttataatggtaaataattgcattacgtgctaagctagaattaactacttattactagttccttttctcctggaattgtttttaaaaatttcttaactcctttttctgaactgtgaagttgaattgcattatcagttaagctggtatgcctttaacagttaaaagtaaatttcacaaaacatagattttagaacactcgtaacacaaaacccatgtattatgatttgttttgaaaaccccaaggttttagggaaaatttttaagaaaaccttatgtttaagtttatatcatttttttgttaacccatatatttgtgcataataattggaaaaaataatatgagatatttctaagtatatatacatgttagtcttattttaacgagcgtcatttattggtaatatgattaatgtttatatgtataagttaccagttaatatgttattgttagtggggttatgttgtgttttttcaatcttccaatgtaagaggaaaatgttaaagtacatgggagggatatgtattttgtgcctactaatgcagacatatactactaaaaatatcatatacaatgatgaaattatgagtatttgagataaacataagttttttaaaaacatttttaaaccagggttccttgaaacaaaccataatatctggaattatgcactacatgtgtctcaaattattttgtgaaattactctttaattaccttattactagttttcaaaaaattatataatctgtctttaattcaattaattagactgcttataatttatagggactagttttttttcacacgcaccaaactctatctaacccattccactttgatatatataaaaaaataaattctacaaaactattcgatcaaaactatcgctttactatactttaactaggcgcttcacaatactagaaacaacaacaaaaaatataaaacaaaacaacaattttattccctacatgtctatgatatgtgaacctaatttggatagcacaagtatctcatatgcgtatgacagatggacccaatgacgttggagatataaaattgtagttttatgataaaatcatatactattgttgtattgttgcagtagcccagctaaagttaaacataccggcagttttagctttatacaatttactatataaaaaccatactcgaaaaataaaatccaccatctccattctctccttactcccaagtgacacgaattacggctattttttcagtgataggtgtatccactgacatatgagacattcataatgactttattaatataaagatatatcgatctaatcttttggagatactcatactgtcatacatatatggtatactttcttcatcacataaaaagcccaatcactatgtccagaatcatctttaaaattggattcttttttgatgaagagaacatatcctatcttactttaaagctataacccactaattccaaagctcaacgtacaaacataccacctcacaatccactagcaacaattacatacaaaacttatataagcatgcaacatcatctataattcattaaaatcaacatccaatcatcatccttcacattattttcacaatatttttaacatatatatatccattattttttataatatttaatatatattcatctatacaatcaaagtgtgggatatcatattttatttacaatctcatacaaagtctactaattttatttaacaaacgagttttatttgttgttaatagctaatatatttttttacttttagcttaattattaaaagatactaaaaattacttagtaattcccgtaacaaagcgtggggaatcacctattatatacacatttatatatgggatcgcgactagtgacttgtgagtgtctgtatttccaaaaa

SEQ ID NO: 54175 - DNA, 14898 bp, Oryza sativa
  unsure (1)..(14898): unsure at all n locations
tcggcttctgcggcagcgtcctcttcatcgtcttcgtctgcacccgcttcgcatgctccctcctccgccgccaccgccgccgccgccgcgcccgcctccccgccgcctcctcccacttcctctcctccgtttacgtcgtcgaccaccaccgccacctccccccctccggcctcgaccccgccaccgtcgccgccttccccacccgcgccttcctcggtgctgccccacgcggacacgcctcggcctcctcctcctcctcctcctccgacgccgccgcccagtaagtgctcctccctcttcccccgcaacgatcgcgattccccgcgtcccgtgcaatgccttcgcactgcagcattgcgttgcgtgaaatctaagcttcgaatctacagtgttgttgttgttgttgttgcggtgatgatgcttggcttagagcgcgtgcttttctcgtcggtttggttatccgcattgtggggggttcgaattcgttcttctccgggtgaatcgatcccaacgattgcagttcgaatgtgaacttggatgatattctattgagcacgtttcagttggtaggatcgagtcggtgaccgggggattgaatgcccgctgaattagggcattgtagttgcgggggcgccctcatacgagtgaggaaaaggggatctatcaactattatggattttatattatatgtttgagattttctgtttgagcacatgtcactgtcagtgtttagttgagattctcctggatgtccacttactggatgactactgtttttatgagtttaggtgtttttagatctgtgaagctcttcttcgtagtcgatggatgatactagcatagaagcatgcatctatgttcgttaggtgttcttctatgagcgccgaatcttcacatattatttgaaatttgaattcttctcaacatactagtactgagtatgtcattctccgggcggatatgccaacatgacatgattcagtttctattgttgaatgcaatagtttcttaaacggtatgagcgaatttgggttctacaaatttacatcatttgcaagtatatattgttaatgattataatagatgacctgaactgagaaacaacaattgagacttactcccttttattttcataaaaggtaatattgcctcctgcccaacattttccaatttaatgtttcgcaagcacgtggttgcctccaacccctaatatcttcttggtaaggcagtcatagataactgctacttaaaatcctgaagaaaaaacaccgccttgcaatgaagtttgaagtaccaagacgttgtccttgagtattttgattgattgtttagtatcaaataagttatcatgtggatgttagtgcctaatagaaacagtatgacttttttagtaccatagtgttgattgttgtgtttaattggagattgactattgaatcgtgagatccctgaaaactcgaattattaccaaacagctaagatcattaggtcaatcacataacagaatgcagacattaagttctgttgaataagtcgaggaggaaggatgaggcactgtcatcaagtaggttaaaccctcacctgtgcttgatgggatggaagcttggattaggttggttgtgcgatgtgtatctaaagaagctacagagatgcttctgttaatcatatattcatattggcgctattcgctatagtggttttgctgtatcaaataagaggtttccatgtttggcatcatccattgtgggattgtattttatagttaaagtgttgataaactgttgtcaactctgataaatactactagtatctgaattgtgatttgtgtttctataggtgattgttagcattttcccaattacaccaatattatattctgaatcatttccttccattgttggcaggtgtgttgtctgtcttgcagactatgaagagaaagacgtacttcgtattcttccttactgtggccacaattttcatgcgttgtgcatagatatttggttgatgcagcactcaacatgcccggtttgtagaatttcattgtgtgactaccctgatagcaagcagacaatgtctcctctaccaagtgaagtgataatacctccatgttcccctgaaccatcaaggtcagatcaatgcaattgcctgtttgtcggcacggggcattcaccaaggacatctcaggttcttataaatgaacctgaccagtcgaatcggacattatatagtccatcagtggaaggggataacaacttgccatcatctgaagttaatcctcctggtgaatttaacaaccaaacaatgaaaaagcatgtggagaatcatcgtattcaagacagatcatgatctacctagctaagatcctgcaagtgactgttgtgcagtctgctgtcttcagggtaaactacatgtaaaattataagcagcaatacaggtggattcatggatggctgttataggacataggttactttgaaggatgtaaatatgagaaaattgttcaggtttcttgttagaaaacacatttatttgttaatcatattcaagggctcattgcattaaatagcttgtctcacttattgcatcccgactgatgaattgttgttgtcaacagcagtacatctgcaaaatcacaaagagaagtagctgtcaatacaatcagaaaacaggaggagggcatcttgattagttcatggatcagggtatgagaggaacacaatgtagctgtctcactcatgtagtcatgcaaaaattctccctgaacagcatcaagatcagcgaccgatttgccatcttgtctgtgactgtatctacttggaagcaagttagtcagacatcagcacagtgccattcatacggtaactgcagcagcatgtggctccaatgtcctatttttgttaagagtctgatgctgccatggtaaagtgcctgagattagttggtcaagcactcaaagcatgataatggtgggagccagcacaatgctacataactctgaatctctgatccaagatctgaagattaaagtccagattatgatctctcctctgaaaaccaaatcttgcagggccaggagaacagcctatggttgtccacgcaacgatgtcggctggcccaatcatggcctcctgctagatctaaactgtgtggctgatcaaaccagcaggcagcagcaatggttcatcacttcatcttccctgctgcctttgcaacagtgtgggggctggactgtgcagacatgattcaatcaagtgtactgccatgaaaggccttaataagttttacagtgattcctgtcggtggtggtggccctcaccggagcagatgcagagctcttcactcactcactcactcactcactcactctgcccttaaaatggtggccagcagcatggtgtgatgatcacactctcctgcaaaggcacttcacctggaggtgtagtgtgaggagagctttttctttgcaccttttggttttttggagcttcagcaatgggggaggtcaagcatctttgcctggtgaagttcaaggaagaggtcttggtggatgacatcctgcaaggcatgaccaagcttgtctcggagatggacatggtgaaatccttcgagtggtattgcatcaaccagtgctgttatatttagactatagttttgttttctaaatctgcaggttctgaggcagaatacctcttaactagataacatgcctaagatcacttgtttttagcagctaaatgaacttgtaagtttgtttatccttgagagttcagacaactaattagatttttgacttgttttctgctctaaatctaggttcagcagaaagtgtgacatatgcctaagatcactagttcttttagcaactaaatgagcttgtattttcatttgaggctttaaactgttaagagacattgtgcaaacacattggatctgtaatctcttttttttcagggggaaggatgtgttgaaccaggagatgctgacacagggcttcactcatgtcttctcgctgaccttcgcgagctctgaagatctgacgacctacatgagccacgagagacaccaggagttcgccggcacgttcatggcggcgatcgacaaggtcgtcgtcgtcgacttccccgtcgtcgcctccaagcctgcaccaccggcggcaccggcggcggcggcgtgatgatgacgacatcaactgtccatcaagcatccatccgccatggcatcaaccattgcatcattgttccaagtactttcaggtatccatccatccatctacacacgcagatagctgtgatagatgtaccttaggttccattattgcatgtttctgctgcttcagtgttgagctggtgtagcttagctaaagctgtaatgcagctctatcccgtgcattccgttcaaagcttgttcggttattcttggaataaatttcggtgatcttttggttgctgtgacttaattacttttgccttttttccttttcggtgttaatgatggagtgacagattcctaaatagtttttatgattcacttgtgcttaaacttttgattgagagcaggtttgcaatgacccaggtttggtggttaattactcgtagtacaaaggtaaacagtgagatgttatcagtgctttcatgtgaggccatttacatcggcatttaaattccatctaaagaggagcgatattactactctctttctttctttcccctttttcccttttcatttgagagatgtttggtgctatgtcgatcaaaatcgacaaagttgaccttttgaaatcaaaatatgccctataaaaaaaaaatcaatggagcaagtatccttgtagccttcaaaggaagctatgggcaaattgtcatagcatttacgaatgaaaagggaaaaatagagggcaaaagggggaccaagttgaagcacttcaccgaatggagatttaacatgagagaaaaaaaatggtgttatatcatatggacatatatacatatggtatttttcatgtttattggtgtgcctaataccaaactgatgtttggcagtaatatataatggccatcctgcgtatggcactatcacaatcgtgatgtaaaattgatggaccatttgcatatttcgatggctcaggatgatgagagcagtgataatatatgccactagctgaaagatgcgtactatataataaattgatatcatgggcggtgattttgatagttttacaactctctaatttcttccatggaatcgatacaaatgtgtaaccagtacattagtgacatgtacacttggaattgacccaagagagaaagcaaaacagaattcagaatttcagatagtgaaagagtgagcccgttgcttttgtttcaaaaaacttgcatgccttaaccttacgagacattagctacccaaacactcaacagacaggagtaaatcatcgagttctcgagacgtgcattaaccttacgagacattagctacccaaacactcaacagacaggagtaaatcatcgagttctcgagacgtgcagcaacgaagattgaatgatgggtctgagattatcttaaaggtaaatgcagaggttaaatcactggaacagtatgatcactgccagaaaaatccagcatatatacattacagtgtcgccatatcatcagcctatacgttgcataccttgaaagcaatgcataataaatcgtgaaagcaacaactgaatttggccaacctccaaccaagccatagtaataaacaaccaaagataaggtcagatggcttgccggcgttgatctaatccagttgataaagatagggattctctcctgcttcattccctgcgcttagattcctaatcagttccggtaaaagttaataattattcagggttattttggtgatcagatggttacaacagaaagccagggagataaattatggttgagcatatgtaagaaatactaataaagacattgtcgtatgctattgtagcaagcgtacaagaagggagaatacagaataagggacaagtttgtcgccatgtaccaacacggttgcttggcaaatatagtttagtgtagagctgatgattgagacaatactatcacatgtgggggtgatatcaccatcaaccctttcctccccccaaaattctgttggcaatttggcatcaaatggaagaacagattaagaaaatccaggggaaaaaacagaaccaccaggggaaggaaggatccaggccaactcattctctcgtgaggagaagcagcagcagcagaaaagcaaaaggtctcatctcacgagttgtaccgtgaagcaaacaccaaacagttgtacacccgatgctagtgtgcagctgggaccaaaggtgaaatctgggaatgccattacgcctacacagtgtagagtgtagaagaccatgtgcttcaccagctatactatgcatacagccttggactctatggtagagcaatacaatataaagtagccaagattagttggaccagagcaacaactgatggaagcagatgagtgttaactggtgaacaacatatgcaagatgtagcaggacatggcaatcataagataaaactgatgtaatcaatatgcaatgtcaggaatcagtaccagagatctcaattgcaacagttaagccgcacagtatgtatgagatgtatcgaccgtgcaagagatttcgatggcacagtgcaagaacttaagctgtggcttccctttgttgaattgcagatttgcagtacacggtatgcggtggtatacacacacacggctcggtagcagtacaaaaataatgcaagtcaccctatcagaaattcagaatcactgcagtgctgcattgcataagggcaataaaagagtaaatgcaatgcgtgattttaaattttacatcaagcataaaccagcgcttcacaatccattttctggctgcaccacctcatgcagcacagcttaattaacagaattaaaacacactctaaattgctttctgttgttgtttgttaactgtacggacacaataccaaactaacaattattcagaaaagatgaagaaataaaagaagaggatcctacactacacacacaccaatctcatcaatgtatatgccctgttcatgatcttgtgttttttttctccccaacatgaaaaatctaacacctaagttgcaataaacaacaaccacacatcattttgcttttgctttgatggtttggtaaagaattgagaccaccaaattctcccaatggagacagacagtaaccagagcagtgaacagatttgacctcttggagaagaagaagatggcgttcgtcagggtggcgacttgaacgcctgcacgatgagggagaatcccggcgcggcggcctcctcctccagccataggcggctctcgagcgcgctcctcgcccggagcatcaccaccgcgcagcccggcggctcccggaaccaccacccgtggaggtcccacatcacgtcgacgggggcgccgtcgacgaacaccgtctggttcccccggaagttccagcgcagccggcacgcctgcaccgcgcgcttgccgtcgacgcacacccacagctcgtcccctccgccgccggagccgggggcggcgggcgcgcagctgacgctgacctcgtgctcgggcccgccctccgcgaaccggacgcgcgcggcgtgcatcgccgccgggtcggacaccacgacgcgctccacgcgcgagacgggcgcgacgcgggcgcgcgggatctggccctcgaacttagccttgacgaactccgccgccaggtcgcccaccgcgagcaccacctccgcgctggccaccgccaccacgtagtacccggacaccggctccggcgacgacgccgcggggtcgtaccgcgcggcggtgagatcccagaacagcgcgagcggcgggggcgggggcggcgtggtagtaccggactcatcaccaccacccccgttctcgtcgccggagctggagcccgaggggagggagcgggagcccctcctccgtcggagctggatggcgcgggcggtgggcgacggcgcgaacgacagcgtggggccgagcggggagtgtccccacgtgaggcggagctgcagcggcggcgcgggggccgcgagcagggtggcgcggtaggagacggtgacggagagcgtcggggaggaggaggaggcggtggtggaggaggaggaggagcaggtggagacgcgggtggaggacggcgcggtgcacgccgcgacgtcggcgacgcggacggctccgtcgccgatgcaggaggcgaagtcccgcacggacgacgggagcagcaggcttgacgcgctcaccattcccgctaccgcggcgagatctgcggcggcggaggcggaggcggcggcggcgaagaggaggaggaggaggtggggctagtagagtagaggttacggtggtggaggagtggaactcataatagcggaggcggagacggcggcgaggctgctcaactggtaactgccggagcagaggttggggaggaggaagcctttaagtctgcctgagacgatgacgaccgttggatcatcaactcgcgcgacgtggaccgtccgatcgaccgtacaggagtgcgagtggagatgtttttttccggaatcacgtgggaaaaaataccccttggatataataataaattaaattcgcgtgaaattcctgtgttgtaatatactaatgacaaaaaaaatgagaaaacaatcttttcacccatttatgcacgacaagtaaacccgatctcgaccgcattctcttctctcttttttttagcgtcattctacctttttcacctctttttaattagctatatgtgatttgattttactcttacgattacacatacacacgtactaacgtgcaaacctttctgtattccatctcttatcacatgtttaaagaaatgaaaactagagaaaaatctttagcttccctgaaatcctatcaaaagaaaaacgatgattctactacgtccttaccgacaataagcaagcctaatcagacgagaaagtaccgtcacccatttatccacaagtaatctagatctcgaccgcacaatcttctttttagcttcgagtaaatcaatttttttttaaaattattatgagggcttttggtgggtccgttcatcctttgggcatgcaggggaggaggggccataccatgatgatggtgccatgatgcatttggcgcacgaagatagatggattagacggcgtcgccatccagctgcagtcacgagtggttgggaggatggggcaggaggggtgacgaggaggaggatgcgatgagatgatgagctgcataacatgggagaacaactgttgaggcaaaatgcatgtgtctccatgcaaccacggaggagaatgggacgctctcggacagagtgttggacgagtcggagtgagagggcaaaaattggttgcaatgaactgagtagcatgtcaatactgactataaatctagacacatgcagcatgtcatgtgtgtccagattcgtagttagggtttacctttttttttggggacggactagtagttaggctaagttcctactctctccgtcccactttaagtgcaaacatgattttacgtgcccaactttgatcgtctgttttatttaaaaaaattttaataaaatttagaaacataagtcgtgcataaaatactattcatattttaacatctcataacaataaaaatactaattataaaaaaatttcaaataaaacaaacgataaaagttggatacggaaactcatggttccacttaaaataggacggatggagtaatttaaaaaggctacatccaaccggaaaatacgtactccctacgtccaaaaaaaaaggcaaaccgtgggttcccgtgccaacgttgactgtctgtcttatatgaaatttttttataattagtattttcattgttgttgttagatgataaaacatgattaatactttatgcgtgacttattttttttaatttttttcataacttttcaaataagacgaacagtcaaacgttgaacacagaaaccagggtttgtctttttttttttgacggagggagtagactttttaagttcctaattaaaaaaaagaaaagatcatcacctgcttgtgcggcttctcttcaccttcacgagtcactggagtcaggtcatctgggtacagacagaataccgccactgatcctgacatggctgcctctccaatcctgtgggttcaggaaattttccaaggtcagaacttgagctataaaattatactaaaatatttaatataataataggaaatgtagcgatttcagctcttacactttgtgcgcagatgccgctcgttctgacattaaaaaaagaatatggtagaataaaaccggaacgggacaaaccctcacctccctcataacttaaatgaaacaaatactagcatattgaaaactttgaggtcaaatggtctgaggacacatgtattatggcatctttcatctttatttccatgtgctagtagtgttttcttcactgtgagctgacttttgtgcaggcaatgggggcatagtttcagtagtagtaacaaaattagcttaacatgaagatgaaagtagaggcaatatatgttggatgagaccgatcaacctggggagatggaaccggtggatcatgcatttggtcatggtccctggtgacatgtatgatgatgcaaaaggaacggtactacgcatcagtacggtcatacatcaaagcataggccatcaccaccaaccctctcaagattcacaaatccaatggaatactatgccaggtttgtcaccttgttacctacaggttttaatcataaaccaaaaagggtttcgcgtcccgaatgagtgaggatgaagtaagtagccaaagggaggtggtggaaagnnngannnnnannnnnnannannnnnnnnnnnnngtnnnnnngtatattnnnnncaagtttgtannnnnnnnaagggggcaaggatctttnnnnnnnnannnnnnnnnnnnnnagngancagcgcagtcggtgtgagtattgggtgttgaatagcaaaactccaacgcacacatggcagatgggggggggggtgtggggcagcggaaaaaagggttgcacggaaatgtgaccgtaatctcatcaatttgcacccttttcacctgatcattgcgtttaacccactaactgaaagaatacgccagattatagagaacgaatgggctaacctgctgtgcttatgctgaccctgcagagcagatggcccattggtccatgaataatgaatcagtctgatcagagatgcgagaatacaaaatagtatgggttataaaaatgctgaactgaagtatactaaattgagtcatgggaggacaatctgctttggggtgtgagagtgtgattcattcatcgggcacggaaaaccaggcacttgatcccagaggcattagaaaattggagcaaggtttgttgactttgtttttagattcgatgagaaaaaaagggctgtcccttgcattaagttggtaatggagaaatgggacactcacctgaaaataaggaaagcaaaggatccctgaaaatgatagacagcagttctctttagctttcgacaaccggggaagaacaaaaatcaaatgttaacacagcaagttaataggttttttcatctgatacatcagatagggtggctcttcacacaaccgatctacatgattcaatccagctggcaagaagatgaacgtatcgccagaaagtggaagaggcaaatagtctacttgtatgttttaataactgaagatgaccaatgtacactgaacacggtttcttttctgactttcttttttttttctcttttggactgaagtaggacaacttgacaatggcggatattataagtgcagaaaacacaaaagaggcatacgtggtaaagctgaaatgagacattcagctgacagcaagggaacaaggaaccctgaaaatcatcgaccgcaatttgttagttttcaaccagcaaaaacaaaataatatacttaagtttataatgtctattttgtgatactccgataatgtgggtcttcacacggaatgatctacagctccagtggatttagtccagttggcaagagcataaacgactgcattgccaactgccaacaaaacgaagaggcaaacagtaatatatcatgctgcatgatatttttagcagcataaccatcaaaccgtgtgtagcggggacagtttcttttgtctttttgttaaactaggaaaagataacgctgcagtttttaaagatacagcaagcacaagttgacgtaggaggcatttatgtttctaatctactgaacaagctgctagataatattatgcagttcgagtgaatatatataactctaactgactgcaacaaggcagttgacgagagagtacaaagccttctctgatcatacctactaaaaataagagagaaatattggataaaaattcagatttccaaataaaggcataccagttgaaaacaaacttgtcttcttctgtgcagttgaagttggaacatccccatgctagctgcaagttgaaattgctcaaaataataatctgctgatcagatcagtgtgagaagtttccattccatgatgggcccattgtttagcttgacattaaagaatccttcaacagtaatatgattccattctatactaccttgccaaaactgaaatcaagttgacgcacccacaattaccgagtaggggagtaacataaactggcattgtcttggaactctacagataagttgtactgcccatacggataggtaaattgttagtgctcatcattatacccttttggggaagccattgatgtatatggcttcatattagtagcctaaagcatgagataaccccatcttgaacagtttacagtacctgcagtaggattaggacctttctggcaacaagaaataggtatccttatgtgcattgaataaacaacatttcccttcatgagtcagttatccaagatcagtaggaaaatatgatggtacactcatcaagagaggcaaagtcgaacaaaaagagacatntagcttacatgataaaccgtaagttaaatatgagactaaaataaggcctattttgtggaagggtttaatatggttcattccacagaacaggcagaactccatctcgtatatcaagaaaatcaagtgatttgggaacctagccatggatcggtaagccattatggtgcagaaataaatatataattaccattaaattgagtantgcatgtncaataaacactgcttatttgagatggactctgatgaactgaagtgttgttggcacaaaaatgatgagtttggtaagtacagtacagttagctataaaaatgaaaccatggttgccaacgaaaaggacacagtaggtacatgtttatgagttctgagacagtatatattggatggtccagaactattaatgatgggaatatggttcttctctgcttgatataaacatctaccaactatgcaaaagttcctgcataaaatgtagacacaggaaaagatagcagagaagtcccagcggcccggacagctcacaatacctaggttgcaaattaagcattgtctctgcagttgtttgcatcacttgtattgtactcacaggttgcagatgtacagaagcccgttgggactcgtatgcaaccttactgtgattaatagtcaatacaaacttcatagtagatcacaaaccgactcttcaggatcgtcaatcacctcgccagtcgccaccattgctcacacttcaagttcgaacccgatgtgaatctgagctccagcatgcatctttttacgttcaaagttgtgcccacctctttcttatcctctccatatgcttcaccataacacctcaagataattccttgtttgagctctcacctaaatctcttctatccaaatgagaaatatcttcgcatatgatagtcatataatctcctgccccttgcaggcgcagataacaccaagggccgaacccaacttacagaaagaacaaggcagacaatgtagatagaggaagacacctacaaacatagtgatagtgtccatttcatgctgcgtaccaggccctttgtccatggaagattgtctgcaccgacgcagctcttgactgcagaagcagtctaatgagccctgttttcttatgacacaatgacagccatggccttccctgtagtacaacagatttatggttacagtatggcttgcccatggtgagggtgacacacacatcattgcggtttacagtactgagtctactgactgaaccggaaaacttttgtaccttaatcatataggtctgtgcagttgatgcaatggtgatttcattaacagagaccgcttctgctctaatctaagaaatgtaaatttaaaaattaaaacttacgattcagtttgtaagaaaatatgaattactgtttatgttaacaaaattgtgtatcaggaatgaagtagtgaacacgcccacatacctggaacacgccaacctcgtggttgtgacagaaattaggcagcagcaacaccattcaccatggactcaatcacccaatgcctgacgcgagcagcagagagaactgcaatcatgcccgctgcagcgagtagtccaaaggtggcacactggatgagggaaacggcagccgcagggatcagcatagaggacgccaatgagcgtggtgacaggatggacgaggcgaaggcaacatgctcccgtggaaggcagccagccggctgggccggcgaggaagatactcaaacagcggtaacacaatggtggtggatatgaaatgatgtttacatataaacagtatgatac

SEQ ID NO: 54176 - DNA, 13388 bp, Oryza sativa
aaaagatgacatgtagtccatcgttaaatccagacacctgcaaatcaatgctagatttatacccggatgtcctacgaccaccagaattctttctgaagtatcatcttgcaactcatttagcaaggcttgccatgcagctttcgactggttccatagcccctccagagttttgtattccatgctgcccagccacccagactgagctatttctccaaagctctacagaagaaaaccaagtgttatttgaacaccccacgaaatgcagggagctattaaaatttccaggtaaccaagcaaccagccagtatgtacataagatgggatagctttagcaagaagaatatggtggctggcaagcactcattatagatctgatcactaaatgttgtgctttgcattatctttgcaaatattgatctccaaaaagtgttttcaatctttcccaggctagggtgccttgcgtgggggtgatggtgtgttttgggttcctttgtgggtgtcaacttggtgtgtctgcctggtagaggcgctattagtatagtgtaaaacactactctctttaatgaataggcagatagccctgccatctattgcaagtgtggattttcaaggcatgtacaggatcttcaaatattctatgcactagtaaagctactgtgacagaagccatggaacgtggaaatggtctaaccttttgctttgtttggaaggcatcatcaatttctagttctagcagtttcttcatttccacataacgaggcacacagtcagcacctaagcaatctgcagcctcttgaacctacaattcactctactatggttagatcaagcaggtaataacaataaaacgataatgcattggactaaactttgcaaattgttcagacttcagaatgtagttacctcgcatatagtagtagcagtatcaaatgctgcaacttgtgggctacagagaataccatttaccttttgatctaaaagtagttctgcagtcttctgagactgaaaacatttggccagtaatgagcttaggttttagttagaataatgaaatatacagtttgcaatacaaagaagaaaattacctgtataatcccaagcatgttaagcggtgcataccccattccactgacaccaatctgtaatagaaacagtgtaattacatacataagcagcaaagctcaacaggtaaatattgtctacctgggggtactctttacagaaatataataaaaacctttccttatacaacttatactcgaatttttaatttagttttttagtacaatacttgaacaaatgagattgattcacttaatttcccaaattaaatttaaagaactacaaagcagacctccaggaaaatagtaggtggctcgtattgatccataaaaggtgcataaatttagccagttttagagcacaggttaagatagttaaggtcatgggttcaaatcccttcattaccgttttaaggatttcttaaggtatcccttctatacttgaaatcaatgtacacagtttctccagtgaattatctttgctttcacattttgatccatagaaaaagcgctttttttttcatgcaagcatggatgcacaaatgagaatatatacctctgcactgttctgtgtagctccttgacatgctaggataatcctcttgcttgtctttctccctgcagaacttcctgaggcaacaggagaatttggcgtctgcaaacatggaaacacaattaaatcctatatttactggttttccacctgtagttctgttttgacacaaaattattttattttacttatccagaagatggtacgaaacttgcattaggcaaggcatactactaaaaggaaaaaaaaaacatccatccaactgaaagttacacacatgcacacacacacctgatttaagcggttaaggcatacagctggaggccctccaccagcctgaggggtgaaatccagcacactagcaccacaattgctctgaagtagaatccgaaagtactctgtgccaagtcctaaatgcgaaaaccagtaaaccagagatcaattgggcacaaccttggaactatagaatcaacagcaaagcctagtggcaccaacccaacgaagaggcaacaagagcctggttcactgcattatgtgcaacaacaagcaccgacttgccctcatgtgccaggatcctctcccagcagttctgtgcgcggtcccagagctcccgcactgggtagtgcccatcaatgctgaagttggccgcgttcttctgccactgccggtagataactccatacctctccttcccttcattcttcaacaatccctgcaaatattcagacagtgataccaaccaagcatacatccgttcaggcatttgcacgaacatcctgtgagcaacctaatacccgagaagtatcccaacctggaaggagtagagatcgatctcgcggaggtcagagtccgggatgaggtcgtcgtcgcggtcggcccagatgatctcggcggtgcggcgggagcgggcgagcgggctggtgaagcaggcgtcgaaggagtcggagaggagcatgaggcgggaggtctccgcctgcgactcgcccttgggcgttagcacggagatgtcggagctcccctggatccgcccctccgcgttccaggtgctctgcccgtgccgcaccagcaccacccgcttcgcctcccgcagcggcggcagccgctcccccggacgagggttcggggatctctccagttcccgcacgctcgagcagcggacgcggagggctgatccaccgaccttcctccggcgagcggcggccgccgccgccgctggtgagggagcgaggaggagcatgggtgaagcgagatgggattttttttgttgttagactcggaaaagggttgtgtggtttgggttgggtttcccgcgaagatttttggcattttgccataggaagaggtggaagcgtactaaccaaattacgcgtttggactcattaggcgtacagtggtaacaaattcaggccatgtttagtttcatgcccaaattttttttatcgtatacggacatacatttgaaatattaaatgtagacaaataataaaacagattatagatttcgtctgtaaactgcgagacgaatctattaaacctaattaatccgtcatagcaaatgtttactgtagcaccatattatcaaattatggcgtaattaggcttaaaagattcgtctcgcaatttacatgcaaattgtgcaattttttttcgtccacatttaatgctccatgcatatatccaaacatttgatgtgacggaatttttggatgtttgaagggaactaaacacagcctcaattgatgtcttctgcactacaaactctgcatttctgaaggataagagattcagagcagggttcgacttaccgccggtaaccgcgcggttaccgcggttactgggcttactgcgggggtacggtaatataaaataccgcggtaacctcctcaaattcaaataaatttaaaaaataatttgaatttttgataaattttgcgcggtttcatacggtttttcacggttaccgcgcggtaaccttgcttaccgctggggcgcgataaccccggccccggcggtttgggaaaccctgattcagagtactcattcaattccaatgacctacatgctcatgctcattgttttttttaaaaaaatattgtttttcgttctggctttacaaccaattattataaaggttgtgctatgaataactgcgaaaaatttacagcttcattaaaaacaataaaaactacttggtatacctatatcactcataaggacatcattctttcggatacactcaacctcaagttgctatgcaaggtataatagctcacatccgacaattaaatttacaggtaacctcattactaagtacttcttaatgtgattttgaaactatgccgatgaccagatagcacttaaacagaggctaggagatggacaaggctgtcataagcattcaatttaagatggaggctgaacttatatcaagttcaagtccacctcggactacaggaacaatctgcattagaatcatcgcccggatttcattcggactctgctcttgacgttttacatatgtatggaaagctaatgagatcatctttccaatgaatatggtctcacataaaaattccttccaagtcaacggtaatcatcaaaacaaaacgacgtccagaatctatcatagtgacgcgtcatagtctttggacccgttggggcttgtatcgtgtcgaagtccaataggaatgcatatagggatccaaggtcaaccctagaatcaatattgtcgacgtttgatgtcgtgactacggtatttggacagtatggggatcgttggtactagggtatacgcgagactgaggtaaaagagatggggataaggatttttatacaggttcgggcccctgaattgtcaggtaataaccctacatcctgttggccgaagccggtattgctcttattcaccataatcacaccagtataatatttggggtagtctatctaactgttgtcgacatggcgatctgaaggtctgactcgtagtcgacaacagggtagtcttcctcctcgaatctgtgtccggcgagatcagagatagcgctttcgtctctcctgacagtatccggagacaccgtaggggactagccgtgcttatccctgaaatcgatatccggcgtcttgtcttggtgtatgttggcttgtattggctttgtggtgtctatgttgcccgtgtcttctatggtgggtgtgttgattgtctcttctatggtgggtatgtggattgtctcttctcctcctagggggccttgtatttatacccataggtgtccccttgtccaagtagaactagggaaaccaatatggatacaatccgagtagtccttgtcgtttccatgtagaactctggttgtcttcccttatccggaactcttcatatatccgcaggttgtttccgtatagtacatagtatgtggtgggttctgccgagatttagtcaactactattatgtatgtggtatccataaccctgacagtagcccccgacttcaatgcaaatgagcgagttcatattctcaaccgcagaccttggaggaactgttatcgagctcacatgaccgttctcgatgagtccagagataacgttagacttcctttatcagcctcgtgcgggcacctaaagggtttgtctgagtcaatctctgacgtcaaccaagaaagtacagagcatgcgactaagtctcttgtcttgctgtaatcgagaatttggattgaatttaagaaattttatctcggcaggttcaccatcttttcattccgtattccttgtcgagatccaccaaccgttctcgagtaatcgagtaggcgtagagtctgtaacggggccttgtcaacatttgtcgtactcgccttagtcgatcttgatgtagaatcatagagacatggagtcttcgataatgtcgaatagaattttcctgaaatcaatactcaggaaagaatattagatagaaatagccccccagcgaatgctcaaaggatgacatgttataatatgtatggaaaaccgaaaatgaattaaacttacagaccaatgttttgtgtatgagcgtctactcttttaccgacttcgatcagtcagtttgttgagttatacactctccctagcccccagccttgtcgtcggagaatcgttctcggaggataaggctcttggacctttgacctgcatcggttgaacaagcactgatcctagcccccacccgtgaagttggaaaatccatttccgattacatggcttggttaatacgcacggcgagaactcttacacgaccagatcttacatggtctttcatctttgaaggatccgacaaggccttatctgctctgggcgtccccagccgaagttcccttaggttcctcggaggccttgtcaagacggcgtaaagggacattaggataggtttcaacgctaggtgtctttgtggtaagggatctctgggtaaaacacttggcgatattgtgtacctgatatcaactttgttgaagtagaggtaatgggagaatcgctacacctctggtcaagaaccaggtaatagtcgtaactcaaccattagaagtaaatgtacgagagatcgctacgattgactagttgagaaccaatgagtaggtgtctctcgatcatttgaagttgtggtacgaggaccgctgcgttattgctgtagtcgtacctcgaccatctgaggttgcggtgcgagagattgctacgtactggttcgaggaccagcgaacgtgtagaatcatctctcgaacaccaatggaggttgcggtgcgagagattgctacgtactggttcgagaaccagcgagcgagtagaatcatctctcgaacaccaatggaagtttgcggtgcgagagattgctacgtactggttcgagaaccagcgagcgagtagaatcatctctcgaacaccaatggaagtttgcggtgcgagagattgctacgtactggtttgagaaccagcgagcgagtagaatcatctctcgaacaccaatagaagtttgcgtctcgaacaccaatagaagtttgcggtgcgggagattgctacgtactggttcgagaacagcgagcgagtagaatcatctctcgaacaccaatggaagttgcggtgcgagagattgctacgtactggttcgagaaccagcgagcgagtagaatcatctctcgaacaccaatggaagtgctagagttggtttattacatgtgcgtctcatgtggccagcatgactcacacacccaacttgtagcatatccggatgtccgttcgcaatcatgtcgggtgatcaagctgaccgcgttcgcgaggaattgtccgttaacaaccttttctcgagtagtccagccatggccggtgctatgagataggtcgtcggtcttcgttggcaggttgggcgcgacgactctgcattcgtcgagatcgttctcgataatgcggtgtacttgaccacaacctactcgagtgctcaattgttcctgaaaaatattttctagaagacaagatatatagcagataatatcgagtattctctgctagcattatcaggatataaagagcagatgtaaatattaggtattatgtaaaccgtaaacaagcatgatttatacagaagaaaatagagcgagcctccagcattaaaccgttgtcggcctaacaccggaaacactcgcataatagatattgtataaaaaacatgctctaggtaaacataataaattatagatctaacaatattgtatgatctgaaaaataggtacgataaattgcatataaaataatgcgtacctgtgtagatatatgctggatatatctacgaaattagtagattaacttgaaaattaacctactaaatacctttggtttgcccagatggcatatacacatataactaaagtcaccatgcatgtatgccgtatggatgtgtgttgtctgatctttgaatctgagttgagccacgtgtgcatgtgcagttggtaggaaatcggtaattttgttgaccgtgtatcccttgacttacgtggcctcgcaagtctcttgtcacggcaagggataattagagtccgattcccacacagcatacgagcacacgtagtcgtctaggattcaggggatgagtcgtccgatttcctcggtgatggcgttgatctggcggctagatggtcaaccgatcggctctagtgaattttcagagcagacactgtgacccgaagatatagctggcgccgacgaagtagtgaactattgtcctccacggtcagctcaagtactccgattggtgaggtagatcaatttgttgacgatgatgatctcgatctcgtcgggggaacgtacttcgttcgggttagatctcccagagccgaagttgtcgagtaacttgttgtcggagaatccatctcttaaacccatctcgtcgaaaacctgaagcaccaaaatcccactacctggcgcgccactgtcgacgtttaatgttgcgactacggtatttggacagtatggggatcgttggtactagggtatacgcgagactgaggtaaaagagatggggatgatgatttttatataggttcgggcccctgaattgtcaggtaataaccctacatcctgttggccgaagccggtattgctcttattcaccataatcacaccagtacaatatttgaggtagcctatctaactgttgtcgacatggcggtctgaaggtctgactcgtagtcgacaacagggtagtcttcctcctcgaatccatgcccggcgagatcagagatagcgctttcgtctctcctgacagtatccggagacaccgtaggggactagccgtgcttatccctgaaatcgatatccggcgtcttgtcttggcgtatgttggcttgtattggctttgtggcgtctatgttgcccgtgtcttctatggtgggtgtgttgattgtctcttctatggtgggtatgtggattgtctcttctcctcctagggggccttgtatttatacctataggtgtcccttgtccaagtagaactagggaaaccaatatggatacaatccgagtagtccttgtcgtttccatgtagaactctggttgtcttcccttatccgaaactcctcatatatccgcaggttgtttccgtatagtatatggtatgtggtgggtcatgccgagatttagtcaactactattaggtatgtggtatccataaccctgacaaatatattaagtagtgatcattgagtgaaggttgagttttgtttagtatttctaccattgcagtttcaccgttcatcggtttatggaattccaatttcaagtttttgattaatcattcatctgcaattgagttgttgtctttcttgttattgcttgtgttattcgaatctgcacgcagggattagcttttctagcaaggctgatcgggttttggcataaccagatgagacatgatactatgattgcatagtttggatcgtgtcgattggaaaccgaatcgtgtgcgccaagttttcgccaaatcgatagttgtcctcacttgacagaagatcaggcatcccgtggcaatcaaccacctaaggtagatattttcatttatggttggccggcgtatatataatctctgtaccaacaacttataagttatatacagtttttatctttctcaaatcagaaaatcaaaatccctgaaattagcggacgattctcgtcgatcgaatttcatagattttggtctctttggtcatgttaatagattgatcattctattgtattttctctttgcgagtatacaggtgataacaatacattttggtctgtactttttgcagaagcagaactacgtgttggcatccatataatggtaaaattcgaacagaaaaaacaaaatctgtacaagcaatcacaaatcctaacccaaaataaaccctatccaaaactacagtgcagctattttcttcaagaaacacacactgggcaagaattcacaagccatacaagctgttcgtctgatccatggatggatcacgacttgaacgagctgtttgagcttcccatggacttgaggtccttgtacggccccgacgacgtcagctcctgctccatccccccggcgcgccgccgccgccgccgtctctgccacagccggtgacccacgtacgctccggcgacggccaggctcgccaggatcagcgacagcgccgccgtcacggccttcgcgccgggcgacatgccccgccgcgtcgagctccgcggcggcctcctgaccttgaagtagcccaccttccggtcgtcggcctcgtacaccatcgtctccacggggaagtcgaggaggtagcagtagccgctcgcgccgctgtgcaccgcgccccagcagctgcagttgccggcgcacgcctgctcgcactgctccgccgtcgcgttcgcctcgaacggcagccgctccttgtacgccacggacacccgcttcagccggacctcgtcgaacacctggccgccgtcgctgtcgccgtcgccgcagaggtcggtggtttcctcggcgctgcacggtggggaggtcgcggtgctgttggtgaggcactggcacttggcctcgccgccgccggggacgcacaggccgtacgcgccgcacgaggtcggcagctcgcacggcgccgtgatggccttgtagtcggcggtccatgccttggcgtcgtcggtccagtagtacgcgcggaggttgccgtcgtcctccagcgtcatccgccggaacgcgccggtgaggttctgcacgaacgtgtcgaacgacagcacgtcgaccttctcgccgctgccctggaggtacagcccgaagaagccccggccgtcgaggcagccgtacaccggcggctgcgtggcgttctccggctgcgcctcgagcgccgtgtgctgccagtacatcggcgtcgccctcccgccgtagaactccatgtgcagcgacatgtacgtcttggcgagccgcagcgcgaagcggcggttcccggagatgagcggcggcgacgacacggtgaggttctggtccaggacgagcgtgtccgacgggttgtcgaagctctgccacgccggcgcgtctccgcgaaccgccggacgacgaggttggacgagttgagcagcacgacggtgtcgccgatggcgttcagcgtctgccacagcacgccggcggcgtcgtcggcgccggcgaggacgaggccggtgtcgaaggtgagcgtcgccgggcgcgaccagtccccgacgcgcgccggcgtggcgcgccagaccgggaatgacgaggcgaggtgcaccacggcgaggtccagcgacgccgcgccgacgcggaggaacccgaaggcgaaggcgccgttggccgcgtacagcaccggctcgaacggcgccggcgcgtccggcgaatgcctcgccgtgaagccattcgacagctgcgtgacgcgcccatctcccttggcgccgtcgacgacggcaaccatcaccggcgacgccacgcagagcgccgccactactccggcgatcgccggatcacctttgtctaacctcatttcatcgacacgacaaaagaaacctcaaacgactcggatttcggacagagtagcgcacactacatacatagtcatatataagcatcacaagaagaaggtcaacggccggtgagaaatgagaatgcacctccatttggaataaatccacggccaaattaattaaagaatgagaattaacatgccaatggaaacctttgcatcatctgcaagctgtagttaagttgggactaatctagtggcagccatgcatgcagtgtgtgtatgaactgtccaaaagtcaacccttcgtttctctgcctaccattatctgattctctctccgttgaatggcccattaggatcagtagtaaacgtggtaaaagatttgatattgcttggtggattgctgcttgttcatacttcacatatgtgcagcaactagcaattgttaaacattcaggtgtcgacatcattcagttcatcagacaaagtgattaaccggtgagatctcttgtttgtgcaggcgtttacttagtttagcttgcttgcagatgcatatcggtgtgccgagtatttgttaaatctgaatgtccagttgacctcgaacggcttgaaaagaactcaaataatgtaaaatatattcctcagattgtttattgagcaaatcagtcacctgtcatataaggatatgtaatattcaccgtatggcatttgcagatttcttttctctgttggaaatctcaaccaagacttgtatatgaatgaagattgaagagtcctgtgtgccatttcaattcctcggttttcgaataattatcgctattcagtattactctctctctctttgacgtaccgtagagaaattagggatatggtttttctacacctaggtgtacactaggttacaatgaacgtaaattctagtatgattgtattcataacgctgcacacttcaataatataacatttttctaagtttttttttcccaagagaataaacagtcaaagtttgagattgaataataacattgagttactattcgagaacggaggtggtaataagacaagccaaaattttctgcaaagaaatgatcaaatgaagtactagaagtacatggtttctagagaagtccttactggaattgctttaagttgactttccaaagttgggaaattgcaccctttttttttctaaggaagaacatatgctgagctttatttggatattggaatctaatggttctccccatgttataagatatggaatcactttggaaaatgaagagctacagctttggggtcaacttcatgtcttcaatcccctcttgccggccgtatgtacaaggtgcttaaacttcatgtctatgatccaagttagattaggtgcttaaactctaaggttgcagtgtattgcaggattgaaagaatgccaattccattagattctacaacgggtacaaatttacaagctgttactgcagcatgtaagtataattgttgccatattaatttgttctgtggtctgaagtctaaacagttctgtagtatagtgaaagagcacacgaagcatgtagtagaaaaagagcacacaaaattcatcagagcttcagatgaccaatacatgtaacaatcagttccaattttatttctttcatgtcaaatttcaaactctcatattcaaataacccatataaaccaataatcaggcgaagtaaaaaagaagtatcgaatcagttcaagaaaaaataattatggccttttcacatttcctttttatttttgagaaacacatttcaattttttaggaaggccagatggctcgacttgtattgaaactctgagagccagactgccagatagggctaaaataaataatagtatatcacatggtagaagagaattaatttataatggagagggaggaaaaaaaactctcatatattaaatattagtattcatcgcgctgtattttcacaaaaaaaaacagtttcttcttttttctacattgtactgtcaataaaaattgcgtttgattaacaactaaggtgcttgtccgtcgggcgcgtcgtcttggtcgtcgtcgtcggcggcgggcagcttatggcggcacagcgggcagaagcggctccgcgccagccagtcggcgaggcacgcatggtggaagctgtgcccgtacgagcacggcatcacgctgatgtcatcgcccacctcgtaatcctcgatgcatatcacgcattgcgccgcagccccgccgccgcccccgcagccgtgct

SEQ ID NO: 54177 - DNA, 3520 bp, Oryza sativa
cccagatgaaaaagtacggccaaaagatttttctatgttatgttaataataaataaagaagtatttattggtaaaacttgttaatattgttataaaaatgtattgaagttggttgttgcgcaatttcatatgttaagtgaggtattatttgtaccttattcgacgtattagtactcggataatttatataggcctatcgcagtctgggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgtttagtaaccctgtattgctttggtagttcaagctgcacaacacggctaggtggagttagaacccttctgatgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggatgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcacaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgtgaataaaggaggctgcatcggtgcggcagaaagtagtcgtgcatgcgccgaaaggtatcgtgcacatataacaacaacgtagtcattacacaagcatacagtactggaaagtgaagcaagtaaacaaagagaagactgctctactggccctgccccgcgccacgaccacgcttggtcctccgggcctgtgctcgcacgtggttctgggagtaggtgaaacgatccggtggcacagcacgggtagcacgagtgtcccgcggaggagtggcctgcgcctggtcctgcgtctgcaccggcagtgtgcctcccagctgtgaggggtcgatgacgtcctctgtcgagcctgaagcgacgtcgaagtcagtgatgccgaagaggaaggtggaaggcaacaagtggtccgacgaggtcccagcatggtccagtggtggaccctgactcgacgtgccggctgcctgtgacgaagtcccggtgtactgccagaactgcgctgagtgcgaggtcgacacagctgcctgagacgctaaccctgcagcctgggagaagtgggcggcctgcgtcatagcgaactgggcgaaacctacacatcgacaacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacagaaatagtaataaaaatacttacctccgtgcggagggggagtcggcctaggaacgtgcgcagctggacggggaccagtcggtacggggggccgatgtacagctgcgtctgcccgagcaacgtcgtctgcacgacaggtgagaactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggttgcagtgtctggcatagaggtctctagtgctcgcaacgtggggctgttgctccaagggagcgaaggtgaccctagtacgggtgcgtggctggtaccagcgtaggtaggccttgtacgactcctcagtgtgtggctctccctcgtggtccacgacctcctcggttgcgagcaaccagtcctcaacaaaagtcgccaacttggcgggccagtcgccagctgactgctgacccttgcgcgagtacctgcgaattaatgtgtaatattagtgtgaaacgacagatgttacaaattattgtgaacaggcagattttaatgcaacaacggaaggcgtagtgcaagatcttaccggtgaacagcagctgggacggtggtcggaaacggtactggaaagggcagacggaagccgaactgccgcatcacgcggaaaggggcgtgaggctcaacgcagatgtcgaagaccatcggaaccgtggtcatccagtacgcctggtccctggtgcagagtgtggacagacccaacggcgcacgagcctgggtagccgtggcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgtcggcaccacagagtacccatcgtagggtagtcgacctctggtcgctcctcatacagtgactcctcgtacgcgtgctggtccacctcagggcggccgatcgcaatcctat

SEQ ID NO: 54178 - DNA, 1295 bp, Oryza sativa
gtcagatcgtcctgccagtccacagccgtggtcactggcccaacggcgtctcccgcgagcggtagccccaacaagtacgatacgtcctgtagggtaggggctacctcaccgcacggcaagtgaaaagtgtgcgtctctggcctcgatcgatcgaccaaagctgctaggagggacctgtccatagtccatcgtctggccgggtctgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccagaacgtcccaagctgagccccctgcaccacagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacatggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcat

SEQ ID NO: 54179 - DNA, 5260 bp, Oryza sativa
tgaactccactatgccaactagtggcagtccacggacaccgcgcatcacccagttgtaaacttctgccaaatttgttgtcattactccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatgaggccgctgcacgctgatcactgcatttggctgtcaactcatctaatctcttccaaagctcattgaattttttctcctggttctgattgcacagcctcttgaacatgtacatgagctccttgttcttgaattgcttgaagaaattagctcccatatgacgcatgcaccacctactctgtacatcttcccaaacaccggggtatcctcgttccacactcccaaactacaactctcctatcgctcgcagaatgccagcgtgcctatcatgtatcaggcatacatttggcctcataccaacaacttttgttttaaccaatttcaggaaccaataccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgccatcttgcatgcatgtagagctaaaaacgccctttgcagcacactcttgccaggatgttcaattgagggaaatttcttcacttcgtaagagctcccagggtttctttcctcgataacaccaagcaggcgtggcaaattgacatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgcgaccggttcgacttggcaacccaaaactctttatgaagtgacactgcaaaatgttttaccgcctcctttatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcactgacagtctccccctcgtcggccactccacctggttgaatgcccactggagctactacgcccccgtcctctcgtgcgttgacctcctccacagaagtctcgtttacttcagcacttggtccctcgccatcatccatgttcgtctgcacacctagatccttcgggtgaacaaacggaaccaaagctagaggccacccgcgttgcaatgcattttccaaataccatctccacactcgagagttttgaactggcattagttcccaataaaaaccctcagttgcccgacttactataacattaattgttatgtcacttgtctgtggatcaactctcaagcccctcattaaccatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggtagggctttgccccttcttctcttctcctcccctctcttcttttttttcactggaattgaggagagaagaatgagggctgggggctgggcagcaggccttttataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgctgccccagaggtgggcggcaggggctatttctgcaatttttttggtcgatagattatttctgtaaatattaaaaaaatctaaaaccgaaaaaaattctatggaaactgggcccaagccgaaatatgtggtttggtatgttcaaggtgggctggccctatgtggtttggtatgttcaaggtgggttggcccgaatctaatccaacgtgtttttggaatttttttatttatacatttttattaaaatatttacaaaaataattttttgattcgaaaatttacaaatctaatcgcctgccgccctttgcccttccagagggcggcaaggcacctaaatgcaaatttttcagcacaacttgttagctctataattttataatttaaaattatattatataaagtcagatgaaataaaactttatatcaaaattgtagatctcaaggagatctacaactttgtagttaacaacttttttatttaagatgttttagatatccaaatattcattacaaaatataaaacacattttaaaaaatctcagatctacatttcaaacgacattgaatggagataaactttatataaaagttgtagatcttgatgagatctataactttgtagtttatcacttttccatttaaaatcatttggagtatcgaataagcattattagtttttaagcaattaaaaccggtggaaagggtttaaacacaaataaaaattttgcatttaggtttttaaaaatcgccctcccaaagggcggtaggcgattagatttgttaattttcgaaagaaaaaatatatttttaaatattttaataaaaaaattccgtgtttttggacgtttatttagacttctctctttttgcggtatgggactatgggagagtagggctgttgcatttagaggatattcaaagttggaggggccaaattttaccaaatactccctccgtctcataaagaggcaactccgagtttctcaatgcaaaattaaataagagaataaaggaccaaaatatccattataaatagcaaattagtattggtgaataggtaggtaaggggtattgaaggaataaaatttttcgattttgcgaaccgagggtggatgagaaggtagaagttgatttgttttgggacaaagtttgaatttcaaaagttaatttattttgagacggagggggtagatatgattgggttggtgacttttatgtcagtaggatggtaattgaggattttcatgtcgaatctataagtcggtgatcttagataacctaacaagttgcaatgctcaattttcgatctaaataaggatagcgtggcgtagtcgcagcgcgcgcggaattggattcacattttgaattccgggttttgtggaggggcgatttctgggcgatctcatggggggcggctgtcggggcttcgccggcggtgacgccggcctccttggcttgcctgtggcggccctgtttctggcgctggccatccagccactggagtcctcctcttgttaacgaccaaatttggtaatatcagcatcggagatgaagatggggtcgaggcagaatcgaagatgaggattgttatggaaacagagtaaggatcggctggagtcaggatcggctacgattgggattggctaagtccgagttagaccgggttaggtgatacagctgattccgacaatacgatctgtgtacgacatcgggttcgagttgatgtgcgtcaagatgattgccacgcacggatagagtcctgggaaggcaattgtatctattaattaggatattttatgtaaattccttatagataagtgtgggcaaaagtctgccgtaaagacttgtgatatcttagagtttgttagagataacagtcgtgtccggtatgggcatatcttgtaattctcgggtataaataggccccgagctctatgtaatgattaacacacacgttcaatacaatttcggcgcatcgccaccctttttcctttagttttatttcgacgagttcttgctttcgggttgagctgcatcggtttcgatcttcaacaagaggtaaaacttgttatggcggcttgcgttctcaagattagtgcttccatctttatgatactctagtcttgtttatgtaattcgtcgagttatcatatatcttacataatctttgacagtatcgtcatctaacctgcaatcggctaatatctgttaccagaaggcagccgattaggttaaataacgacgttggcttagattatataagatatccaccactttatgaaacatccagcggcttgattgtctagatattgttcttcttttcatacttaatgctacatcagttgagtttgatctattaagtcgtgtttagaatttcaatctctagcctgcctactggttgccgattagagtagtatcggagtttcagccgatcttatctgatttaattacttttatcttatatgcttaattgatatgttaaatccgtcctttaggttaagatcttgttacatttaagtatattaggcttctgtctagtatattttacttgccctagcatcttaatataaagtcgtatcggagtattagccaatacacgctaaatttatctgatcggctatgctatgaacatatataatcttgttgttaatatatctttcgatctaaatgatttatactgtctcggcatggtgaccgatctatcc

SEQ ID NO: 54180 - DNA, 26338 bp, Oryza sativa
tgttaatgtctacagccgatcgagtagatctagttcttctttacttattcatggttgccgatcgatctacatatgacatcggctcaaagacaaatgatatgtcatcggcatctagccgattggctatcatttgtggatttaaccacggtttctttgtctttgtttcttgttgattgcaggatcaaatcaactggcacgctcatacatccgaaggcgagttttggacctgcactagagttaagcagatctcccaggcctcgtgttttctgtcaacacctccggaaccaggaatcgggccaatgtttcaagtccgacattcttcagtctagtaaacagcgttcttcaggccgacggccgggagtggagctgtatccttccctcgccggcgctgtgtccttgctccaaaaacggatcaatggtccattggaggctcccctgaggttcttcctcactgccggcgatgagtgcatctccttcggtggcggcttcttcttcctcaggacaagagcaaggtaattttcctacctaggatgcaggtgctgatctctgtgcaggaagtctgaaggtctatggacggcgccatgactcccaccgacgtcggctaaccctagcaccaattccttcgccggtaagtggatctcgcttctccagcctaactgacgtcatttaggaaggagagatcgttaattcagccggctgcaatcaagaccacgtttgtggacagaatctgattgcaaccatggctgccacaacttctgctcctgattctcccgctcaagttcatcacaacggctcaacggctctcgccggcatggaggttataggactgaaaacgcatgactctcaatcaggagagtccgatctctccctaatccaagggttctgggacgagattggttttcccactcctgcttctcgttggtgggaacaaaaaagcccgatagtgtcaggggtgactccgactgccccacctatcaccgaggacgatcagtggaccagagtctcatcaaaacagaagacaaaatccactgagtgccatcgccgtggatgggtaatgcgtccatggaaggtaccattacctcgtccacggccagtgcaaacagttttgctggcagatttcttgccgcgggccaaaacttcaccaaattcaaaatcaacacctacccaagatcggcaatcgatggtgtccgcatcaaaccgagtcgatcaaagtgcgggaggacgatttttggctaattcccttccccagaattcagttatgagtgtcggtattccttccttcccacacagaccgattggaaaccaatttcgtggaaagtccctagcccactttcgcctaaacagatgcacgccatctagcgagagttctccgaagaaaccctcctaggcagcgatggcggcgcgccctcgtgatgatgcagcgacggccgagcagcgacgggatgatggagccacagggaatccacctttcaatgcaagaaatcagcacgggccaaaccactatcctccgcgccagttttagcggccaccggttttcccgaggttcgggggcaaccatgccggtgggtctgggactgggggatcgggagggcgttggcatggaggcgccgggcagtctcaatgcaatagcaacagatggtttcctcagggaaacaatgctgggggtcatcacaggcgagaccatgatgatctcccgtgtccggaccagcaagatcagaagcccaaacctcgggggaaggggatggcggcgcaaggccagcaaacggagaaactggaccaaacaacagatggtgggcagccacatcctactgtacaagcaactaaggccaagaagccgaggccacctcactgtcaccagtgcaaaacgagtggtcacatagcgcaggtatgtaaagcggacatcgattgctatgtatgtaacaagaaagagtcacatctagctgtcaagtgcccgctgctcaaattgccgaaacctacatgctctctttttggatttgggaaaaccgagttcggttttatccaaatcagtgattttgggatgaatgtacaggaggcttcattggttccaacagctttggtctctattcgtggcggctccttgacgcctgaaatagttcagactgagttagctcatcgaatcagaccggattggaagtgggaggcagtccttcatgctgagaattccttccttgtcgcttttccttccattgaggaattgaagaggatggatgatgtggaattccgtctaaaaaatcatggtgtgtcaatgacaataatcgagtggaaaacgactgatgagctgattccggcatatgagttggatgaagtgtgggtgcatgtgtcgggtgtgcctagcccatggcatcattacttggctttttgggcacttggttgtgttattggagctactcaggaagtagatatgctcacctacaggcggacgggagtgattcgtgtgaaggtttgtatgcattgtagcatacaactccctgtcactacagatgtggtttttgggaaattgggctacccaatcacttttgctttggaagaggaaggttgttagccggcacagatttcggaggtggactttatggaccatgacggggatgcacaggaggatcatgaaaactcgtcaaaggatggctctcatgatcaggcacacaagagggctaagaattcagcttctccaacaatatcaaaggaacaaaaatcagatgttacagccatgcaactagttctaacaccgtttggaaattgtcggcctccaccaccacctcgtctggtgatcgcaaatgggatagcttacaccattgttcacaccaaatcaggtgcaacagtggtgggtgaggtaataacagcagcagaaaaggtggatgaaatttatttgtctcaaccagtggacagtcctacacccgatcaaccttgtttgctgccaccggagttggaacgttggtccttgctgtcctctcagccggctgcagctgccaagatcaccggcgaggcctctttggcagctaccactgctgcactctccctagctgtacctcagatggctacacctacctcaaccgatgtcaatcgcagcaaggaccaactgagcaagacatcttctacacctcgttgtcgtagtgtgagatccaatgttgagaacatggatggcatcgctgcgggggatgatgactcactgctcaaggcaatgaagaggaaagcattgcgcaatttggatgacagctttgttggacgggaggtttcggcaacgaattcttagcagcactcggcctctcataaaacatcctctagtgaagatactgttataaattcatccccttctttaccttctttacattatgattttgttgcttccaatcttagttctttaggtgtttctttgggtaactctcatgatgaaatttctttctcgcttaacgctttgaaacatattgaggttgatagaactaaagcaacaaacaagactagtgaatgtaaccattctaagcacgttttttcagaagtggatcattttacaactagtgatgacgagggcgacgatgatgttgccctactcgctcacttagtaaaggatctcacggagattgatatggacgatgtggaccaaagtgacaaaatttgtgacttgttggtatccactagaaaaatccaaatcttcttcaaaaagaaaagagcgaaaggctcgttcccaaaatccaaaagcctctaaatctgtttcctcatgaaaggtattttttggaatagcagaggtcttgcagacttggctaaataccgttatgttgcagaaacagttagagagaaaaatactagactatgttgcgttaatggagacaagaaagggtgaaatgtcaaagatgaatttagatcgcctctctgggggtgctgatttcatgtggcattgtctcccacctaaaggaagatcagggggtatacttctcggaattaatgcagctgttttggatatatctttaattgttgaaggggaatttttcgttaaatttcatctcaacaatagggaggataattttaaatggatcttgatggctgtgtatggtccggcccaagatgattttaaatctagtttcttggcggagttcgttcgtacatgccaacaaaatcatctacctactcttacagggggggacttcaacatcctgagaagtagtgtggaaaaaaacaatgcccgttacaactctcgttggccttttctcttcaatgttgtgatcgatagctttgacttacgagaaatcgctctttcgggtaggcaatttacatgggcaaattcgcttcccattcctacttatgagaaactagacagggtcctcacatcaattgaatgggaatccaagtacccctggtttcggttcatgctcttgacagaggggtatcagaccacacgcctttgctccttgacacaggggaagcggccttcacgggaaacattaaacagtttaaattggaactgggttggtttctacgtgatgacttctatgatcgtgttctcgagatatggaacaaactagtcaagggtcgtaatgcggtccaaagatggaataacaagatgagcgctttacgtcgccatcttagaggttgggctgctcataccagtggcgtctttaagcagaaaaaggcaaatttgcaaaacacaattgattctctagacatcgcagtagaggtacgactcctttcggatcaagaaagaattcttcttgatcaatcgagggattctttggcaagtctactccgtgaggaggagattaaatggtaccaacgctcgaaagtctcggacgtactcttaggagataacaacacaaaatagtttaacttgatagccaacggtaaacataggaagaagaggatctttttcctagaccaggatgaagggaaaattgagggggttgaggccttgaaaacttatattacgagtttttataggaaactttttggaccaccagaggagaactcgttttcgcttgatgagtccataattggtgatatggctcaagtttcacaagctgaaaatgattttcttactgctcctttttcggaagaagaagtgaaagaagccatctttgcgatggagcataataaagctcctggactagatggtttcccagctgaattttaccaaaaattttgggatgttattaagcatgacctgatgaacctttttaatgaattccatactggtagcctcccaattttcggactaaattttggggtacttactctagttccaaaagttaaagaagcaaatcaaatccaacaatacagacccatatgcttgttaaatgtcagctataaaatattcactaaggtggctacaaaccgaattagctcggttgctaaccatttagtgaacccgacccaaacagttttcatgcgtggacgaaacattttagatggagttgtcatcatacatgaaacagttcatgaactacataggaagaagttgagtggggtgatattcaaaattgacttcgaaaagacgtatgacaaggttaaatggccttttctgctacaaactctgcgtatgaaaggtttttcgcccaagtggatatctggattgagtctttcatttccgggggaagcgtggcaatcaaagtcaatgatgacgtcgggcctttttttcagataaaaagggccttcggcaaggagaccctctctccccaatcctattcaactttatcgctgatatgctagccacattgataaacagagccaaaacacaagggcaaattgatggagtcataccacatttgattgatgggggactctccattctacaatatgctgatgacacagtgctgtttgtgaatcatgaccttgaaaaagctcagaacatgaagtcagtgcttctagctttcgagcagttgtcgggtcttaagatcaattttcataaaagtgaactgtattgttttggtgaagcacttgattatagtgatcaatacaaccagctctttggctgccaggtcggcaacttcccattccgttatctgggcattctgatccattataggaagttgagaaatgcggaatggaaagaagtggtcgagagatttgagaagaaattgagtagctggaaaggaaaacttctttcgttgggaggacgacttactttgattaactcggtacttagtagtctcccaatgtatatgatgtcattcctttgcaattcctagtggggtacttaaaaaacttgattaccttcgatctaggttttattggcaaggggatggacataagaagaaataccgcttgctaagtgggacattatttgtcgtcccaaagaacaatggggggctaggaattcatgacctcgagataaagaataaagtgttgattagtaagtggttattcaaactattttaccaccgatggaatatggcaacaactgctactcaataaatatttgggatcacaacctttatctcaagcctattggaaagcgggggattcacatttttgggctagtcttatgaaggtcaaacatgattttttccgttttggatccttcaaaattagggacggctcccaagttaggttcttggaagacaaatggttggggaatgcctcggtaagagaacagtatccttgtctctataacatagttaggcataaacagtcgactatcgtacagattttccaaaccaatcctccgtgcttttcatggcgacgggatttaattggtgcaaaactagctgcttggcataacctattgcctcgcatagctgatttggttctagtacaggagcaagatgagtttcactggaacctcaccccgaatggggtcttctcggtcaaatctcattatctagctctaacacataccggggttccgaatatcaatagacagatttggaaggtgaaagtacccctaaaaagttaaaatctttctttggtatttacgtcggggcgtaattctcaccaaggacaaccttgctaagagaaattggaaaggcagcaatacatgttgtttctgtcacaaggatgaaactatccaacatttattctttcagtgccgcttatctcgcttggtgtggtctgtaattcatttggcttctaatctaaaacctcctcacaatgttggtcatatgtttgggagttggctatcatgtgtccccaaagaaatgaggaatctgcttttgatgggtgcaacagctctgtgttggtccatttggctaagcaggaatggagtaatttttgataagaagatggtgtcttctcctttttgcaggttatcaccttagttacccggtggctacgtacctgggctatcctccaccaaccgggattgcgggatactattatggtggtatctcgacgtttggaccaggtggcacaggagttttttacccaggagcatgggtggcgatctagtctacggattgatagccactaagatatacggtggtatctcgacagttggaccaggtggcacaggagttttttacccaggagcatgggtggcggtctagcctaaggattgatagccactaagatatatgtttctgttaaacttttatgcttgggagatgttctagttatttttatcttcttttttggctgtgtgcattttatgcagaggccgggggtgactcagtttgattgtatcatcttgatataattatctgagtctaaataaaactttcattatctaaaaaaaattgaccatagatgatcacttcttttgatgggaagcgatggtggtgcaacgcaacaacgtcaaggaaggcataaaaagctcatcatgcttgccaccgacctcgcaagtgatttggcggtctcagatagttatacgatgaatagattatatatagtcacatcattaatttgaattataaagggttctcgcgaaaaaaaaagaattataagggggaatttgatgttcatcctaatatctgtaaacatgtggtctatcactggataagcggttaattggaattaagacgggcataactcgaattctgccgtaaaatcaaggctgaggtggtgtttgaatacatggacttaattttagtctctatatttagacactaatttagagtattaaatatagactacttacaaaacaaattatataaatgaaagctaatttgcgagacaaattttttaagcctaattaattcataattagagaatatttactctaacatcatataggctaatcatgaattaattaggctcaatagattcgtctcacgaattagtccaagattatggatggttttattaatagtctacgtttaatatttataattagtgtccaaacatccgatgtgatattttataattagtctacgtttaagttttagtcccatctaaatagggtctgaaaacattgttatgccacttgtttgaataagagaatcttatcattacagctactctagattaaaagaaaaatggtccatcaattgctaaaacacatactacctccgtccaaaaataaatgcagccatgagaatccgtgtccaacgtttgaccgtccgtcttatttgaaaaatttatgagaaaattaaaataaattagtcacatataaagtactattcaagttttatcatctaataacaataaaaatattaatcataaaaaaattacaaataagatgaacggttaaacgtgacacataaacagtgtaaaactatacttattttgagacggaggaagtattacactgcctttgcttagctcaatgctctttacagaagaatggaaatctcaactatacatcagcatgcatgcaggcatgcacacgcgaaacaaaaagcccacaaaatttatttaaagaaaatggatgttggggcgggtattggcgggaacgacggcgggaaggagatggcggcaaagcgggcaggagcggcttcgcttcaaccactcggcgaggcacttgtcgtggaaccgatgcctgtgcgcgcacgggatcgtgctcagctcgtcgcccacctcgaactccgcgatgcagatcacgcaccccgtcgaatccgcgccgcccatcgccgtctcgccgccgccgcgcggttcctcgtacttgctcttcccgaggcagctggtatccgccggcgccaccctggcggcggccacggcgacatggcgccgggcgccgcctgtcaagaagacgacgccgaagtcgccatcgtcgatcggcggcggcatcggcggcggcgcgcgggtggacgcgaggcgctgcagccgggaagagaagatgttgaggtggtgggtgggcgggcgcgggaggcgcgggccgggcggggtgaagcggtcggcgtcggcgccgccggtgagctcgaactcatcgtcccagagcgacgacgacatggcggcgtcctcgtccgccgcctcgaggaggcggccggagatctcgttcgccggcggcgcgagcatccggagctcgcggtaacgccggtaaggatcgtcgtcgcgcacgtagtggctgttgtaaccatcgagtgggatatactccatctccatctccatctccggcgtcgtggcgagctgctcctccgccgcggccatcatcatatcgtgagatcagcggcgacggggaattgaaggaaacttcagatgatcgagttcgttgcgtgggtttggtgtttcaatatatcgaggcgatcaagtagttttactccgtatcggactcggactcaactctgaaattccgacacggaaacggacaggaaaacgcgcggggacgatcgactagccgctcggaggagtccgatggtttacagtcatcgcacttctctctgatcccgcaacgcgatgcgatccgtcgctggaccctgtgttgggcttgccatgacgaataatttaaggcccaattagtaccgcagttgttttggcccatataatatataacccagatagaataggagaaactattggccttgtttagttccaaacttttccttcgaactttcaatttttttcatcacatcaaaacttttctacgcacataaacttccaacttttccgtcacatcgttccaatttcaaccaaactttcaattttgacgtgaactaaacacacccattataaactctcgagagaaagtcactttgttgtttgcgtcactggaaaaacatttaaaaaaatcaacaagatagtttaatatgtgctagatcactccataaacatggaagataaaattaacttctatatgttgcgtcatgtcttgtaaaagttgaattttaacttgtatatttgtgaagtgatatattacatgttaatatatcttcttaattttttccataattatttaagtgacatgcaaataactaggggacatcctttgtagagtttaaaatcaaccctcacataataggccatacacatacacgcatgctcggtgatgtcccctgaccatccatcgttaaagtaaatcaggtacactaaaccccccttttctcctcaactttaggagttggagagaatagtatcacgtgcacatgtaggggttactaaagagataaaccttataaatttaattgtgaaccgagagtaaataaaagagtaaaacttatttttggacataaggagtaggcattctgtttttagagtactaatactccacccatttcaaaatataagattttaaggattcaaaatttataccacaatataagcactttttcatacagtatctcatttcaaccaatttctctatttaactctttacctcaaccaattacaattatttttcaccataaacttggtttcttttaaaactttcattaatgattatattttggaacatgtgaagtgtttttttttctcaaatgcgcaaaatgattgcacgtgaatatattagaagaaaatagttatagttacacaacgcaatcaaccagaccgaagcaaaaataaaaacttgaagcttaggaaacaaactacgacggctaaaacacaaactccaagcagcaggaagggcccgagccacgctacactcccaacaagtctctaaaagcgacaatgccagctaaagaccacagatgatcctccgagtggatggactccagaaccctgagactgaagaaagcgtggagtcgaaaaccctagagtttcatttcttccacaactgccaaaagatcaggagcaccagggagtcgaaactggcgcggagatgctcaggtaatatcaggccctggaggacggccaccagagattgtgttactctagaccttctactccctccatcccataatactcccttcgtttcaaaatgttatgacaccgttgactttttagtatgtgtttgaccattcgtcttattcaaaaaatttaagtaattatttattcttttcatatcatttgatttattgttaaatatactttcatatacacatatagttttatatatttcataattttttttaataagacgaacggtcaaacatgtgataaaaagtcaatggtgtcaaatattttgaaatggagggagtataagggattttggagggatgtgacatattctagtatgatgaatccctctaaaatcccttatattatgggacggagggagtatattaatataactctcttcagttacatgcgtctccactatggattgtgctatcgatgtctggaaaatatagttggctattgaaaaacgctattattgggccaagctcgatggcgctgctggctctccaccactaggccgtttagcagatattaaagttgaggagaaaatacttcagtatcctcattaaataagtaatggtaatggttgagggtaagatgcaaagaaaattaaaaggaatatgattgatgggataagtaacatttcaaatcctttacagttatgaacaaataaaataacatcttatatttatatttatggacaaatatatttgtgcactcagggagtataactgttgcctctcttgtctgaaacgcatagtactaacctgccacttgatggatttgattgtttcaggtgaagtatttaccactgtgattaacacggtttaattcgtatggtcgtcgtcgaagtcaatgaaatcaaagaggaggaggtaggcctgcattatctgaactgaaatcgacctagctagcgtaacaccctgcattatctgaactgacagtggaccggccagcagagtgaagacaagcataccagccaaaatgtgcagaagccatcgaccagcttggatcgcaccaattaacacacattagtccctccattcataaataattattggtttcgacctgtaacagaatagctttaacttaatacatattctgaatctctgatgaattgatagacagattatgtttgcatgcagctactagcttagcaagtgcaggcgaaaagtgtgcggcccctcactccaattgcgaagtggccgacctccctctgttgctgacttgctgttgcacgcccacacacacccatctgccggaaaagaagcaactaaagcgtacatcgcctacatgcgtgcgtgctacactgctactactagcctcctcttcgatgatgaaggctacttcgaacaaatgattcttggaggattttcctatgtgatgatcacttggatcaaagaaataactatccaaaaatcctactccctccgaaaaaaaatccaatcctaactacatgtccaatcctaccccttccgacaaaaaaaaaagttcaattcttactataaacttggacacgtgtgtgtctatattcgtagttagagtttgtctttttttagttagagtactatgagattcctttgaattatatcccaaaatatagatattttagaggaattctgacatgtgctttaacctattggaaataaattctttgtatcttcctccaacttctgttttcgccggttggcggaagccagccgaagtttattaagatttgggaaaatctttctccaacttctgattccatcgttttttttcctatgccctatttaaatggtcattcatattattgttattcatttttttcaatccataaaatttgagatgttatagtattttagttatatatgtatttccttttgttcatgtgttttaaaaatcatgcatttcgaaaaagccatgaatcatgtaatcaactagtgagggaacctgacacctagctaccagcaaccaacatgcttttaaccaattaaaaccccactcgcgcgcactacaccacactacggctactatatatactcatatcttcagacaacagcacaacagcagcaacatatgcatgcccaactaagattctatcatatgtatgtcgtcactgactactcacactagtgatttatcactagttcactagtcatcagattcagatatatataatggagctgatcactattggccactcagcttaacccaaacatacactagtgcacgggcgtgcagttcactttctactatatcaaattaagctcagtccctgtttagcgagctaaagatcctaaaaaatagatggtgagtagcccaccggtgagaaccaagaagaactgtgttttgtagcatctaacttttagtttattttctagattctagagctatatgatactaaaagaagttccgatgtttttccaaacaagacatcgtgcatggtcagcaatcaaagttcagtattgagttgtatgcaacaattagttcaacaaaaacttaaagtgataagaaaagatagtcaattttatatttcgacgattagatcagattatgatcagacagtacgtgtgtatgtgtaacctacgaccttagctcacacatacctagatactcagatactaatgagctttgtgatcacctcggtctgaatttttgactgctggttcgaggctccaactcgacgacatctttcgcatctaccacagcatctttgtgaaaaagctaaccacaaattgctcgatcgatacatagtacaataatttgcaatgtcatggggatagatagatagagataggtagctatgttagcagtgtgactgaatcattgcatgccaacgcatgtggggagaatcttcgtgtgttccccttttgctggtcagatgagatttatcaaagcctctgtatagcagctagctgcatccacggtgttgacttctgatgaccatgatgtggaatctggaacaaagacttgatacaaaattgcccatgacttgggcactgtagacagactgacagagagtgactgatcaatcgatcttagtaggatcctggactggtagttttttttaaaaaaaaaaaggattaagtttctcttgggagaactattagtgtcgagaaaatgttgaggtttcgttatattttattcgcattttagtatttacaagtgtcatgcccgtacgttgcaatggcactggaattatagggttttgttctttttctatccattccttttaaatttttgtgtgaaaatattgatctttgggtggggtgtttttttgggaaactgttttttttacgtgcgggattacgatgttgaggaggacgatgaatccgcttttaaggtggtagagataaaccctgattgataacatcttttgtttgctttatattgtacgttgaaattgatgttaatttatttgtcagaatttttttgctccggtaaagttccagccatttgtaaaaacattgttgaaagaagaactgtccaagtttgtatagctcggcttaacgttggtcggtcattaaaaaacgaagaaattaagtactacacttttttacagacaggaagacagacatgcgccattaaacaaaacacaagtgttccttgataagtatattattcatgctatgtactatttaccactactacatactaaggacatgagacaaaggtaatatatatatgcattatattgctaccacagcttaatttcatcatgccatgacaaaccaaaataccattagtacgcgtactgatcacactccctcgtcagaaataacccacaagcactcaccggactaagtaaaagccaacgaacacttgaaggaaaacgatgccatgtactgctactagctagtagtatcacagattgtacagaaacggacagtgattggcactgcagaacagtagcgatcgatgcagtgaaaacagcatgcagaggtagatggatagatagatatgcatatagagttggttaatttatctcgatctcgatcttccttgtattagctttggatttcagcgtgtagttggatggatggatcgatcgatcaaggcttgttcttgtgctgcgtgtagatgtagtcgaggtgggcgtcgctgagcagcctcctctgcacgcactcgtcgttgttcttcccctcctcgcatgctgctgcttcctcctcagctgctcccatcaactgaccaagaacaagatagaaataaattaacaatcaagattagttaccactaattgcttcttcatcaattcttgtctaatcagctaggtactcgaagatttatagctctgtatatttccatcgattctcacctcggagacctcgtcgccattgccggtgtcaccttccagctggagcacaagctgatcagctgcaactgctgctactgccttgacaccgccattctctgaaaagaaaagctccaaaacgtcagctaatttgcatacactatcaattgaacaatcaataatccaagtgctgtagctagctaccttggtgttcatcacgaggaacggcgcgagcagctgcggcgaagtggaaggagaagaagcagagggcgaagaggagaagcagcgcaagagcagcagcagcagaagaggaggagacgccgcgagtagtgctcatatctatcgtcttcttcttctagcttgggttaaactatggtgcgttgtcgaagggcgagaggaggatgatgatgaggaggaggaggaggaggagaagagattttgcttcttgcaattgctgctttgggtttgggtggcggcgagtagtagaagtagtggaggctatttataatcgggcgaagtggcttgctttcgttgcaacttgccgttgtttgatacacacagtgaactgaaaaacacatgttacatgtacagtacacaggaagtggccagacagggcaggattattgttaattttataaggatcggccgcatgcatacaaaacacgggtagatttaagattagttaatgtatatatatatatatatatatatatatatatatatatatatatgtaaaaattatcaatcctttagggccccttttaatcgcagaattgagaaaacgtagaaataggaaaaacgtaggattttgataggaatgtaagtgtaaaacagcggattgcaaaacacaggaatgaccgtttgattgaaccacatgaaaaacacaggacttggatgagagagatagactcaaaggaaagttagcaagaggttgaagctcttgctaaatttcctccaaaatttttataggattgtccattccataggaatttcaaaggattgaatatgattcaatcctttatttcaaatggcttcataggaaatttttctataggattaaaattctctaaaattcctatgtttttcctccaaatcaaaggggcccttaatttctccaatcaccaaaatatgggggcaaagaaacctagggataagaaattcacaagctagaaattccattagaattccagtcctttctcgcggcaacaaacaacgctgtcgtttgccttttggcttatcagctgcatgcggtcaaaatttaaattttgaaacttatttttagagttgattttgagggtatttaatcatactctattttccaatatatattaacttttaaatcgattagaatattaacttttcttcttttttttaatcctcaaaaaaaagaaaagttttacctataaattatttttaagctgctaataaaacttttttttccaaaacaaacagaggctcaaaggtgccaaacaaactacacctagttcatgctacggtaactgccactaccgtgttggtcaaaacgcaaagtttttgcggttggcctgagttaggtctagtctaaaaaccaactaaacatggctatttaattagtgataattttctactagcagaatttcaactcttgaaacaatcgtaaatttggtttgtgggtcatctgaactactgtgtgtgtgaaaagaaaagcatattggacattggtgataaagggatgctgtatgaaatggatatatatgtcggagacaaggcaaagggaacgcaatagttgattgttgcataatattactacttgtgttttcgtctaatccagaaaaatagaactcttgtgagagataatgcgctgacactagccccattttcacgggtacaacatttgcgccaagtcgccaacacaacgagctgaatatattgattggtattttgcaacaagaaatagcatgaggaaatagaaaaaaatggatcctttgtcagcctattaaccgaacttagagcttattcactttgtcaacatttttaaattttggtattatcaatattttgtaaggtagcaaattaaacataccattaccaacacaatcctttcaaattttggtaattccggaactttccactcacaaaatttcaactaaaatttaccttactttatcaaaattcggtaatgccaaattttggtattaccaaatattggtaatgtttttcttacaataaagtaattaagcccttaattgcttacgttattaatcattttctggctgctcattgcacactggaaaatctgctggcaatatgaacccagccaatccatgtaaattgtagtatcaattttacttttattttagggcccctttgaaatgaagaatagtacacaacaataggaaaaacataagaattgaagtgacatatttccataatcctacaggaatagaaaaccgagtaaatatgaagaggatccctttaatatcaccataggaaacaatgaatcaaaagaaaatttctaagatgttagacctcttgtttatttttctatgaaattgcgcaatagaaatacaatcctattctttcttataaattaaagagttccatagaaaaaattccttaggaaactgaatgcttcaaaaatcctatagcaatcatccgattcaaaggggcccttaatgtgcttgtatatgttgacgctttggatttgagcaaatgaagttggtggaattcagagacgagagcagagaatactataacttgtttgttttgttcttcagcggagattggattgatcattagaccctcctcctaggggtgcgagcgggcttatccgcgaatcaacggatttgacttgcaggttacctattaatttgatctataaataagtttataaattgacccatttgtatatctagatctgataagttaggccacgacgcgaaaattcatgggttatcatctatttaacctttaagtgaactcgcaggtcgttctccttgcatctaatattggatttgtttgttttgttcttcggcggaggagagattgaattgatcatcagaccctcccccgacgcaacttccaacatttccttgtcccaaaaactgtttgtgtttcgtttttcaacacagttgcacagaactgatgatgagcagcaggtagcagattcatgagatcatcagagctgctgcatctgcatctgtggagtggacgtggcagccagctcggcagcttgagcttgcagagctagggcaggaacggggcccacacagtaacagctggcgaagtgggacccacgcccaagctagcagcagcacgtttgatggaaggaaggaagccgccaagtctacacacccacccatctctctgatctgcaataatctgccaatccgtattggccagccaatggccattgccaaatgtcaagtactcgctccatctcaaattataaaagattttcaatggatatgacacttaattactataagtacaatgaatttgtacagaaattgtctcatctatttaaaatccttcatactataagggagggagtagtatttgttttataactgagggaatagtagacacacacagacagtagcagcggctacgcatgctctgttcatttgcagctgctgcttctgcatgcatacgcattcagagctctgcttggctgcatcattggcgccatggccactatctacagtggagtggtggaggtagtggcatgtgtgcagcgtgcgtgaagactgaagacttcgggctggtttggtttgaggcttaaattaggcttaccaatatttgacaatttcaatagtgtttagtgtctatttggtttgaagccaaattttagtatgtctaagaaaataggccattttaatagtgaacttaggctgttttggcttcaatccaaacacaactttgccataccaaaattagtcatgccaaaacttatcaaaatttgggcattgacaaaatttggtaaggtctatttaggccacaaaccaaaccaacccttcatccggccggcacgcgcgccgtgacgagggagatggcgacgggagaagaggataaatccacgaggaaaatcaaaccggagcatgtgagtaagatactccctgttcacaattccgacgaaaaccggtcgaattccgtaaaatttcgatgtttcgacatggctcggaattaagtttcgattgagatttcgaaggttaaacagtatattcagttgaaatttattgaaaaccgtgatactgatgaggctcaaaatttagtggtcaaccgataatgtaaacctgctcctttcgttcaacttttacaagttgtaaaaataaaacaaatgaaactatagctagttaacgtatatttatagttaaatttatcttttatataacacgtaaaagtgaaatttaactttgcatgtttgtgaaaatgatatatctaatgttaatacattttctcaattatttttaacttttttataaccatttgagcaatcatctcatccatcggcagcgtgggctcgtgaagtcgatcctgatccatcatggcgccaccctttcctcttcttccttctcacagttccatatatatgaacttgtcctgttcatatatactccctccgtttctaaatatttgacatcgttgactttttagcacatatttgaccgttcgtcttattcaaaagattttataaaatatgtaaaattatttgtatacatataagtatatttaacaataaattaaataatagaaaaagaattaataattacttaaacgttttgaataagacgaacggttaaatatgtgtttaaaaagtcaacggtgtcaaatatttagtaacggagggagcacgaatacgagtcaacggcggctgctgtagctgttgcatgctgcccctgcactgtcgaatgtagtagccttgctagcgactgttcccatcacatagctagctagtagtagctcaatagctcatggcctgcatcatatcactgcatgcatgggcatggttcctactacactgttcttccatctacagtgtagtaggagcacagcacactgacgacgacgacggcggcgcatccgcgcatgcatgggtttgcatcagtctagtcgatgatcgttcgttcgtgcggtgacagagacgtaggggcacaggcgccgatcgagagatgagaggtgcgcgtatcatcaatggattaagttaggtctgattagatatacttcctctgcctttaaaaaaaaaaagacaaccccaatgaatctagacaatcctatgtctgtaaaaataaaaaaagacaaccccaataaatctagacaactcttggtacagattcattgttcccctcctaggttgcttctcttggggacagtcttaaaatattttaagtacaaccgtaagtttctgtgcctaactttaatcgttcgtcttatttgaaatttttttataattagtatttttattgctattagataataaaacatgaatagtaatttatgcatgacttatgtttttaaatttttttaaaaaatcttttagataagacatcaaatttggacacgaaaaatcatggttacacttaaaatgggatggagggagaaaaaaatttatctcgctttttgtttgcatgttttttaaactgctattaggtgtatttcctgcaaaaaaaattatttatatatattaaagttgctagtattagacaaatcaagttttcaacttttaaataattgaaaattatttttgcagggaaaatttaattaattatgtgtgccaattattcttttttctcattttataactggattcgaacgggcctcagtacgtcatggatggcgtatatatatcatatctcgacgaaaattctgcaagtgtgcatgcagttggatattatacgcgcgcgtgtgtgtatagcgatctctgggattaattgggcacacgttagcgacgtcacgtacgttggcatgcatgcatctgtgcttacgcggcagtcaagcatggatacccacgccgtttttccgtatccaacagggcgcgcatgcatgcatgctggttaggagtaattgaaatgctgatgtaattaattgaaatgaaatggatggagttgaattgagtacgtacatgcaagcatgggactaagatcctctaacttaccttcctctaacttgtgtcactgacatgtagaccctctatccagcgaactctactccctccgtcctataatataagagaaacttgtgtcactaacgtgtggaccctctatccagtgaaccatactccctccgtcccataatataagggattttgagtttttgcttggaacgtttgaccactcgtcttattcaaaagtttttgaaattattaattattttacttgtgacttactttattatctacagtactttaagcacaacttttcattttttatattcgcaaaaaaaatttaaataagatgagtggtcaaacgttgcaagcaaaaacttaaaatcccttatattgtaggacggagggagtacatatcagtgacttaaagtcagagggaagtaagttagagaatcctcttccgcaagcatagtgccgtgaccagcttgatcgactgaggccgtgtttaattcacccccaactaccccaaactttcaactttccatcacatcatatcacatctaaaacttttctacacacataaacttttaactttttttccaaactttcaacttttcccaaacttccaacttttttcaggaactaaacacacaccttgaattaacaacagaaatttgcatcacttggtgtcattcacgcttacgtcatgcaccccagctcgatccatgaaatttatataggtgaaattaatcaacaaacttaactacgtactgatttataatatactccctccatactcataaaaaaaagtagtttaggacaatgtttaagtcaaactttgagaatataaatcatgaataactcttaagttattgagtttgaaaatataaaaattatatgaatagatttgtcttgaaaaatacttcataaaagtatacatatatcactttttaataaatatttttatagaaaaaagaagtcaaattatgttttggataccgtgtcgctgtcctaaatgacttcctttacgagtacggagtatatggatcgtgagatgtcacttgaatgtaaaccggcctgcgaggaatatttaggctatgttcgttctggcgagataggggagattgagtctcgtttttcgcgcgcacgtttttcaaactactaaacgatgtattttttgcaaaaaaattctataggaaagttgctttaaaaaatcatattaatccatttttgaaatttaaaatagttaatactcaattaatcatgagctatcttcccaatcactctaatctcctactcctcaaacacacccttagttaatggatgaggatgtaatgtatacataccatcttgtgctcattgtaagtgctgagcttgccctatcattttcagctggctagtctggaatgcactatgtatatatatttctcatcacattccaattacgcacaacttcgatcgaccagaaagttcacagttcaacttcaaagatacggtgtcatattttgttttcttgatttttgtcactaatactcctatgacactgctacctctcccttattttttaagtaggtaataaattttttttttatcataattctcttatgtagtatgtattataaaaaaactacacctactaccttcgtcccaaaatatagccacttttaactatgaatcagacacacactaaaaatgcttatattttaggacggagggagtattaacttttcaaatttacagtataagatttataattagtactgcaaaacattagttgtatttattaatacaaatatgatgttatatatatagtccgaaaagtaaatatcaatcgatcatatggttggttacgatctcggtgagcatgacgtacgaatgagatctaaaagggtttatgatattttttttagacctacctcacacgatcacgcgcaacctttttgacatatgcagtagcagagcagtacacacatcaccacttaataaaccatccttacagagttactccctctgtcccattctatgtccaaccttagcttcctaagatagatacaaggaaatagcaaatgaccaaaatgcccctaattaatgagtgggtaggtgtggagtattgaagagataaaacttgttgatttacggaatgatggtaggtaacaaggtagaagttaatttattttggaataaattttaaatcctaaaagttggtttattttgtgacgaagagagttcagtttaattccattttgcaggttggtggaattgttgatgcatgcatagatcactcgaccgatttgtttttaaattacattagctttggtcaccaagtaatgctgtatttgtcagaccaatactttcagagtctagattcttcctttaattagaagtctcctaggtacagcgtacacatactatcctatcttcatactcctatatacgtatttgatttggcttaatctgctcaagaacaatattgatcgatgagtcgatcggcatccacacgcattccacgtgttaattactttatttttttaggtaatggtttatattaaaccaacccctacattcaaagtggatgtacacagcaagtgctaattattactaagccatgaaaactagtactgtgatgcaacttaattaccatgtgcatgcatcttctctttacagatgctatatattgctgacagcttaattagctagtgcatgccaacagtatttgcaaattaaggacagattaatcacagtatcacattgcaatctagctaccgctaatcaacggggtgagtttgatgcgttcacaaactaaaagtagcaagaactcgtgcgtgcgtgcattgcctgggacccctccaatctaattttctagtacaattatggtgaccaagctgatcaccttttctgtagaacaatcatatatggtgatcaagctgatggtgatcgatcgagttagtgacaataaaactgcagatattattaaccacatatatgtagtatatagtactccctccgtactcgtaaaagaagtcgtttaggacaatgtttaagtcaaactttagaaatataaatcatgaataactcttaagttgttgagtttgaaaatgtaaaaattatatgaatagatttgtcttaaaaaatattttcataaaaatatacatatatcactttttaataaatatagaaataagaagttaaagttgtgttttggagactgagtcgctgtcctaaacgacttcttttattagtacggagggagtatatacatgtatataaaaggttatgggcaaaagctaaatttagcatgccgagagagggacgttaacgtttatcctcgtgcatggccatatgtacgcccataaaccatactgcaattggatgagataaaagatttagctagttaattattagcttctccctttctttgaggatatcagagctttcatagatcttgtgttgaaaccatagcacactatagctagctagctagcagaatgcttaattaatacgcaaatgtatcagaaatctgtactctttgataaagaaattttacggtaattgagaaattacgttgaggtatctaaattttttcactaaaatttttgatatctcgaggtacttagtatctggaggtaccaaattttacactattacttaagtacctcaaggtaccaataaatttagtgtaaaatttagatacctcgaggtattttttcaaggaccataaaatttcttctacaaaatatgatacgtcctaataatttcttaagatgataaaattaccatttgataaggccggacttgcgggtgatcatacactctccctccatcttagttggttagcttggaacgaatggagtatcatttatttgtaaatatatataggcctctgttaattattttgtaataaatgtatacattatttgtgtacataggttattgattgatatcatattctcatgtagtcgtgtacacaatttttaggattgattatattatagttttacaatttcaacttaagattagactattaagttcatttacctggcattcgacgtaaccacaggcacaattccataattaatctgacaaactgataggctactcttttcataagccgtattttataagcaggtattcctctgccctatgtccttgcatacagtattttttaacacgacattctccacgcctcataataaaaaggcgaacttggccgatctccaaatcgaaggaaaaggagcgggcacaaagtttttcatgaaaaaataggactctcgcacaccaatcaatcaacacaaacaacaaaacaaatggagcatgaaagcatgattacactgcatgcttaattagtataatcagtgacgctgacaggcttggatggccatggaggcaagcttgcaagagatgcgatgcatcatcgcccctctttaagtgtcaacttgcaaatttaatacttgtgctaacccaattaatcaatgtatctgtttttggcctgaactacctttgcacagggattacgataagctcgatcgagcttgctgccaaaaggagggtacttgactagtttaatgcatgcttaatcatgtgctcttaactattttagttacctgtggagaagatctgagttgtgcagagagacagatatggtagtcatgacaaagaagggctctgctgaattgcctcgtccatccatcagagatgtttctccaagacaggcttctgcatcaagtgtccatgtttattcgtctccgaagatggagatgagaaggaatatctttgcttggatcattgtctgcaaaacgcaatcgaatttcatgccactgagatttaacatcagagga

SEQ ID NO: 54181 - DNA, 19549 bp, Oryza sativa
ttgataaaacctaattggtagttcagttgctaaacttatttgttagttctttgaatttctgaagtcactgaaattgcacaagctattttgagcttctagaaatttttgaagtgaagcaaaattacttacctcattctagatcctattactgaacgacatgcaatacaaaaaatgatgggaagaaacattcttatgctaagacaggcacatgttttgcacaacacaatactcgatttcaacagtccctcttcaattcatataatctgattgatttctttggcccttcagttctgagtttgcaaaatatagtgatttttagcaaagctaactgtttatttcatttaacagatggaattgtgcatcatgctgcttgagtgctgcagccaagagagaacatacctgcgatattatggattgctagggcagcgattttgcatgattaacaaagtttaccaagataactttgagaaatgtttcgtgcaacaatattccatgatacatcgtctggaaacaaacaaactgagaaatgttgctaaattttttgcgcatttgttgggcaccgacgcgcttccttggcatgttttagcttacatccgtttgacagaggaggacaccacgtcatcttctagaattttcataaaaatactcttccaggtatgctgttaaaattatgccttttctttactacatatgtcgattcatctttaccaaagcaagcaattgaaggttttgtttcttgttatgcaggaattatcagagcatcttggtattcgtctactcaatgaaagactaaatgatcctaacatgcaagattctttcgattcgatcttcccaaaggatcatccgaagaataccaggttttccataaatttcttcacttccattggactgggtggtatcacagagactctgagagagtatttgaagaacatgccacggctaataatgcaaaaacagaagcctgcctcgtctgaatcagactcaagtgattcagggtctggttcagacagctacagctcagaatcggaatcaagttctgatgagagtgacaggaagcgaaacaagaggcggaagaagtaagaggtggaagaagattttcatgtaaattctaccatggttctgggattctcctgtatttttatctacgtgcagtatctgatctagctgttggtgcttactaaattgagaacccaatcatattaaccgagatattggttcctacttcctaccttcagatcatgtgagagaccgaagtatgttgttaatagtgcaacttcactatgttaattcatccttaacaaaatcagacaattgaagtattttttttcgtgctatgcaggagttatcagagcatattggtattggtccaactctaagagattggatgagcctaacatgcaagattacttcttttctatcttcccaagggatcatccaaagaacacaagtttttctacaaatttcttcaccttccacattctggccttggttgatcactatgaccatgagcgagattaccctgaagagcattcctcgccatctaatgcaacagaaacctgcctgatgtattggtatccatgtgttctgatcctaactgttttgtttttgttggatctccatgtgcaatataatcagatcttagatgctgttcagagggcttgttgaattcaggacccaatcataattagaatccccaaatagggttttataagatatcagcagagtaccagctggtaggaacgtattcatgtgcaataattaatggtgaatcctttgctcagttgaactttttcatccaaattcaaagtggttcatttgggactggagattggaaggggagaaaagcggccgggcgaaagcgatttatgcaagttgaaagtattccttgtcaaattggggggaaaactgcaatatttcctgaattgcaagttgaatatattggtttgaaatggtccccacaaattgaatgaaaaaggtcaattgaaggttgaggatgagacgtggaaattaattacttcctccgttttatattataagactctcttgtattgtccatattcatatatatatatgttaatgaatctagacacagatgtgtacctagattcattaacatctatatgaatacgggcaatgctagaaagtcttataatctaaaacggagggagtaagctggaaggggcagcagtggtgaagatggctgatggaaggtgatgggggcaattacatagtctgcatcatagacatcacacacccatgtttcttacattttgtaacgtcatccatgttgctgtgaacaaatatatacactacagaaaaacctaaatatcctagaaaacattaaaaaggaccaaatgtataatctttaaatggaaaaagggcaaagatacataacaacaagttgaaaatcttgtcgcccaatcacttttgtgtgaaggcaataataatataatgttgctttacagcaaaagcaatgtgcttttgtgtttattagctgcaggtggtttttatcattgaccaaacgctacaaacaaaagcataataaccataggttgaatatataatcaatcctggccaaaacaatcggattaatctgccttttgggcggtcggcacttgctaaacaatggaaatcatcaacaaaagcactcaaacaggacagtgacatgctctaattatatttgaagctggacctcacgaatcatgctgctcttggccaataaaaccaacagattaattaggaagataaacagggagcagttactggattaggagacactttgttgaggtgcaggtgcagaagaggaggagacaaggtgaacatggaggagaaggtaggaggagatgtgagggttctgaagccactgatgcacctgctgcttggactggtcatgtactgggtcgccgaggagatgacggtgcctgtgctcgtcgacgtcaccacccgagcactctgccccggcgccgacatcgcctgcccggaggccatctacctcaccggcctccatcaaacggtcagctctcatttgatcatctccctcttatgcagtggtgtccctcctttcctgtaagacattattgttgttcagtgatatacatcgtagctatgcagaggtcgggagtattatcggaacaattgtaccaccttggtgtaattaactgagttcgctaaagttttcattatctgaaaaatgaaatcacatgatgatgcctaaattcagtttctttcttttgctagtttcagaagaaactttgactcgatgcattagggattatattactactggttgccaatgcttatgctatatgattgatgcataacattttcattgatgaaaatggagttgaccattttcttgattttatctgaaagaatcagtctgcaagtgacaactgaaagtgaacaattgattggaaactcttgtgttaatgcaggtgggagggattttcagggctgtaggatacactttgatggggcagctagctgatgaatatggccggaagcctctcctcctactcactgcctcaacttccatcatcccttatggtagctatacctgttctatcttattttggaagcttatatcagttaagtgttagtctctctgcttgcaggaatttgacattagaatgtcaaggttttcatgagtttcacaggatattaatcatatgtctttaattggtgtcatattgtttattcctgcaggtgttcttgcctgcaacaaatccaagattgctgtgtatatcttccttattctgcgtactttgtcattcatgataggccaaggaaccataaccagcctcgcagtgacatacacggtgagagcaatcacagatgctaactcttggtttcactttatccaagtcgtataattctctccttgagcctggaaacttaaaccaaattggacaaacggcaaattgacagcgtttcttgttattgcatagctatgcacaatgcggtttgagaacaagtagtcatgcacgttgcatgctggacagttaaaattcccttttctgctaatttaattaggccgatgtggttgatccatcaaagagagcatttgcatttggctgcataactgggatactatctgcttcgcatgctctgggcaatggcttctctaggtttctgcccgagcggtggattttccaggtattatatcatgaagatttcttacagttcatcaacaatgttatttttcaatttttatgctaattaatgtcattcttacaagtatgaaaccacgcattatcaggtctcggttgctttgttgatctcttctgtcatctacatgaaaatatctctggttgagacacttcaaagagcttcttctggttcgtttgagcatatgtcgttctcatctttggttgtcaggttaccactgcggcgctgggagtctatcaaggagaatattaacataatcaggagaaggtaatgttcctcaccagactcctttatggtctaagtaatttaatggtgtaacgattcatgtcaaagcacaaagaaaattaataagtatcggattcacggataataattctggaaaagaaagcctgatgagacttctgtatttacacttgaccaacatttgaaaattgcaaatgcaaattttgttgatgtcaagagatacctactaatgcaaattttgatcttctctatcttcatgttttgttagtgaaacacttagcagaatcacatacatttccttcttctacgagttgggcatgatcggcattagtgatgtcctaatggtaaccatatgctcagatttattttacgacattgcgttcaaaagagtactggttatttcattcttcgcccctttatttgcagtactatctgaagtcagtatttggttttgacaagaaccagttctctgaaattcttatggtagtaggcattggttcaatcttttcgcaggtagtacttagtctataataacctttgcttgatgttatattcgaaaaaacaatcatcctttaagtgccttgcctgattaacaaaaaaaaattgtaaaattgtagattttggtactccctgttattatcaatacagttggtgagaagggagtcctatgcgttgggatacttgcatctgttgcctacgtgagtgtatcacatctctttttgctaatatttttgttatcacttttactgatatcagatgcagaactaaaacctttttttttcctctaggctgtcctgtatggtttggcatggagttactgggtatgtatttgggcgcatagttcagtaataaattttaagtccaaaaaatgctgcagtgactaatgtcgttactgaacatttttgtttgttttgtttgacactgattatgcaggttccttatcttacttcctcattgggtgtcatctatgttctggtcaaaccagctgtaagtgatcaccatgtctatatacctgtaacttttaagatctgtgatatatgagatatctgagtatattaactacaaaataaaacgccaaatgtacaatgtttgcatcattaaaatcaggaatcatgttttgtgttttgtgtgcatttaagtaacaattatacacttgaaaaatctttgaatacacttcaaaattgttgaacatgtgcagacttatgcaatcatctctggggaagtggactcatctgaccaggtaaactcaggaagggaaaaaaatatttcttgatttgtaaatccaatcttgatatcccttagctttatttactcagttactgatcaaagtttggcataaaattgactttacttttgcagggaaaggcacaaggattcatttcaactgtgaaatccacagctgtactgttggcaccattgttcatgagccccctgacctgtaaacaagcaatttttttttgtttcatcttacaaatgttgcattgccatgtcgccaactccatgtagtattctgaatgtttgatttctcccttttctgcaactctgtttcagcttacttcatttcagaacaagcccccttcaactgcaaaggtttcagtttcctcgttgccggtttcttcttggtcagtcctattaattcttccatgtgtgttcatgaatctaaatagtgcctataactgcatgacttgactgaatacttctgcaggcaatatctttgggcatttctttcatgcttaagccagaagccaaatgcacaagagttgcagttccagatcagcttgatcatgaagcagtgcaagcaccactattagctcaaccatgaacaaattggcaaggaactgaactttgtacctgtacataccattctacctggcaaacatctgaagtttgaagattgcattggttgtaacgccacaatcttgaaactcatgttgccaaagctgatattgggtttatagcaaagatattaattgtacatatagcggatgttaatgttatgtctagtactaattagttacgttttagattcaatagtagccaagtgaagtttgtgtaagaaggtaaagttgcaggtaactttatctccgacttaagttaggtgactttaatatcactggcatatgggtccacagcaatggcacggtattacaaaagtgtgcctgcactttatagttgcaactgactgaaccaaggctgttctcgtgaaattaatatatatagcacttgataatataagtacattttatgagacaatattgagtttttcagttgaagtgattatctgaacttgtcacttcatacaatactagaactctaaaaccgaaatatataaaaaaacgagatttggcgggagaaatgtccctccaaacatttttaaagaaagaattatgaaagtgccggggattgaacacgagaccttggggttgaaatcacacacctcttaccattgcacgatcaatattcagttttgaaacaggtgagctgttcatagtgttcgtatggctattatccactgcctgtttcgtcagtcgcaactcggtcatcgcttacgcaagtttgatgcttcaacaaacagttttatatcggcatctttctccgacagataatcaagtcactgatggagctagagagacatgatagggaagcaagtcaatatttaaacacaatagtcgacaacttgttgctcataacgtgcgcaagcgcaatcgtcttgattatgtattattggtggtcacaagaatgggaagaaattttggggccaacatgtggcacacaaacagttcgacataaatggattggagaacatcaactctgaacacgcccaaagaaagtgacattttatataggcctaatttaaaatagattattcatcaaattattatcacgaaaaatatacttgattatatggatgaattaattattttaagaaataaacttaacaaatatctcagaacaaatggtctaagcaatgaattagataaaagtatcttaaaaaataattttagaggtatggagtcccataaaaaccctacctagaattgggatgtaattaatcccatacaacgaatctggacaggagcaatctaaatttgttgtactagattatatttcatcacacttctaggttagtttttttagacggagggagcatgtgacaataatctggcgaagaaggttcatgacgtgagtgcttactgaaacacagaatagttgctcaggattcctttttcttttgtgtccatttcgcatgaggagaaagcaaagacggatagacgattgcttgatatggttgcagcacctgtgatttggtcgggaagaaagcaaagatggccactgtttcgcaactctctgaactactgcagatatatcttgtctgtttgtttgtactactcgtaaccattatggcattctccttctttctttttttacatcagaaaatctgctgcaatgcaaatctgcaattctgcatcctttcttctcatcataacgcagacaagatctggcctacaaaatgtgcttgtgcttgtactgtaactacaattcggccagacagcctgaaactgccgcacttactcataccctgttcaactgctggctcaattgcttttttttttcttcaagaccatttgtagtataagtgaagtgtccatattttctcgcaaccttaaacttttaggttaaattagtccgtgaatgcaactcaatatgatatcacaaataaatgtctcaaatttgaaacctaactagcacgcaactaaataaaaaattacggtctatttctattatacacttgagatttgaggagtacttgtaaattgtctgtttttctgataagtttaaggtgccataccatttttttttaaattgtcaaagatgctatccatttagtttttttaccaaacttgatcaatacaaaagaaatcctgtccaaacctggcaatattaccaaattgctaaaattttagtgctaaaatttgataagttttattttggctgcaatctgaattgcatataagctcttagagcaggtacaatagcaagctataagctagctgcaaacatattttaaggagataaataaggagagagagaagagcagcgggctacagatttgtagccagctgtagcacggactccaggacgcagtgtgtgtatgacaggtgggaccaagtattaatagtatagtatgtaactattatatggatgagctattagattggctatagatgaattggagctagtagttggctatactattaaacttgctctaatatctagcactagtgctgctatggcatgtctgcatccactagtttatccatgcatgtgtaaaaattgatgaacagcagaacaagttggtcacagtttcagagtaaaagtagtaaaagaggccatcatcattcatctgctgggggcagtagtccaaatgaacagaacaggcagtgacacacactgactttctgctcatcttttgagtagagatcaaaagagatcatccatgatccatccatccattcacgcatgcgtagcacaattgcaaatgaaaaacgccgttttttcaacttgtttaagagcaaagctgcaacaatctgatttctactggtatttcaagctccattattgcttgtgcaggtgtgctgaattcttcttgcgggcacacaaattcatggccattggagcatgtgctcgtgatctctcctttttctctttatgcgatgcagattgtacttatcgttttttaggtcaagattggaggtgagggatcaggggatatgctgcactgcacgagttgtgatgtgatgggatgattgagcaccagccatgttggtcgattgattcttggggttagtagttttctaaagctttggtagcatcataccatatgtgttgatgcatgttgcttacactggagtgcaatttggggacagtgtatcatgaaaaatctgaagatacaccttcgtggatctgtggatgcatgaatcagcacatccaaaactattcacaaatagtagcggtgtacatcgtattagatatagaagttgggttttaatttattattagaaaatatgcacaaatacaattgtgtgcatttctagctgtcggcctgccgctataggcggtaagtattacttctataatattaaaacttttacttccctgaactctttagtctatcatttttttctcttaagtaaaagttttctcactttgatcaagtcacaaaacaataattaacatcaggagagaaacaaccgggatttcaacctgcaagagtggccctgagtcgatgtagcgaaagctatggctacagaggcggagttatggcgcctggcaaaggtggcaattaataccggcacttggtctctagtttcatgagtctctaggtcgtcccaatcggttgtgagattgtagcttaaattcttttttccgctccggtatcctatccccttttcaaattttatgtttgatttgtaaataacttttattcctcttaatataatgatacgctccttgcgtattccaaaaacaataattaacatctacaataccaaatgaacacactatcgaaactaacttgaaactaatacccgattttaaagttaaaagtacgaaaggtatactagctaattaaagaattcagggatagacattagtagaattattttcgtagtacgaagaaagtacatatccgttttgattctccccgtacacatttgcaacgtgctgtttgtattcctaaatagagaataagagcaagtttaatagtatagccaactactaactctaaatcatctatagccaatagaagagccaatttatacaatagttgcttactgtactattaatacctggccctacctgtcatatacacagtacgtcttgaagtccgtgctatagttggctacaaatctgtagtctattactcttctatctctttatttatctctttaaaatatgtttatggctggtttatagcatgctattgtactgctctaatagtagtactaatcaaggagatgtatgtggtacaaactgaagaagaagatatggataatagtatatatgagtacgacagtcacacttgactctctttacatgattaacaagaagagccgtaccgtaccacagctttctactactagcttaattagcgaagataattattaaccgggggctcatcttttgcgaaatctgtcgacgaccgagttggccgacagcgacatgtgcagagagacaaaccgatcgaagaatatccgtcgaccatcgatgagtttggttttcagaaaaattcagagaaagaaacagtgaacgaaacatgcacgattgatctactagaacatagtagtacaagaacaaattaaattaagttaatgtaaacacgtgcatttgtgtggtttaggttaggttcgttttggtttttgcggcgccgcacggccggacgaattttgaccttgcactgacgaaagttcaggttaagttggtacgcatatgcagctagtgagctcctagtgatattgatgatgatgatgattcagagatatatatatatatatatatatatatatatatccacccgtttttggcgccaaacacgcagatgcaggcgcgaataagttggtgggttagctctcactggaggtaggccggcgccggcgccggcggggacgagaattaatccggccgccgttgacgtagacgggtcaatgttattttatcttacgataatgaaaactttactgaactgagccagttactccctccttcccggaatgtttgacgccgttcgtcttattctaaaaattttgtgaaatgtgtaaaattatatatatacataaaagtatatttaataataaatcaaatgataggaaaataattaataattacttaattttttttgaataagatgaacggtcaaatatttttaaaaaagtcaacagcgtcaaatattttggaatagagggagtacatcgagatgaaataatcgtacttacaatactttcgacctttgtatggttaagatgcatagatagataaaaacacacattcgctctagtttagttttgaaacgaaagaaaacataatatacagcaagaattaaggtccatcaatcccataactaagatcactacccatgttcgcaaaacgattcctggccatggcgttccaataatgtcaggccatgccctgagatttgtgtactaatttgggtagtatatatatgtatacccactttgccactgaatttacttttagttatttacgtttttttaccttcaatgtactctacggaaaaacacataaattgaacatagcaaattaaaatttaaaagttttttcttgaaattgttcatttggaaatttttgaaaagctaattataggttattctatccatcggaacaatagggccgttatacttattatttttgaattgctctattaataaactttagttacccaacgtactctctccatctaaaaattaggtgatttatagagtttgaagtttgtcttgaaaaaataagttgatttttatactattggtttagtttacctggccatatatatatatatatatatatatatatatatatatatatatatatatatatattgatgccgtgatgcgattaaacttttggtaactaacctcactctatatatgcatgcatcattatccaaaaaaatatatgcatgcatatcatttgcatagtcaaggaccacacaattagtagctagcatgccttgaaaggccagtgtgattattcaaaacatgccatttccactgaactataatctgctagtgatttgtttcagctaatctgtgcaattgattccggctttttgtgcaagaagttcccacgtacaacacatggattgattaattaaccaagcaaggaggccgataattagaacaatagaatcaatcaatttgattaaagagaaaacatatgcatgtgaccgcaaataaacagtctgcttaacaatcctccgccagggattttacctttccgttctcaaaataaaaaccgctccaaccagtttacaaaaaaccaagtgaaaaccaatataacctgcagataacttttagtcaacttcgtatgaaaattaactaaaacggaccgatttataaattgaccaccgtcggtttcaaaaagacagattgattttgttgattttgtatgcatgtatatatatttatatttatatgagatcttcgcggtgtcaacaagtttgccataattcaattaattgacagatgatactctacaaatagatcagtactttttatttttagataatggaaaatcccggtcttttcaattaaaactataggcagttattataatgtttgtagcagatagcaaggccacgataatcgaaaacaccaactatagatagatagagacaacattcattcatgaatctgtcctattagtgaaccttcacccatcattatttattttattagaaaagatatacattgacattgttgtacataaatttatttctctgccattctagaatctagaacgattctggaagattcagactattaaagtctaagaaactcactataaaagtcagaaacttttctagagatgtttcttaattaacatcaacatgcatgaaaacatacatgtggtatcttgggactgttctttttgagagggaaatcttggaactattctaacaacccatttggttggccctcatgtcaaaacaatatgtttatgggaatttcaagcaaactgtccaataaagtatatggctcatttgattaatttattgtaggggagcctggcattgaactttgtttctgagtaaagataatatattatatagtaaaagttgtggcgtacgtgcaatttacaactataccaataaaaaaacataaacatgcagaaattctcacaatgagtaaaacaaaactgccctgtggcatatatgtacccatattctaatttacaactgccaaactctaattgacttagattctacggctaactcttacagatattttattttgaaatagaattccgctcagaaatcctgtcccacatagggaagaaattttctagacataaaaagtatcctttgtggcatatatatactccatctgatcataaatgttttaacttttaggataaaattcagtcaactttgttttttttagaaaattcagtcaaacataactttgactatcaataacttagttatagttataattatgttggatagagggaacaggttgctagcttgtaactctgatatgttataattatgttggataaagaggagcatccataatcaatgcttcagagatataggctttggctgaacctcgttaacaaatatcatgccttgatattatcgtctgtttttttttgaaggaaaggcaagaagattgccttatatattgatagagtagggaagcaaagttatatataagtcatgggagttatggtcgtcctagaccagtcagaacactccattctcgtaaagggtacatctcacttaggtttttttttgcccccgcaactgcccattggagagcttcctcctttattctcaagaggatgaggaatggggtgccggccaattttcctgaagatacacgagttccattctttccataatcctagaagaccaaaatgaccattaacttgagctgttctcgcgaagtgttatcatcatcagttttggatctcctatgacattcacaaatatcgatctatgtattatcggtaccggttttataacactatttaatttctcttacttctccatttccctctctcttagagatcttataaagttatctcttacatactgtgtaccttcttcttatcctcttatattttttccctacaagcatatacaaaaatatctatgtactctaatagtcaaactatcggtagatacaatatgcaacatataattaagcacaactgcattaagtctagatacccttttttttcagattgggcggtgatgccatcttaaggggaactactactaatgataagaatcgaagagtttctaataattaattgagtcgccgacatgcatggtgccctcgtgccctagacaaagtgcgcatggcgccgagccgaccggccgatggaccatttgctgttgcctgtcaatggccacagaatattgcccaacatatcgataagtgctgtacacagtaagccaacattgcacatacccacttcctctcatggttctatattcagattaaataaaaattaagaggtgtttcttttcgagaattacatagtacaacacagacactcacaacacacgcacgcaaaccccacaggtgcctcgttgttgagtacgtcgcctatcactgaaagcacaatgtcgtcaaaccactaggttacagccctttcgctcctttcattttttttaatatatgacacatttaattttatcgtgatgtttagctattcgtcttattaaaaaaatatataattattatttttgttacttattttatcattaaaaaaactactgtaacctattctttttacatatttatactatatttttaaattagataaattgtaaaacgttataaaaagtcaacatcatatataaaaaaacggaggtacataagtatatacttaattacggtgggtacaatccgaaatacaaacttataaaattcacatgtatatacacgaacttgtatactgcatagtaaccatgataaaatagtacactataactaatcttgctaaagtaaacagtgatttggacaccgtgcgcacatctaaggtgagcatgcatggttcgtttaccgtcagcgcaacatactcagaatttttaaaagcaatagtaaattagagggagaaaattttgaaacagacatattttaacctgatttgaacaattcctattatattcaaactaattcaaaattgccaaccaaaaatttcggcatcaatttcggtccgaaaattgtggacatcgccgccgcccaataatcggcctccatccggagcgaaatgacgaggggagagagagagagaggccccggtagctagcgaacagcgcggggggggtgtcgctagctaagctatcaaacagcagggcaaaacgtgcgggaaacttgggcggtagctcgcggcggcgacaaccgcggcgtgtgcgcggcagctgcgctgctacatgcgtgtagctaggcaagctgtccgtcctggactaggaaaggtagcggcaagcacggtggagcccctccctccggcgagacgcggtggtcggctgcgggaacaggacaaggacggacaggcaggggccaaggggaagggaaagatcggtttatactgcttcatccgtacctaaatacttgacttcgttaaccttttttaaatatttttaaccgttcgtttcattgaaaaacttttgtcaaatatgtaaaactatatgtatacataaaagtatatttaacaataaattaaatgatagaaaaagaattaataattacttaattttttaataatacgaacggtaaaaaatgtttaaaaaagttaacgacgtcaaatatttagggacggagggagtactattttgtatttttccctccattttgaaaagcaattttttaacaaaataagtgaggctcaattctttttattattactagcaaaatgctcgtgtgttgctataggaaaatatacatcaaatcctagttaattagagaaagagaaaggtgaataatactacagtaaagtaagtgagagaaccagagagactcaagattagtaactacaccacatttagctacttacgtcaaactacgcatgtaatattaaaagtcaaattaatatcgataattgatccgaaacgagaattagagctattgattttcttttttaaaattatagatctctgacatatgttagatctggaattcagacttgacactatttatttagacgatatagagagctagtcggatttggttgaaccaatctaaatatgaataaatacatgaaaactctctttcgcctcaagtttctcatggacgacacgtatttcttttcggatggtctttttttttttgcccttttttagagtcggacttttatttttttttccttttttatttcaggggaaactattggcgttggatgacagaaacactacagatcttttaaatatgtaaatatttattagattattgaaatggattatttacctcacgctttgaaaaaatatattttctcaaagaaatatttatttcctactattgtattacttaaaccacttgtttaaattatttggaaaatttatttctcaaaatatttgatgtatccttataatcaaacagataatctacggtaccaatctgcttaataacttgttttaaattgaggcaagtccagaaataagtgacttataatttctaccgaagtttccatgtaaacatattgttcctaacttaaatccaaggaagacaggcggagactttaactcaggatgtacacatactttgctaggcaatttccatccaaaatcttagacaaaaacggtctgactttgaggaattatcatgtgattcgattattcaaagaagttgggtatattgttcaaggatgtcaggaccatcccttttcttttgacaaatgaaaaagtagctagctcagcccataagctgtttaggacttctttgaagcacatgatttttatttgttttaagaaacacaatataatcgtaggcgctcgatcataacgtgagcacacccaccctatgaacgccttacccctataagcacattcgacagatccgactgacatatcttaagattaacgaagttattatgggcgtctcactgtcgacgggtacaacactgagctacgcttacttagcaaacacatgatttttaaaatgcagaaatagaaaaaaaaacacatgaattgattgtcacatgctatgcaatactacatgattacaaaatagaggaacaccacagataatgccttttgatggttcacaggaattgaaacacaagaattttgcaagaaaccatatgtggaagagagatagagagaatgtgcattgaactagcaaaggaaaataaaatataagacgtgagatcatgttaaatttcctaatagaatttgcattccataggaatttttaaatcctatttctttgatcgaaagggtgttatatagaaattctttcctaaaggattaattataaccctccaaaattcctttgattttcattcaagaacttagcttagtccaggaatggttgccttgtcacttatgctgaagttttatgtaaacatattgttcctaacttaaaacacaaatgaggagacttgagtgaggatgtacttaaacataccttgctaggcaatttccatgcaaaatcttagcaaaacggttttgagtccaaggaattatcatgtgatttcactctgtgagtgagtctctgagtatgatcaactacttaggggtatgactcaaccacagagcttcgtgttgatacctcaacttctttcccgttggtttcacatcgccatcgcttctcaggcatgggctaaatgaaccgagggctcaacgacggcgacctaaactgtgaggtgtaatactctactcccggtttcatcgtcatgggatttttgtttttcataaaagtttctttcaaaagggctaaaatgaaattacaatgtcacaatcagcacacttgcaccactgttgccggacagtgcgctgcaccggaggaggctgatggcgatgccgtcgctgataacttgtgaccttgatgtgtacatgtcggccctcgagtctaattgaccggcagctaagcttgttggctactagtagtagtagtactggtgctttctcctttatctcatgcttacttacaacctaattattagatggctaaaagctgattatatgctaaaacgatttattaacaaataaaaaatattgttttagtagaatttttatatgtgtgtgtttttagcggcttagatggtaatgctgaaaaagaaaccacgttaaaaatactgtagaattataatttcaaaattaagatttaaaatttaagttttgaacagcgactgattctttatatatagagcaaatgatgaggttctgaagcattgacatgtattgtcattaggacaccagagcgcattagtttggtattagctcagctgtaacaagttttgttgttttgcacaattgcacttaggcttgtacagctaccatgcatgcatggtaccacactacctgtcagatatgtgctaaaaacataaatatgccacgcataaagctagctcctccaacatcagtatatatgatatgaaattacagatcaatgacaaattggtcatgcattatcgatcggtagtcagttcagtcagttatgcttttgtgtggttcagaatagagtttggtgtgagtctatccaccctacatcttgcaagttgcaagtgggcttagatttgtggtgtaaagatggtccatggtagtatagtatatatctttagttctggatttctcccttttgttttttaaggaaactgtctattatgttaagttcgttgtgcttgagaaaaatgcatatacaattaaatttagagtaaaatacatggccggttcttaaacttgtggtgtggtgtcacttaggtccgtgaacttgaaaattgcacgattagatccgtaaacttgattaaatgtaccacccccggtccaatcgtcatttgactacgtttgaccgccaacgtggcatgccacgtaggcaacacttttgttctcaaccccttccacatataccttcacacataacttgccctgaccagtgcgcatttcaatccaaatccctcaaaatatccctaaatcggctagggtttcgacggtgagtttagcggaaggaggtcgagaggtagcggctgtggcggcctcggcggtgagattagcggtaggaggcagtgcagtgcagcgggaagctgcgcaattcggcttgcacgctaggcatccccatggattgtctaagctcgtccttgtcttgaagtcgccggaagaaggtgttgttgatcaagtgccagttgcgtaaagatccgatcattttagagtgcagagcaatgtcaattgctaatcggg

SEQ ID NO: 54182 - DNA, 13286 bp, Oryza sativa
caccaccacacaagtttaggggccggccatatattttactcttaaatttatatggagataaataaagaaatttaattatatgctgcattagctgtttgcacatgtgaatatattttacatgcaaaactttgatcttttttcaaaaaatatattatgaaacgaaaattcgttcgataagtctatatatgtttgatgtttcattacctttaatgctactagttacctcttacctgcggtacattgcaacgggacataatccgataaacttggtttaatttttctcttctcccgtatttttctctcggttgatcaattgtctggtacagcagttttttagagcggctttttatatgtgggattagggtggaattccacctatatgaggttgccactaaccatttcttaattcacgatcactttatttgtaattaatctagaaaatcctaaaatgcaacaagcttatgaattttctccaaagcttgatggaattaatatagctagctcgctaccaattgaactattgaaggacggcgagccatctgattcactctagagacatacctatctaccagctcacagagatctcgacaactcctcaaatatatgctttctcatctaattcaggccatctattaattggccacttgagagagacgacatagctagctagtatctcacatgatctcaagtctcaacaacaactggaatatgctttgtgagctactccctctgttctatattataggtgtatttggagagctttagattcgaagaaacaattgatgggaatcctgttagtaagaatttgaagaagaaaaaaaatcagtttcaggtttctaatttattttcataatcctacaactataacattttagaatctgaaaaaaaaacctatattgtttggatgagcttttaattttagaggaagttacagctatcaaaagcttccccaaacaggtgatataagatttttaagtttatcataagtatttttttttgaagtttgatcaaaatttatagaaaaatatagcaacatatgtagctccaaatataattcattaatctatcgttgcataattttttaagtatatttgttttgtgttgaagatatgttacaacattcttctatatataaactgatcaaacttcaataaatttaacttagaacagccattgtcacttgttttctctcgtcgagtgacgtctagctaaggtccgagaaacaagaaacgagtgagtgtaccatgtatgtgcccatgccatgagttgttggaaagagtctcacaaaaaagacaaggaactttacctagtcatatgccaaataatcacaaaagatgtctctagtgtccagttgaacataaatagctagccctactggataaaggggatatgatcctgcacattggattgcaacaatccatgtggcggttttgttcttccggtgatctctgcaaaaaaacaataatgccaacggtgtcgaacgacagtgaaaccattgtgcttatgagatctctcccgtttccaagcccatggtttggagtagcctccaaccaacaggaatgtgacttgttggtgtacgtatgcaatatatgtgtgcaacaatccatgaaaaattttgtatgtatatatgctgatgcaatgatagattgatatggtacaagtgtccacatgcatccatgaaaatttttgtatgtatatatgctgatgcaaggaccgaatccaggctaatgatggtgatgatggaggtaatcacgcaactaggctatcaactagctatttaatctctgtctcatctgggattgattagaaaaagggaaggatgatatatttgttattgtttatagaatttagggcgtgatctagcttaatgattgatatggacagaaaaaaatgatcgtatgaatagattaaatattgtagaactaattgatagcttgaaaaacgttatgtaagtaatgttgatgtaggaagtttttagagataactttattcatttatttttttaaatgaacagcacaaaaggtaactttagaaacttggcacgaatagcccataccttcattttaactatttagaactcgcctagcagtaagactaggagcaggtatggtgtttttgttgtagtcttgtcattttgatgaactaatttgatgacgccaataggccggatagataacaatatacaaagaagtagagaaaaatttctactcccttcgttcctaaaatagacatttctagattgtttagtaaatattgaacataaggaagcaagatttcctttcagtcaataaatgtgcacaacatgtggctatgttaggcaaatccaagaaatgctttgttcaaatagatgcataatagagctacgaatttttacgtggaaaatctttacgagaaaaaactacaggcacaaactggcaattatcagtattgaggaattaattataatgcaagctagggaataaatcatcatctcacccttcccgtatttctagtaggaaaaactttgagtcctattgaaactataattaatccgaatatatagtaagctgaaatattcatatcacattatttaacataaatgcttatataatatatataatttaaattattgaaataattatatttgaaaatggatggcgattattgcaccatacaggcatgaggatggatcaacagtagtagtcaaatttaaacacaatgtggtggccgtaactatcacaagacggaaagacagtacagtaccgaaactgagcattcctttcagtccttactaaccatagaccattcccacatgtgctgttgtaatgttttatttcctcaataataattgaagaaagtgatatatatacatatatatgtggtgtttttggtctaaatgtttacacgtagtagtccccgttggcgttgagtgtaatattattaatgtttgttggcatgcatgaaaatattgttgctatctagagaagaaatttcacatgcatgtgcgtgatgaatcaataatggtgagaagtgcacatgcttatatatgtcgatcgatcgagtcgacaagatgaaataacagcatatgcaacatgcatgtaaccacacgagtccgtttctcacgctcactatcaaagggacacatctgcagtacccggcttgtgacagatgtacttagggcccattcgagaagtcagtttgtggaggctttttcgcgcaatggaaaatgagaaaaacatttgtacatgattaattaaatattagctattataaatttaaaaaatatttttattattttaaaaacatttatatagattttttttacggaatgtaccattcgagaagcgtgctaacataaaaaagtttgtgcttttgagttgaaaaaagaactcagttttattggtagattgggagcaggggtagtacatgccagttgcaacttgcaaccaagaaatttgagccaaattcagtggcaaacgttcacatctgacatctctttatcaatcaatttcgttttccattcgtcggttttaattccgtaccatctagtacgtagctgctaattaatggtttttctctataaattctttataaaaatatatacaaacatacatcttcagaaaaatattttttacggacggctaaaatagatttggagagaattaaggcaggaacaactgtctctaatgaaagcaggagcggcacctacattagatctctatggagagaagggaagagagaagaggtaataagggcatcaccaatgtatatgacaaagtgatccatatagatgggacccacataaatagtttatccctatggcaatgtccataatgtatagatacaaggtatcattaggagaagagagatgagtagagatagataatataatttattccatatgggtagtccatatgcatatggatatcttttgttattttttctatatagactagttgcacaatgttaataggtggctgaatggaatattctattgcttatggactacttttacaccacattgtggatgtcctaagagtaggaggctggagaaggaagaaaaatatgagcctccctaaacgaaaaggctttaaaaaatgttttcccatagtaaactagatgttgtctggattttctcatgtattcatatcatgtcgttgcatttaagtctaaactatctattatcttaaaacaaaaggacttgtcgtcaggcatacgtgtgcgcgagttgcctgtgaccggggatttttttttttttggagggggtagcaagtagctaggcgatgcatactgtcgatcgtggcgcggccggacggaccaccggcaaagatggagccatggatggatggccggccggataaagaaaaaccgtgtgttatggatgcgtggttggctatcgtacaaatacaacaacatcctgctgtcattttgcctggtacgtacggcggccaagaaaacagcgaaacggaacggaattttctgccgccctggaccaggaggaccacgcgtacgtacggcgtcgtcgtcgtcgtcgatgatcgacgagaaaaggtagccgatcgatggctaatcggggactaaatttgagttcttatcatatcggatcggatgtttgacattaaataaaagtattaaacgtagattaatgataaaaacttattttataatccttgactagtatgtgatgctacagtaaacatatgctaattatggattaattaggcttaaaaatttatctcgcaaattagctcttatttatacaattaattagttttattattagtctacgtttaatacttctaattagtgccaaattaatatttgatatgacaagcactaaaatttagtctctggatccaaacaccacctgagtaagggattgatgcatatatgtccgagcattcacacgaacaacatatataaaaaaatattttctaaagacactaaatatagaaaagaaatatcattaattttttttagaaaagagagcatacattaagttatgatcgattacaatcttacaaaagacgaagctgcttaattaaataatacacgttggatggtgcatcctctcgccacacgggcggagtgagatgtaccaaatgtttagcaaagttagcaagttcatcagctaccttatggcacgcctgcatatcaggaagaagacccatgtgaggccctttgtctctgggatgagggagctcagcttgatatgttgcccatcctcgatagtaacaagtcggcaaccgaggagcaatcgagctgactactgggatgctggtgttctacatatgctcccctttttcaacttctactccctttttcttcgagaactcttttctcacactggtaaacagtgttactttttttaaaaaaaatctatagaaaagttgcattaaaaattatgttaatctattttttgatttttttaactaatacttaattgattatgtgctaattcattattccgttttgtgtattaggacggatggattccgaacccataggttcaaatggaccctaatatactccgccgccagcttcaacccttctttgcaagccatagcctccacatccttcgcagcagcactaatatctattgggaacaaaactgaaatccacactaaaggcatgctcatgcctgctatatgaattagctagataaccagattttttttttactttatgtagatcttcaaaaaaacattgaaagttatatatttcaaagtaaataatgtgtataaaagtgtgttctgaattgtaatggaagcaaagaaaaattattttaaagtcacatacgtgttgctcctatgtaacaggaacatgggtatgttagaaggcacactcatggtgagtatggtgatgtgtgcgcgcgccattcttgtactaaagaatataatgttgtaaagtattttgaaatataaaaatgaaggtagaagagaatgtgtattaatatagtttatccactattaatttgagggaagtaaagttaaagatgtcagggttatggataaggtatacctcctatcctacaatctatagaatatacggatatgacatactttcacgtatacgaattatccccataaacgctattggaatctgttacaaattatgaaagatatctcctcgagtcaagcgatttccaaagtcctacttggaagggatagagtttctgttgtaccatgcaagatccaatgtctctaggtcttacttggggtcaagatagtccacggtataaaagggatccctagggaggggtgtaaagcatcgaatctcatcgccaacacacccaccatagtttacgaagccagagtacgcggagccaagtcgtcggaaaatcttgcgagtacatcgactacgatcttgtcggtatcatcgagttcgtctacttcctttgtaatctgtggttttccatcatcaatcccatataaactggagtagggctattacttgataaggggcttgaaccagtataatccttgtcttctgtttgcttgatgtcgtattacgtagatcctcgttccaacgtaccataatatcctaatcatccggtctacgagtatcactcgtcgacaaaagaggctgaatttatactatttacattattaaatattataatcactattgttttgtgctaataaagggaaggaaagttaaaagaggacgttttgtatccatttatattaaatattgtagccattattgatttgtgctaataaaaggaaggaaggttaaggagggtgaatttgtattaatatagtttaatcacaatattattttgggcaaatagaggaattaaagttaaaaaggacacatttgtacccatttataataaatattgtagccactataaatttgtaccaattttgcaatttggctatttgcattaatgtagtttatcccctattagtttgtgctaatcgagggaagaaagttaatgatggtgaatttgtaccatttatatagaacttctgttccaaaataagtttatatttggcttcttcagttcgtcccaaaataaatttatttttaagcaattattgcattgggatttgtaaaaatagaatatatatatatatatatatatatatatatatatatatacatcggagtagttaaagagagaaacaattgcattgcgatttgataaagtgagagtatttttagctcttttttttatattttatattggtatgtatatgatggatgaaaaagaacttattttggatggagggagtagtatattgtagtcactatcaacgtgtactgatatagggaagacaagtaatttggaaggtgcattcatatcaattcatatattaatatagtgttgcgcttataatttgcgttaataattgtctgatggttgttgacaatcaaatcgatggcattggctttagagtcgactgggttgccaactttttcggaggtattgcttcatcccaaaatataaaaaactagtaccagattagatattttatagtactacgaatctgattatattgtctgtcaagattcgtaatactataaaatgtttaatatgatcttagatttttatattttaaaataaagggatcgagtaatgaaggaacaaagatgcatggtagttggcaatatttgtccattccacatgccggagatagccaaacattatggttaggctcatttgctcgcatctctaggctctagctatgttttaagatgtggaaaaaaaaattttcctcttctattccttaatataatttacccagtttcgagaaaaagaaaagcaccaacaaagtaaaggaaagttaacgaggttgaagtatcatctgttaaccattgatctcacaacaatagcatgtttcatcccaaaaaccagctcggaagcaatatttagcagctataagttgtactctgattttttagcacacactttggacccagctcagcatgcaaaaatcgctgggacatagctgtgtacgcgcaaaaaatagaaaaaacaaaacacacaataaaagaaatatagagaggcaaagctaggctgccgggaaaacgttgttaaatgtttagcgcacgtgtcccatgtgcgccttcctcgtccacacgcattatatatagccatcgcctcctccttgactcctccccacccaagctcacacatctccctctctccctcttcttcttctcctcctctcgccatggatgccaccaccaccgtgtccatggagatggaattgccgtggggcgcgcggtgcgcggggctcgccttcttcgcgttctcggtgtgcctggcggcgctcggcgtcgtgctcctggtggcgaggcggtggccgtggtgcagctgccatgtgtgccgcgcctacctgacggggtcgtgggcgagggagttcaccaacctcggcgactggtacgcgcacctgctccgccgctcgccgacgggaaccgtccacgtccacgtcctcggctgcaccgtcacggcgaacccggcgaacgtcgagcacatgctcaggacgcggttcgacaacttccccaaggggaggcccttcgccgcgctcctcggcgacctcctcggcgacggcatcttcaacgtcgacggccacgcgtggcgccaccagcggaagatggccagcctcgagctcggcagcgtcgccgtgcgctcctacgcctacaagatcatcgcccaggaggtggaggcccgccttatgccggtgctcgccgacgccgccgaccggggcgccgtgctcgatctgcaggacgtgttccgccgcttcgccttcgacaacatctgcaagatctccttcggcctcgaccccggctgcctcgaccgggaaatgcccgtgtccgagctcgccgacgcgttcgacgccgcgtcgcgcctctccgccatgcgtggcgcagcggcgtcgccgttgctgtggagggcgaagcggttcctcaacgtcgggtcggagagggagctcaggaaggccatcaaggtcgtcgacgagctcgcggcggcgatgatccgggagcgccagaagctgggcgtcggcagcagccacgacctcctgtcgcggttcatggcctccaccggcgtcgacgacgccgccgcggacgacaagttcctccgcgacatcgtcgtcagcttcctcctcgccgggcgggacacggtgtccaccgcgctcaccacgctgttcatgctcctgtccaagaaccccgaagtcgccgccgccatgcgcgcggaggcggaggccggcgacggcggcgagacgggcgccgccatcacctacgagcacctcaagggcctccactacacccacgccgtgctgcacgagaacatgcggctgttcccgccggtgcagttcgactccaagttctgcgccgccgccgacgtgctccccgacggcacctacgtcggcggcgacgcgcgcgtcatgtaccacccctacgccatggggcggatgccgcacatctggggcgccgactacgccgcgttccggccggcgcggtggctcaccggccccggcgcgtcgttcgtcccggcgaacccgtacaaatacccggtgttccaggccggccaacgcgtgtgcctcggcaaggagctcgccgtcaccgagatgaaggcggccagcgtcgccgtcgtgagggcgttcgacgtcgaggtcgtcggcgagaatggccggagcggcggcgccgccgccgcgccacggttcgtgccggggctcaccgcgtcgatcagtggcgggctccaagtgagagtcaggcgccgcgttcacacttagacagctaggagacttcacttctactgcaacaacaaactgaaacaagttattacaggcttgtacatagaaaaataggagaaattaattagtagggaaatttgggtttctaatgagacaaaacagaaaattcagatattgattcgtgttcgtcatggtttcctcgtatggtgatcattctgcaattggacattgttagttgaaatcacaaatcgggtaatcgaaaacaaaagaaaaaacatacaaaattgggtaactggagtagatggtatgttgttgtcactaatatgaaaacaccataatatctgaaagatattccgtcggacaggctttgttgcatctgatttggcacattgttgttccagtacaatgacacatcactgatactgttattgactagcactacctccgtttcaggttataagactttctagggttgcccacattcatatagatgttaaaaaatctaggcacacatatgtcaagattcattaacacatatatgaatgtgggcaatgctagaaagtcttataatatgaaacggaggaagtaatacaaattttgtttcttttcatctaaaaacaaagtattttttacaactaatactgtcagtttgcaggttcccttccctgtttttacttctggttagaccagcttaggttaattttcctgcaaaatcacatttccttgtaagcattactattacagaagatattcgtcggaactaaatatagaatgaaggtatccaatgtaccacatttaatttgcagcagtaatatgaaggtttgccttcaatgcatatcaaaatgtggaaaatttctgaaaatgtgcagaccagtgcaattactgcagttaataagcctcaatttcaggtatactcaaccaatatcacttttattggcataatctgttgacctgggcattcccaaattatcagtgtcattgactcaagtctcatgctttcgcacggagagtcattgcagaatacaggcataaactcacaacaattcccagaatcccagtattgccaactactgccatgctcctgcgttggaatgggattgaaattattgggtttagtttttttctaaccattttttcgggttgatttttcgcgccgaaacactggtttttaggtggaattgtttttttaaggtgggtggggggaggaggagaactgtgttggttaactgtactacaccagaagcaactgggaacctatcttcttactggagtaccatgattttgctcatgtctcatggtattgatagaagagatgaagatagtgaaaaagacagattcctacatttcctgtatttgtctccatctctgagtctgaagaaatgcaatgtttgacagtgctcatcagacgattgtttttttttaaacgaaccgcacaagacagtgcgagtttcatgtattgataaagcaggagaaaaatacaagttatagccctggaagactatagcccagaaaggaaaaaacaaccacaccacgcacctacaaccacaaacgctgcaagagcgaaacaggaaatcttcaagacgacgtctccaagaaggaaacgacaccaaggatgccgccgtctgtgatttttgcgctgttgtgaacttcagaacttgcacttttgtaactttatcttatcttttctcctttcccggttgaagaacagtcgcaacacgaaagaagaattcagttagtgattctggtggagaagcaaaggaaagaccttgaacgtgatgaaatagacagtgtccaattccaaaggatcaaagatgatatatgccgtttctgatgtatcctatgctatcctcatcgaaagctgcatttccatcgcccctcttttccacgtcattttcagctatccatgatccccaaacaatatatatagccaggttcaccgattactagttcatctataaattctagggagaacttttgctggcattgatcatctaccttgaaaatacatttggggacagtctgttcatattttgacaattgttctttaatctttatcaactgtgttgctcacgcaaagaccgggaatactcatttgagtttagtaaaatgcttcatttatcctaaaaaaaatacgtcactctttgacgttatcttccgttttggacgtcggtcaccgacggcgatgggagcgaaattcgatcaacaaagaccgatcgctgatttcagacattctgcttttctttggtttgaagaagacagggattacatacaaccagagatggaaatgtctatgtttatgtttattgtggtgtactaagtaggaatcttgtttttaatcaaactgtaattttataatacacagctgtttgtcctgcattcgctgcaataattggttatagcatctttgaagcaaaaggacagaacgaattccattatctttaaaaagaccgcgtcactcacaatttgtcacctgcataaaaacctaatatctccattactagaagtacattactgtacttaattccgacataatgaatcatggatgtaataattgaaacatgatgcagacagcacgtcagtattatcttgaccctgattctgatcctagtcgatgcataatgccataatgcacaactcattaatcgcaacgtgcgatgcgtgatcagcgtcttgtcatcgctagtacgacaaggatccacaagaaatttggttgggccacaaatgctgccaagaatccacacaaatatggataaggaattcactagtggtttcagaacaagtccaaatatgatagtacttatttggtatctgttcctgataaaaagaactggatagttgctcatgcttctctctccttttgtgtccaatcacatactcacatgaagaaaaagatactactgaacagactgaacctgagcaagaaattgtttgtttcccctatagctgaacggcttatcagtgagaaaaaggttatggataaaagttttatatatcttaacggtttaaaaataaatgctaaaaaataaattacaatgaaaaaaactaactttaaaattaatttttaaaatttaaattttgccagcagcttatataagatgaaaagggctcctctgctagagatgactgaacagctcgttcacaattcctttcagacaaaggcagccgtggttttgaagggctcctcaagatttgttttgcgattcccaaacattgtcgattaattactgcaaatttcactcaaacaatgcgtctttctcatcaaaccgagatagggctgctgttgttttcataatgcagagacgtcctggcctgcaaaacgatgagtggatatttctgttgttatatatactatatatctacctcttgcatgtgccaagatgccaatggaggaagatgcaaacgatttacaagaataactaactactggcaactcgaattgggcgtaaattgcaatagaaataggcgtgtagatggttgactaaaacactagcaggggtagatccctatagaatgactaaatcatgagtgatgtggtcggtcaattgcagcgtcttatccaggatcacccaattacatttatgtatttttagtagcagagtt

SEQ ID NO: 54183 - DNA, 2988 bp, Oryza sativa
agagggttacggtggtggaggagtgggactcataatagcggagggggagacggcggcgaggctgctcaactggtaactgccggagcagaggttggggaggaggaagcctttaagtctgcgtgagacggatgacgaccgttggatcatcgactggcgcgacgtggaccgtccgatcggccgtacaggagtgcgagtggagatgtttttttccggaatcacgtgggaaaaaataccccttggatataataataaattaaattcgcgtgaaattcctgtgttgtaatatactaatgacaaaaaaaatgagaaaacaatcttttcacccatttatgcacgacaagtaaacccgatctcgaccgcattctcttctctcttttttttagcgtcattctacctttttcacctctttttaattagctatatgtgatttgattttactcttacgattacacatacacacgtactaacgtgcaaacctttctatcctagtatcttagtatactacgatcctatcaagccgaaacgataccgatcccatctagtatcttaattttcatagtatcttgattctactatttattactatacgatcctacaaaatcttaggtgatatctcgatcctacgatccctacgatcctacaaaatattattttaaataacatggtttggaaataatgtaaataaatatgctcaattttatataaaaatcagttaaatatatcaaaaccagcgtggtttctcttgataaatgtttctatttgcatgacatatatcattactacatttattttatatagaatggctatatataattaatatagatattaattaaacttaaaaaaatatcatagtatcccgatactacgatacgatcctacgatacgatattactttgagcaaaacgatactacttagtatcctgatcctgacaaccttagttccactcctgggctactctattcagctattgttggttatgcattaatttggctttgtgctcagcatgcatgatatgtttgtaggtctggcggtgttcgatcttgcatagtgatggtaggtgtggtgatagtttttgtgtgtgtaaggcttgaatctttggacacatgcatgaagcattaaatatagataaaaataaaaactaattgtacagtttgtatgaaaatcacaagatgaatcctttgagcctaattagtccatgattagtcataaatgctacagtaacccacatgtgctaatgatagcttaattgggctcaaaaaattcgtctcacggtttctatgcgagttatgaaattagttttttcattcgtgtccaaaaaactcttccaacattcagtcaaacatctaatgtgacacctaaaaattttcttttcgtaaactaaaagcattgttggtgtgtgatggtggttttgtctttttctaattctagtctcataggacggtagtcttgtcatttttttcctactatatcatttttttggcactatccgatgttatttgttttttaaaaagcatgcatgatacgtagttctccttctagacaatagctaccatgtttttagtatttaattgggatatatttgaaattatagatcagatttctctcaaaagtactaccattagaaaaaaaataacatataatttgttggggtgaataaatatgtaataatagaaactggtggttatagttgtattttataagtggggtcaaatggtcaatatccaaaacatgaacagcatgtatttatgcccggagagactagtagctactactatgttcttaaaaaaaagataacaccttagctacgaatatagacatagctatgaaccctagctaggattgagttttttttttttttgaaacggaggtggtagatgatatataaaaagtaagttttttttaagatagaataaatcttggccttacgaagaaagtaagtggctagatgataggaacaaagtgtcatactgctcatttggacggcaccgagaagagaaatggaggccgtgttagtgtctccttttgcttcgcattcaggccaccacttcaatcttgaggtggacatgctcagttaaaggaaattttctagccacaatttgaaacggatggctgcatgcatatgcaatgaggctcaattgaggagttgtgaacgtatccaactccatgaccgtaatagttcagaaaaaaggagatgaaaaacatgggctaaatcctttcttgtcatacttctgtgcacgaaatggataagaactttggggcagctaaccagagttatggcaaagctagcacacatatgccaatgcagccaaagtgccaggtgatcaaagaggctttcattttctttgacattctgtggaacaatcaaaaccagtcgatttgatagtttagcggtattagtttttttagcacgtttcaggcatatatacatcagtttaccatccagctgaatcacttcaggaaagagatagtgaagctactaaatcacttcagaacagttccaaaattcagcatcactttaaatgtcaagcattagagctgacgaattggagatgaagacaaatacatgagttctgcagagtcagtgaggtaggtgttcatgaaaattgagtagccaagaatctgcgcatagactgtggaaacagatagccgtgatgaagcactgtaacctatactacagcaactaaaaatgcccatgtatggagcagtttcagtctgaaatggcggctttaatagtaatgtaatttgccttcgaattttctaagataaggattcgtgtgaagtactccctccttttcaggttataagacgttttgacttttgtcaaagtcaaattgctttaagtttaaccaaatttataaaaaaaagtagtaacatttttaacccaaaacaaatttattatgaaaatatatctaattattgatttgatgacactaatttagtattataaatattactatatttatgtataaacttagtcaaaattaaaa

SEQ ID NO: 54184 - DNA, 1750 bp, Oryza sativa
  unsure (1)..(1750): unsure at all n locations
gcacgctcgatcgatcactatctctctttctctttcttcgtgtcgtcgacttcgcatgcagccgtcgcgtacggctacagctcgacggcgacccaccggagctggctgcccatccggcatccactccatcgccgccgatgctcagctcgctactcgtcgcgggatgagcaagataacgacgagcgaaatccagctggactggacggcgagtcaatactatgcttgagaagagacagttgtattgtgttgtgtgggttgacgatgttgagatgtaaggatagaatatggcgatgcatgtccaaatttctggttacagttggcacagaggtgatctcataacatgcattgtatgcaaatcatggtttgcaaaaataatttggtcactgatgaaaaccgttcctaattaagtggattttagttttatatattatttaacttggcccctttgcctagcggtttctcaatttgtaccagcttgacacaagttcgatgaccagaatttccgaccggtcatattcatttgtcaacctgattgtaccgtggttgactatttattattgaagccttgcaacatggacattttggattagaattagtaccttgagctcctttcgaaagcaacaatttctgtagaattttaacaggatttagttgagttccttccaaaaaaaaaaagaaaactcatttcaaacttctctgctgccaacgaacgaacagaatgggctggattccaacagaggggcctttccctgctagatcagcacgtccggcccatccaagactagcccacttaacatatcttatctatggcccaaagctcacaaaaccagaaaagacctcggcccaattaccccattccgtccaactccaactcatcctggccgtccattcccgatcagaatccgctatataccctctcttccacccgcgccacccactcatccccttcctccgaaaaccctagctccaccacctcctcctccgccgccgccgccatgaagcgcaatccgcgcgtgacgagctcccggcgcaagtgccggaaggcgcacttcacggcgccgtcgtccgtccgccgcgtcctcatgtccgccgcgctctccaccgagctccgccacaagtacaacgtccgctccatccccgtccgcaaggacgacgaggtgcaggtggtgagggggagctacaagggccgcgagggcaaggtggtgcaggtctaccgccgccggtgggtgatccatgtcgagcgcatcaccagggagaaggtgaacgggtccaccgtcaacgtcgggatccacccatccaaggtcgtcgtcaccaaactcaagctcgacaaggaccgcaaggccatcctcgaccgcaaggccagcggtcgcgccgccgacaaggccaagggcaagttcaccgccgaggacgttgccgccgccggcgccgccggggcctcgctccaggagatcgattaggctcggggagatatatccctttcctctctgttcgtaccgtctctcctattattatcatcatctagttaattttaatgctacttgaaatctgctactttatccctgatgaaactgtttgtcaacgtgagttttggaaccttatgtggatctagtctgatgccttggattntgatagatcaagaactgaactcattacatgttttattgctcatgctttagtgaacgttcaaatctgatgctgaatggtctcattttttgttgttatcatgcctcctgttgttgcaatgcgtcac

SEQ ID NO: 54185 - DNA, 1740 bp, Oryza sativa
ctactttcaatgtcagagcgcatactttgacgaaccacatgaccaaactgaatctcaaagttgtcacaatttgcactacagtcatcttcaagcatcaaattatctagcattttcatcaccttcagtgtactttcttctgtcatggaacatcggaaaaaagcttcactagccactgttcgtagttgacgatagcgttccatctggtctgaccatgtgtaaacttcaccatacctatctgaaggaaatgcagattttgcttgcattgtccaccgtcgtgctatgcagaagcttggtatggcctctaactgtaaataactcaaaactgcaaatatgtgatgacatggtatgtactgacactccattttccggcaaggacaggccatgctacacagtaatgcttcctcaaacatgcaggtcacaatgacaattttatcttttccaatcaaatgcaatacataccttacacattggtcctcttcgatggtatctattacctctcaattgatgcccatgtatatctcaaccttcacctttttgaaaattttaggcgtgaacacacgtgctgcatccttctcaattagtgtagcttcattagcagtaaatggtacctgattgtgaagcctttgcatccaactctgcctcttggtgatggatacgcgacaaacaatgttcataatgctccaccaaaataactaggctcatcttacgatccaacaacctatgaagttttgagttcaagctttcactgcgttgattgctcttcatgctgagaaaaaccctccctttagtgtatgttgctgcccactttttccttaaattatacatcctcttcaaccacttattgtcgtccgataccttatgcttaatcttaaactctacccactttctttcaaactcatcttcatcaaactcactatgcacaagtgttctaaaatctgaaagcatggctggactaaggttccgtgccatattttgctcaatatgccaggtgcacaacctatggtcagaattgggaaacacatgtaggattgcccgacgcattgcattgtctccatcagtgatcacagacttgggatgtttctgacacatacaagttaaaaactggcgtaggacccattcatatgtctcaaccctttcatctgaaactacagcacatgcaaatatcacagttgacccatggtgattgaccccaacaaaaggaatgaaggggagattgtatttgtttacacgatatgtgctatcaaacacaacaacatcaccaaatgcatcataatctatccttgattgcgggtccgaccaaaatagcctcttcaagcatcctgcttggtctatctcgtaatcataatagaactccatatcatccttctgccgtgcttgcatgtacttaagaacatggtcagcatctccacctttaatccgtttctttttcagcttcacaaaaaaattgtacatatccctagaagtaaaaccagtaccctcataaccaccatggtctctctccattatatccatcacttgatgctgatgcaaacctacatctctcaattctaccatcttagcctgttctgcaggagttattctacgatgtgagcggagaaatggcacttgatcacctttacacaacggatggttatgcttcgacacaaacctaacgacataccagttaccttctttctgatatagtttaatctcaaactgagctttgcaaccacaacgagttagtgcctgtggctccctact

SEQ ID NO: 54186 - DNA, 2059 bp, Oryza sativa
cacttggtttgtagtgaccactataggcccagatggactgaaatcagaatagatcatcagagatagaaaaaagtgctgattaatgcacccaaggaacagaatcatgaacaagtcatatgaaaattatcaaaatgttctcttataatgtgcttgcgaccagaagattagataatccattctgatgtccttgtaagtcgtaactaagtaaattgatcaaagaaaaaaaaatctgaagaatcttgtgggagttatattgggaaaatgcgataatgtaagtagatattttgatttagcaacgataaaagataggtaaatttaaatgaccagtttgatccactatacaaatttcaaccacttacgcgaaaatatttataaaatccatccaggcattgtctaatatttgtcacaaaaggatatgcatgctaaactgtcatatcaggaaagtaaaatgcagtgcacaaacaataatgaaccttgataactccattttctgctgtaaacctcccagcagctatggtagcacctcctgctaaaaagctcgagtgctggaacacacctttctctttctgcatgaataaatcagcttatatatatgagtaaatatttatagagatgctaattaagctaccagcttatatgagtaaatcagcactaacgaacacaaaatccttatggcacggagaaaattaaaccaccttgccagcataaagtctcttcgttgtgctcataacaaaaatccactttgacccttggcttgtatcaaggggttcttcagagtacttatggataatctttccttttgtaatgatgtattcatattgctcacgctcttgctgcaaaacatgcatcagatatatataattgttagaaccatctgtaggtaggaagcaaaaatatagatctcactaacaatattttcatgttacaattttgtaggttgctgaatttaatggtttgtttcagttgtcaaggattatatatgcagcaactatagaaatgatcttaccggaccaagatattttatgcattgcttcttcagctgagctcttggacactcaggaaggtcaacatcttttccctccccaatatcaagcctacatttgcaaaaagaacattactgaaatcactgcacaatcaaaccacttactgaaatttatgtgattcagtgcaacactgaacttaatgcattctatttgcaaattaatctctttttgtcagacacatccaaccagtttaattattccaatgacatggagtagtttgcaaatgcaagcacacaaatcacagtcaacttctcaccagtagaaaaaaggctggccggcctggctttggcaccagacatcatagtagcactgcagattgtgaccatatctatgccgtgggtcaatctatacaacgaatgataattgctgtcataattgcatatgtgcatcaaaagtttcacataatgaacgaaaaaaagcagaagcagaagcttccatcacgccatcatgataagctgtgaagctttctcatgagcgatgatgtattcatgctcacacctgacgaactacaagtccaattaagtcaactgatagcagcctcttttcacgtgtatatatataataaaacaataaaacaaataccattaatttctgaaccataaaggtactagtaatacactaatacctgatcaagtaaagaacactggtaaaaaaaaaacactagtagatttgtactgttgtacttacagcctcgatccagtgctggaatgccagcttccgagccttggcgtctcttgataaaccctgacccacctgcatcaaagctcagattttttacagcaatttcgacacaaacagaagattaatcaaggagatgcagaccagacaaaccaaaagaatgcctcctttttttcttaaccaaaagaatgccttctttttttcttgtggaattttgtggtaggctgcaggtagcagcaactgagaaacggaaggaagtaggagaccttggaagcaatgatgctgacacggctccagcgggaggcgacggtctccgggttagggtcgtggaaggagat

SEQ ID NO: 54187 - DNA, 10563 bp, Oryza sativa
taagttccaaacagattattgagcaaatagttgtcaccgattatctacttgattattaagataaattagatatttttgatatataaacttaatagataacttaaaaacaatgagtaaaacgcataaaacggtccttaaatttgtagggttgtgacatctaggttcctaaactcacaaaatacagatttaggtctcagaacttgtcaaagtgtatcatttaggtcccaaatcgacacaatccctatatgatcctatgtggcgctgatgtggcatgccatatggacgtgacgtgtccttttcttcttttttcctaactttttcttctttttcttttttgttttcttctcattcttattttttcccctctcttctattcgggtcacagagaaaggagaaggaaacaaaagagaagatggagaaaaagataagaaaataagaaaaaagaaaaggtaaaatttgttcgtgtggcatgccacatcagtgccacgtaggatcctataggagctgtggcgatttgggacctagatgacacactatgacaagttccggaaattcgatatgcattttgagagtttagtgacctagatgacacatccctataagtttaaggaccgcctatacactttactctaaaaacaagtggtccaagtaatataggtaagtaatataaataatataaaatgcattattcaaagcgtagagtaaatattcacttcatcttaatttgatcatcccataaacgaagaccacgaaaaccaagaacaccaaaacatctaccattctaaaattaggtactccattgtttcgtgtccaacaaaaaaaattaattcactttaaatgttgcgcacatagtatttcaggatgtacatttactctttgcataaataaacaaaagaaacactttgttaattagatgatgattattttggaaaaacctaaaaaatcttaggtgataatccaataaataatctgaaaagaacaactaagtgcacaaagttcgacttaataacttaaaccgatgagcaaagatattccacatgaaggttggtgaagaatccggttaattaatcatcaccagagctcctcgacgacgacggctgtgtcggcgagcttgcgccgggtccggtagctccggtacatcttctgcagcttggtcgccgccccatcctcgccgccgccaccgccgccgcttccggccaccggagaggaaacctccgcgtcgagcctggaagagcccgcgtgatccagcccggccgccgccgtcgccaccgccattctcgtggtctaagaggaagacgcaatagtgcagcaaaatctaccactcccttcaccaaatggagacgacgatcgagagagaaacagaggcaatggcggtgctagctagccttgtcgagaggagagggaacgcgaggaatttaagcagagagtttgtgtcgctgtatgtgacacgtgaaatggagaagaagaataactaaaatttgaggagaataattaaaagatgttttattctgttatatatatattctgttcgcgccaaaaaaaattccaagtagcctagcctacacgaagtcgaaaagtatcgtgctggaagcctggaatgtgtgtaacggtattacagtgatgactcaacgactggctgcatgctcttactgttcaggcccacaatcccacatggttactgcacaaacagtgaaacaatcgaacaaaatttaccaaaaatttaaaattttaaaaacttggttatgttactaatctcttatcgttacttcaccccaatggtaaacccgtcgacacttaaccgtgcggtaagggaaacttgtatgtgtgtgtatatatatttctgtaaaagagggtaaaaattttggctcgtagtattgatagagcagagtgaggaaaatccgttttcacttgcacataaatacacgatgagcccttttttttaaaaaaaaataaagaagttaatttggttcatatttatcctcagttgcctactatatatagtcccctttttttttaacaactatagctgtgattcgtaaatcgtcttcaattctgccttttaacatctcaactactccaaagtgctaccactaccatagttatatacaatacaatactccagtagaccagtacactgtaaaagctctattatatttttaggtcctgcagtcagcacagtgtttaaatcttttttcaaaaaatctattatattgttaaaggaatagaaaaatgagcctctactttcgctctcatggcctagaaattctcacattaatcggagaaaaagaaaaaacagagtccatatagaaatactccctccgtcccacaatataagagattttgggtttttacttgtaacgtttgaccactgtcttattcaaatttttttttgcaaatataaaaaatgaaaagttatgcttaaagtactgtagataataaagtaagtcacaaataaaataaataataatttcaaaaaattttgaataagacgagtcgtcaaatgttacaagcaaaaattcaaaatcccttatattataggacggagggagtacaatttagaaacagctgaaattcggaattaaaaaataaggaatattagaagagaagactagagtccatatagaaatacaattaggaaatagttgaaattcggaattaaaaataaagaatattagaagtagagtatatagtccatatagaaatacaattaggaaataactgaaattcggaattaaaaataaggaatattagaagtagagtatagagtccatatagaaatacaattaggaaataatagaaattcggaattaaaaatagggaatattagaagtagagtataaagtccatatagaaatacaattaggaaataatagagattcggaattaaaaataaggaatattagaagtagagtatagagtccatatagaaatttaaaactaactaaaattcggaataaacataataaaattaaaagtaaaagtagagtttagaattcgtataaaaatacaatttacaaataactaaaattcgaaattaaaaagaaacatgggtagaagagtctaaagttaatataaaaatacaatttagaaataggtgaaatcgaaattaaaaattaatgaatattgaaagatgagtttagagttcacatagaaatacaattagaaataataaaaattaagaattaaaaataaataatattggaagaagagcctagagtctatatagaaatacaatttacagataatggaaattcggaattaaaaaaaagaaatattgaaagacgagtctagagtccatataggaatataatttttaaaaaactaaaatttaatattaaaaataactaataactaaaacgtatataaaatacaatatgaatattacacattagtagttttgtaaagttagtacaaaatttaaaattatgttgttattttaatatatttgaataatacattgaaaaaatatatatgttattatatgagagaaaatataatgatgttagccgtgcagagtcaccatgctagttaaaataatatcaagcaccaaatccaagcaagagatgtaagttcatcagagacagggagctcttctgcgttggattgggtctctgagtcggatcgacggtgccaatgggccaagcaggccggcttgggcctgtaagctgagtggcaacagggaaacctttgctaattagattatgatcattttggaaaatctaaataattttaggtgatgattaaattggaatagtgataataattagttttgacaatctaataaataatctgaaaagaacaaataagagcacaaagtacataaatatgggcttattcctactacgactataatctacacttcgaaatacagagattttgcacaggcaacagggagaaaggaaattgtgaaaagagctcagattcaagagtcctctaaaacaaaagggatcagctaacaatcactggactccaaaattcaccttcttctgctgagacaagttcactgaattagattttccacaaaaataagatgggcattatattttggatgtgtgtaggagcaccatcggttacccaagtgatgattatatgccaaatgggttattagaaaaatcaatttatgggtaatttttttatgtgttcacttaaaaaaacataaaaaaaaagaaactacgttcgaaataccttaaaatcaaatctaaaatttagttttaaaattcaatttttagcagcgacgtgttgttcatgaatgggttgcaggaatgatctggggggcattggtagattgaaagtgggatggcaatcacatgttcatacgataagagtaatgtgcaacgaatgagcggaagatacgcgagggagacttgagctgaaggaggagaatggtctgtggtgacaaaggagattgagcgatggagatggggtgggttatacttgaggatacatttggtgttaaaagatgatgggcttcactggcatttgctaggtgaggatggtggtgtagtggggtaggattgctgattagcgcgtctgtgtcacgatcttacacttctagctcataagacgcatgttccgccctttcctttttcctttcattttagttgaaggttttgcaaatagaagttttttaacaaattttgctacaggatactacgattttgtggttttagccataagacactgcccgaactcacttttagggaagacacttcataaacgtgataatttaccgatggacaccgcgccgattagaataatattttccggttgaggaggagagagaaatcgcgtgaaatgtcaaaaatacccttaggtccagtcagctcttctatcttttctctctcccccctccttcgtctgatgcgcggcggcggaggacgagaccgacgctgcgatggatgtcgagcccgactccacccgcgtcgcggtggcgccacgaccacctgccggtgcgcgtactccagcaccagctccgtattcccggcgcccggcttctacttccgcgtcaccaagagcgagcatctccctcagctcgaggagaagctcaagaggatctgtaagcacgcacgcacatcgaccgtatacgttttgccatttcaaccttttttttttgccatcctattcttattaggaacgtaataacacaactaaagcatgattttcgtggacccatggcattcttttccgtccatgaacgccggctcgccgccgaacacctctacctcgaccagatgcatcggtctcttcccgaacaggtcggcctcaagatcgagcagctcgctctccctcccgacgaagccctcgttgcgggtgaagggaagctccgggcgcaccgccaccgccgcgtgccatgatcggacggcgtccgccaccgcgtgccgcccaagcctcgactcaacgatcttgaggagatcgatcaagcggtgcctctggctcgcagcgtccacctccacggccgattccgcacgggacagcgcgcccacggcctccctccagtcccacttgccgccgtcgtacaccttccacaggtggccgccgaacctcctctacagatcgccatacttctccacgatgtcctccgcgcggcagtcgcccttcccgagcccgacgaacaacggcatctggtcgcgtggaacgggctgctcgtggaacgcccgcacggcggcgacggcggaggcgacggtgccgtgctcgcgggacgtcgtggttggtgacatgaaagaagcagcacgagcgtgcggcggcgcggacgagcgggacggtggccgagcgcgggagggagagctcaacggtcgggaaggagatggccaggctgccgtcgtcgggcagagagagagagagagaggattggagagaggggagagagtgagacgagcgacggaggaagaagatgacgtggagggggatgaggagctgacagccgggcccgggtgacagatgggccctagtgcaagggcatttcggtcactccgcgtaaaatattaggccccctagcgcctcgtcagcacggatttattattttaaaaggcgcggtgtccgctggcaaattgccacagttatagagtgtctttccccaaaactgagtttgtgcggtgtcctacagctaaaacaacgaaatgacgatatactgtagcaaaatttgccaagttttttagattgaagttttaaaatgtatgtttttaaagaaaagaaattgtgcactcaaacatagctgcgctaaatagcaatctcggagagagtttgttcgaagccagcccagtccaaccaatccatcacaggcggcctggtcctccattttgtctcaaaacctgaaaaaaaaactggccgactcgaaatatgcctagggttggcctgtctttggacctgaatgtttctttttgttaggctcgggtcggcaaatttttgctggagcctagggcctgtttagtttccctagcaagttttttcaccctgtcacatcgaatgtttagacacatgcatgaatcattaaatatagataaaataaaaactaattacatagattgcgtgtaaatcacaagacgaatcttttaagtctaattgctccatgattttgacaatgtggtactacagtaaatatttgctaatgatggattaattaggtttaataaattcatctcacagcttacaagcggattctataatttgttttgttattagactacatttaatactttaaatatgtgtccaaatatccaatgtgacacggcaataatttttacccctgaatctaaacacagccctagttacaggatgaatttgacgtgggagttgtgtgggattatctatatcatcgatctgcaatcctatggcctctaattgagtaacctctcaaacttctttcagaacgtcaccttgtgaaagtatttaaaaaatgctcaaattaatatgttcattgcgtagctaaggctttagtttgctctgggctggccgacatgcggctcacgcacatatgttcagtacgtcatagagaataaaaattactttaaaaattactttactggtcaagatccttgtgtagtagtagtagtatgtttagtagtaagtcctaaaatatacagttcaactgcaagctcatcacagatcagttacagcaattgtcaacgctactccatcccctgcatccttttcgatcttcgcaagcaaacagctaacatctgaggatcatgcatccgtttgaccttaatttgagcgaattattctttttcaatccgagttttgttacagactagaataaactcattggatatatttgaagaaattctgaccattggttgaaatggtctgtaaattgcgaacagttattataactgaacgtagaaaaatgataattaaaacaaaaatatgtgatgatagggcatgaatttgccaatagaagtgttggtttatttctacgcccgatattagtaggataatattatacaagagtagctagctagccacgggatcttatactttgtggaaatgtacttaatcacagccggtgactgacacgttgggtcgcttcattccatagttaggctgctaaagcacatgtatctttccttgacggattggttacacactaaacgtggaattaactagtaattaggcatgcaacgacaaaattagccaatacaatgtcctgcgatcctgacctgtaaaaacgctgttgtaccagctgacctaattatcgatcgatcgatcgagctgacccggaaatcctgcgatgacacttcgaataagtggaaagggttgcatgcatgtataagcaaaaataattttgccgctgcaagcatacatgcaaagctattacatagtcatattttatcttgacacatagaccaaggataattaattctacttatcacccatttaaacatgctactagtaattcctcgtaaacaagcgattcattaatatttacatttctcgatgcccatgtagctaatcttgtgtggaagaatggaaagtcatgcattaaattcgagaaagtcattaagaagatagattattggattgaaatatgcctatcaaaaatagaattttcagatttagaaatatgactatcaaaatagatggagggagtattaagctaatcacgtgctgggaaagcatggtatattgcatgtggacatgtacaaccttggaagcaagcaactccatcgatcgcctataaattccatcgcaaccatgcatgcaatcacaccagcaactaaacacatcactagctacttaattagcagcagctacaatctgagtgtaattaacagtgtcgtgatggcgcctaggctgagcgccgttgcattggcggcgttcctgctgctcgccgtcgtcgtcgccgccgccgcccagcctaagcctaagccggccggaaaaggcggcaagccggagaagggagagacgccagggaaaggtaagccggaggagagggagacgccgccggggaaaggtaagccggaggagaaagagaagccggagaagaagaagataaaggtgaagtgccaggagagccgtaagctctacccctactgctccgccaagatgatggagtgccccgacacgtgtcccacctcctgcttcgtcgactgcgacgcctgcaagcccgtctgcggtgagcagccgccgctaccattgttaccaatcgggattaatctttagttctaagtatttaaattagagataaagatatcttagattcttagattcgtatttctggttgaaaaaccgggattacacaggaggttaccaactggaagtacgaagcatttctccgccagtggttgcacctccatcttgtctctgacgtatactctctgttgttgtgcagtgtgcaacgtgccgggggcgtgcggcgacccgaggttcatcggcggcgacggcaacgccttctacttccatggccggagggacgccgacttctgcgtcgtctccgaccgcgacctccacatcaacgcgcacttcatcggcaagcgcggcgccgacggcatgtcgcgcgacttcacctggatccaggccattgccgtcctcttcgacgacggcggcgcccaccgcctctacgtcggcgccaggaagaccgccgcctgggacgacgacgtcgaccgcctcgaggtcatcgtcgacggcgagccggtgctcctcccggaggacgccggcgccacctggacctccgccgccgtgccggcgctgaccgtgacgcgcaccaaggcggcgaacggcgtgctcgtggcgctcgacgggcggttcaagttgagggccaacgccgtgcccatcaccgccgaggactcgagggtgcaccggtacggcgtcaccggcgacgactgcctcgcccacctcgacctggcgttcaagttcgacgcgctcaccggcgacgtgcacggcgtcgtcggtcagacgtaccgctccgactacgtcaacaagttcgacgtcagggcgtccatgcccacgctggggggcgaccacagcttcgccacctccggcctgttcgccgccgactgcgccgtgtcgcgcttcggacatggcggccgcgccgccgccgtcgccatggccgcgtagctcgctgcactgcgtataccgacttaaatcatcatgccctcttgagtctgatgctatgatgggtatgagtgttaattgttctgttcattggccatggctgcacgcctgcactgcatgatcgtcaaagtgcgaagtaataatcttgtgttcgtgttgattagttgatgtgttgatattcgcatcagctgcactgtagtattgaactctgcaaagaaataaatttcatgatttttcgtaaatatttgggtatgttcagaaatggatgcatggtaaaccaattcagaatgatgttaagaatacaccgtaacactttgtcattgcttcgaaagagtgatcgatactggctcaaagcaaacaaaatacggtttttcaactttacaaagttatttttcgtacaaatcattgagtagaaactatagtctaattcagtcttgtatctacggtacaaggatttgcagacatgtctagagtttaatggcacttccattttcaagtgatctgaagacactatcatcgtgtctttatagaaaaatgtaatcttttttccacataaaagcaacagcacacttggtgattactaagaagacaataattagtagtagcaaccactcaatgcaacagaaaatggcctttggtataaacgtactaaaataatactagaatcgatgttacttgcagttacagaataaggctctgcttttatagcatttccctttttgtaatatacgaaaagagacttgcagaacgaacataacaggcaagacataataattctgttttgctaacctttgggttatggcaaaaaggtgtaatcacctgaaaccaatgcgtcaggattcatgtaaattcaaaaaaaaaagaaacttagcaaaaaaaaaactttattctgaacaaccaaaattcagcagcaagcattactcatgcatcagcttgcaaagggtgcgggtcacattcactttgatgcctaggcctgccccaatgctttcccaaacgcaaaagccagaaatcccc

SEQ ID NO: 54188 - DNA, 1227 bp, Oryza sativa
acagtttatataatttagttcattcatttggctctttcgcctaattattctgctctccagattgtcgtaatcaaatatcttatcacatcaaatgcaaaaaggtaatggcctgattttttttagagacaaaatggcctagctaattggtggagagggaatattggtgctgaagctgtttctgcgtgcatcagtgtcagtcagcacacaaaagcacaagcgaagagttattaaaaacattcgatcataaatggatccacataacatagtaccagaaatgaaccagtaaattacatgaatcaattaagtgtcttccactcagataccagtatagatgtaccaagtatagtgatactcgtgcacgctggttaattagatactcgttgccggttctaacttagttggggcagccatctgggttgttgtaaactcaggaggtgttggtaagttgggtgagagtgataggcttgcctgtagcctccttgagattgaaggagctgaagccctcggtgagaggttcaccatctccagtgcctgcatcctgagctgcattggatagtccttcacacatccaatccttggaccagccccagtgctccatttcagggacaacttgtggccaagctgataggatcttgattccctcttggatttcaccctctcaagaatcgctttccgcgggacgtcgatggtggctctagggctttgtagcccacctgataaggttctttggtaggttggctttgcttgctctgtggcagcattgtcgccttcggcaccttcaacttgtgaagatgacccagatgccttgttttctagtaccatgttttgtgggagaatcaattgtggaggattggattcaatgatggcagtgatagggctctgaactttattaggaactggttcttcatactaagcatcatcgtcggatgggcgcacctgaatatatacacaaataagaactcattgattgaaaccatgcatttgatatatttcataaatacttagcctgaaatatggtgtaccacgttgttgagatcaactccattctcctctaggaagttcatgaagttgctgaggttctctgcacttggtttgtagtgaccactataggcccagatggactgaaatcagaatagatcatcagagatagaaaaaagtgctgattaatgcacccaaggaacagaatcatgaacaagtcatatgaaaattatcaaaatgttctcttat

SEQ ID NO: 54189 - DNA, 1668 bp, Oryza sativa
agtgtggttttgtgaaactacactaccaaaatatatgtacttaagtgccaagtgtcaaagtgtatgtggttttctgcaacttggaccataaaatacgtagttttgtgaaatttactctaaaaaaaagtgaatgctcaaaaaataaatgcataactgatggtgtagataaggtggagcagtacctccggtgcgtactagattaggaggaccattaactcctttatccgatttaagatgcgatggagccatatggggcattgtaacaactgaagggttgttaactgattttacaggagatgatccaggtggtttcaaggtaaccagggaagcagaagtcactggggcagtagcaggcaaggcagcaacagctggtagattcctaggaactccgacagcaaacttgggagctccatgaaaaccttggaaatcagctgtgccacttgaagtgattgtttgagctgtactagtcgttggctgtactggagattccttgacttcttccatctggaattagggtaaaagaagaaaagaaattgataacttggcagatgtacaaataaaatgcatagaccaggcaatgagggtgaactcaccagactacaacaaaattatttttgcataattaataatagtataatagttaactaacgatgataaattggcaactagactcaattcagaaaaaaaagagtataattcataactgaaaggctaagtgaaaccactcaatgctgagaagtacgatcacatcaatccaataataaagtgaattcgaagaaacccatacaaagaaacagtaagcgtaaccaaaacaaacctatgatgacactaagttcaaattcatgttgctcctacaattatgaaaatagaaaggcatcacttagagaaaattcttaatctggcaatcaagttcactagttcccttatatggcacttgaaaattgtcataccagattcacttatatgccatcaagtggaaattcatagatcaaccacatcaagtgagtggcaaattatcaattagatctagaagagtgggaaatcctagaatgagaaactaaagagtggcatatgatattttttgccttcagaataatggcaaaactacaatttgtcttcatcccctcctttcttctcttcttctcaatccactttcgcatgggcccccatcggcacaggccagcaccactctgctcttccacaacatgccatgcatgcattaactcatcaccaggccaatcaaagctcatagtgagaagcagcatacttgcaacacatgcttcccatctgcatggctgcaagatcgccgatgaagaagccctcctgccagagagggagccagagagtgctatgtactgtagagctgcccctcaaaaggctggcagtcaatcacagcttccccaccacccaccatgtgttgtgtgctccacagtcctgctctctcatagtatcgtagaggccaagaaaaaaggcaagagagcaagcagactcaaatgaagtgctgggattgggcaaaggggttgtcagagggaaggaccaatatatatgaaactgacaaagggacaagaggggcgccaggcctagtgcttgtctgctcaattgtggattgtacccagacttccaaacatagttacttcctccgtttcataatgtaagactttctagcat

SEQ ID NO: 54190 - DNA, 18851 bp, Oryza sativa
catatagatgttaatgaatctagacacacatttatatagatgttaatgaatctagacacacgtgtctagattcactaacatctatatgaatgtgggcaatgctagaaagtcttacattgtaaaacggagggagtagattgattaagatccaaccacgcagtcacttgtaatatcagcaagctctgacatgactacatctcgctggacagctgtagcagccacaggaaattgacgctatccttcgcaacatctcgctgatggatgaccccaccatgcaatcaactcccatgaggttgaagaaggaaaggagggggaacatgggtaatttcatagcaaatttacagtggcatataaggaaagaattggtttcgcggcatcagaagaacctgacttcagaaatagtatatcgctgaaaattagtggtgcactttaataccatccaaagtttgtgttgtttagtttttttaccatttcttgagttggaggcactttaccgtaatctgtggcaaaactaccctcgctctctctccccttcacttctcactaagcttcgcataaggatttagggatgggtgtgggttgacccatgggtattctttggcccattctagtcctactaaatgaactaaatttcactttagactctctaaaagtgaaacttagttcattttagttgaactaaagtgggtcaagaaatacccgcggcggccacccctaggaggattcttctgcatattggtgtgctggacagcagccccgatggctagcagtagaagggacaacaccggccaccaggaatactggaatgtggctgtagaagcacgcgcatgctctcccctggcacgggcacacagtgttgcagtcggtctgcccctgctaccacccctccagcatgctgcagaggcgaacgcaagtacggtggatgccaggccagtgggctgcttcactatgtagtgtcaatccagcacaggatagacatatccattgtaaggacaaaaccatctttttcgtcggattattgacagaagaaaaatcattaaacggaaaagaggcaacagagtggtatatgcccaaccatggaaaactttggatagtattgaagtgtaccgatgaatttatatggtatatttgtgaactcaggatcttccggtgttatggaaccgattttcccataaggaaactcatgaattttgattggcatataaaggatttcctccatcacttaacacgaatatatactcaaaacacggggaagcaaagtaaattatcttagtgggcaacaagccagcaacactaggaaggcaaacaaaccatatcagaccaaagttaaacaggagtaacagaagcttaccagtacatgagctgttttctagaaaatcaatcaatataaaccatcaagagagtagcattcacatgatatagctaagctaacaattcaataatatcacgagcattctccccaacgcagcatagagtatagaccaaatcgttccagtttcgtcaatggtgctagttcatcgtaaagctataaagctgaatgaagcgaaaaaagaatgagagttaccaaaccttgcgcttagtgagcatcagcctgtcggcgatggaagccttgggcgggcggaaccccatggcggcgggatccctggccctgttgaggccgagatcctcgacgagggcgcgcacggcctccccggggaacagatccttgggccgcaccgccccctccgtgacgaccgcagccagcctctccctcgcctccgcggcgagcgcccgctccgcggccgtcggctccctcccacccctcacctccccagcggcggccagcaccatcacgatctccgccacccgccgcagcccctcgccgtcccctccgcccgctcctcccctgcgccgccgcttccccagggaagccgggggcgacgccgccgcggcgtcccccatggccgccgcccccgccgcgcgaccaggagggggaaaaccctaggagagagagcgggaggcagagccgcgaccgcgcgaggccgggggagcctcgagaaggttctagaaggtcctggaagccgagggagacgcccaattcaaacgcgtccacgttttcgcgctcaattagagttgagtttggagacgagaaaggagggagccgatagatggtggcggtgagatgggcgaggccgcggaagggtggagtttttgggggaagactagcgagaagagagagagagagagagagagagagagataggggtaggctagtagtagaacgcagccgagcacgggagtttttttttttctccttttcttttcttttctttttttttcgggggtggggggattttcggttggtgggtggcggagttgggttggtgggtccgggggtggagtagtggagaccggatggacggcgtggatgcgggctgcgggttaggaggcggtatggataccgttggatggttggatgggcttctgtgtgggccattgggagataggagtgcaggatgggctagtgggcttttggaggctgggctgaatttccttttcgcttcaaatcgccttgtgtactcatttcgccatgatttgtgaaagaattgtacttagatttaaatcgttttcggcatgaattctttaaaatatctacgttccagtttcaaaggagccatcactttcctttcttgcctgggttgtgcttctctgcttgcacagtatcacaattcacaagacagggaagaaggatcagaaagcaggcacataacaagatttttggtttgtagacaggaaggtggaaccctgtttggagtctcagttcacacaggataaaacatagagttaacaagtctcctaaaacatagaggattaaaatgtttaaaactgtacagtttgaccggtaccactctctttttacaccaaatcaaatgcgaccaattatcaactcccgacatctatctgtacagagggggttgaaacttgaaaggaagacatggagagagagacctagcagactcccaactctcaactccaagtcacttttttgttcttcagggggcgacatcgtttgccacaaaaaaaactagtagatgcgccatgccacaccacaaactttcgcagctaaccaatctttctcacttctatacactttgggaaggaaaactcttctctaggcagttaagatttatcggcgactccaaagcaatggtcataactcttctcctgctgtcctctcgttctgattgttgtcctcttcatttccaaagggatcccctgttgcaattgctccatcttccagtggcatatggatacatatgccgttgatgggaaatggttcctggtattcatgcatggtgttagaaacacgcttataacctaagatgcagtttgctagttaaatcaccattaccttgttcgatatactgtttgaacataagaacaagcggacaaatgtgtgtcgacattttaaacaagcttacctgatttccagcatctggcccattagaatgaaaaagaatggggcggcatctcttatcctcgttcattaaacttgaattctggaaatgtgaaatgagtgcagtccttccctggatcctagcgtaggccaaggaggctactttctcactgttgaatttttcccatttcttgccattgaacgcctgcaaattacagcacatattcagaaacagatcattacaaattgttccgaataagtctaccagtaatcttaggttgttgtgcaactcagctagacatatttaggagaaacttacataaacataaaccacgaacttcatgttgatggatatcaattaaagaactgtgtagcatgcaagagtcaataaaagaaatggacatacctggtagaacgatacaatgtgcacaggtgatatcatgttaatgaacgcgtagccaacattgcatttgttctgcgtggggaaaatataattaaattctgctgggcatcaaaacaagtcactgcaaacagcagtacaatacaatacaaatctagtaccttgaaatcaattggcaggtagaaaaagtcataggttcctttatgaaactcatcaattgcagccagcagcatcttagaagtgtacctaacaatttaggagctgagcaactatgtagtaatgtaagatcagaaaagaaaatgcaatatcaagccacatacatacttgttcggaatatttttaatcatcaatgtagttcgagtatcatcgcctttacggatcttctccaaatcaagctggtattgcttcttgctatcagcttgaaacacactgctgtcaactcggcggttacgaccacgttcgatggaattgtcaagtccaaaagaaccaggcccttgatatgtgggattcccgtaaaatgattgtcccaatctaggtgatagtattggtctaaagctactagagttattgtctgacatgtttccactcaaagcagaaacagggtttacagaagcacgagcagccatgttcagcatgaggccagttccgtttcggccactaccaatattcccaatgttcccaaacctgacttgattcatataagacgtctctggtgattcaggtaaaaatccaaagtggctctcaaatggagcacctgaaggggcagagccaacatgatgatgatgaagctgatcttgagacccaaaaagtgaagcctgacggccaccatacaataatccctgcccctgagaacgggtattagatggtattgcatgaccaattgctggtggacgccaaataggggattgagcatgttcagaataaggctttggactaccccatagaaactcaggccctgttaaagtcccaggacttgaactcatatgttcacttttgtgatcttggtatgaatgggaatgctgaaatgcagcaccgtggggctggttgttgtttgagaatactttgtcatatttagaccagttgctatccttcccgattggagcaatcttcacagcattcgatatcaaggaaggaggcatcccaataggactcatgccatttccagttggtgacgcattgaatgcttgcaacaaattgttatcagttggactactgtattgagcccatgcccctgacaggagatgatttaacattcataagttgtaaacaaatagacagaagcatattaaatgtccctaaagtagatccagtccgagtacctggaggagagctggcaataggtgaaccaacatgaggaatcctgtagcttctgggttcatcctggtctatatcatgaccaagctgctgcatcaagctaaaccagaagaaaatgagaataaatcagatcagtgttaacaaagtgaaacattctgtcaatgataattggtttgcacgataactgaaaaaacatgccttccaaaactcaaacagtaggaaagattggttccatggcataaacaattctcaagttcaaatttgtaccactaaagctcataataaactttaatagcgctgaaaatttgcaatgtaccatttgatcatttattataccatttttgtcctccatttgccttttttctgtttttttccgtttttgtttattttcctagcaggagaggcaattgaaaatgacgatgctagatcaaatgcaagagacggaaagcagagcagctctagccacgaaagagacaagacctgtccgctcaacctgtctgtttgtccatccactcccttggcgatgagcgtgatttgttttgcgcggcatatacagcaccctgggtgacctcctaaccactgaacccacacttgcctgccgcaccactatctacaatcatttcatcgccaatggccaccaccatgtgccctgcctctccctctccctctctcatgaaatcgtgatcactactactatgcatgtgtctgagtgaatctctgaattggtggcccactgtgggaatcagatgatgggaaacggtgtccaatgacaacaatcagtggtgcagttggagctttctccatggttgaggtgagtgtggttcacaagggttatttttagtctgagttaatggaaacattagttaagtagacggaaatggtattaaaaagaaacggtgcaaactctcaatggtattacgtgtgaactttcaatgtcattaagcatttttcttaaattaatcctaggactaaatgagcatatccacaagcttgaaaatataccttcaggaaatagtgcactgcccattaaataaatcagggagacagggtgtacaacaagctaattactttcaaaactgcaagtatttcgttgaaataaatgaaagccaatcaactgaggatgaatctgaggtattctactgctgatgaaatgataaaactggattaaaacaatcagattgctaatagcatcacgaggatgtaacgaaaagccttaacaggcatgccttggtcagttaaatagtgcaatttgatacattaaaatatttgcatacagcagataaatcaacataactgcagcatcaatagatcatcccaaaattggtgtataaattcagtagggttctactgcaaagtgcaaacaacaactcaagactatgacagataaatggatagggaaagaaaacgcataatcatactttctgcgcgttccaccaggacgacttggttccaactttatgcgttttccagctatctcgcttttattcagtgaccgaagagcagcttctgctgctcttacatcatagaactcaataaacttatgatgctttttatttggtgtctctcttatctgtggatagaaactaacaccatcagattgaattccaaaaaacagaaacaaagtatacgaagaacgtaagaacatgcaattttcaagcaaaaacatatttcaaagggaaaaattggaagtaacatcctaacctcctttacttccccatatgttccaaaaatctggcgaacttcttcattggaaactgagggatccaagttaaaaataaccagagttccctggtttaaatctttatctgatggattctcctacaaaatcaacatggcaaactgctaagtactttatggtaaagggactaagcatttgaaagtgaaccataacataataaaccttcgggatggagaaatgaatgtccaactttctcctcctcagaggcttgttctgcaatccacgcatcgcaccacgtgcagctcggatatcaaaataagatatcatcacaaaacctctatgtttcgttgcagtataaagtgttcggatatccccatattgctgaaatacaataatggatattgtaaagatcaactgagatacattataagagaagtgcagacataacactgactatgagttgattagacagcacataaagttgttcagttgcaaggtatacctactgataagtaacactaacaaatcaatctcagatggcaataattatataaagctaacaaacattgcagttattacctcaaaaagtgagcgcaattctgtgtcgtcaacattgctattgatgttcctcacaaacaatgttctagaagggtgctccccgtatggatgctccccggccacagtgctggcactatttgacggaccaaaatggttgaccccattgcctctaagcccatcagctatacttgtattccccaaaccagctgtgatgctctccacagggtctgtgtccagctccatgccccctccactgccaaatacatcaaattcctccagttcttccatagaatttgtctgcccagcaggctcaatctcatttgtgatacccgcgaaaagatcatcttcattaggcaataaatcatcgatttggcggagatcaaagtcaaacttgtagtccttcccttcagggtcatcatcgagctcttttagttttgcagaagcatcatccatcaatggggtgccacgtgcagaatcaagaaagttgactgaaagagggaaacacacattatcaggaatatcaatacaaactagggaaattccctacacaattttgcacggggtagttaaattggatttgctatagagctcttagctcctattttcatgtatgtaattatactttatatacagcagatattaaaagtaggtctggattcaatatacaactcttttcttcggattctatatatacacaatggtactttttatacgactattgctatcaatctacatggttataatttggtcccacaatgatctaacggcttagatttttttctcatattaatgtagtaatttctaggcctccaaagcaaaggtggtgcccccttttcaagctatattcataataatatatggatatgagccagtgctacattacattacagaagaaaaggttggattcatgtgatttttggcatgttaaagatgggaattttttacaataaatggtggtgtgaaaccacatatttggcatttggacacaactaattccatttgcagccttccctcgtatctcggtccctagtgtcattccctcttccaactttgctttgcacacatcacaattaaaatccctcagtcatacctatgtaactacagtactatagccaaaaaataaaaaataaacaccctactgcaccaatgagcacatcagttgtttggacagcaagctatttccagcatgacatgcacagactagagcatgacatgtcttatgagtgaaagtggcatacttttttcatgaggaaggactggcaaagaggtggagaagaggctggcatttgccagcccattgcgcgcattcatcggtggtggcagagggtctatccatggactgttgtttccagccatgttcctcatcttgactgcagggggaactgcaatccctggaacaagacaaatgcatatagggacagcgattaagatccagtttaccagagcaaaacaccgtttacctggaaggtggagtacatgtcatgatacctcgtgagttgaaaggatcttgtggtcggtccatcaccacatttgccgaagggatgcctgcatatcagagggtatcatgagctaattttagcattaggattatccctacctataacagattgaaataaacaaatggggaaaactgaatctttttactttgttacgtttgcaatgcacgaattaaacaagattggcagaactgatagagcatttttacatttgaagagttgaagtacaaacaacacatggcacatatggttaatgtgcctgagagcaaaaaggaagcaaaattttatcttaacttgaggggcaaaaaaagaaacgaagaagggaatagatttcatcatgaagcgagaagcgctgcagttgacaagtgaaagctgtgaactttgattcaaaagagggcaagcaaaagagaaagaaagatttcaattgcctctcctctagtttctttccccttcctcctctttgttcaccttgttggcttccctccctcacatatcactctcaaccaccaatagtctagaggagaaagtgaatagaaatcaatacttagcgcttccactattgctggttgactgctcattccttctctacccctgcggttgttttcctcttctggggcttttgtgaccatttattaaggttcaatatgcagttgattgattgattgcctatttttcctcaactaattcatccaagcactttaacttctccacttggttagtcgtcatcttcgtcgtcgtcttgggatattaccaggtttgttaacatgcttacatttgcagacttgtagattgatcaatcgtgtcacggataccttccatggggggtaatgtttgttgctttcacttgtcagttgttatagcaattctcatcaccccaagagaaatatatgccttctttttttcttttcttcccccaagttgatatcaaaactgttccactcccagccacattgaccataccatggcaaccatagtttgtattgcaactattcaaatctaatcacacgctatcagtaccgccaataaaagattcaattccccaattcatttaaatccgttgccacatcgttgcatcgcctcacctccaccccttttccccaacagccaagtcttgcccatagttcttgcaactattcaaatctaatcacacgctatcagtaccaccaataaaagattcaattcccccattcatttaaatctgttgccatatcgttgcatcgcctcacctccaccccttctccccaacagccagtcttgcccacagttctctaacgcgtagcatcgtttcaacagcccacttccccggcaatccctagtaagcgccaagcccataaccgcgtttggaggcagagaacgaggacaaggatttgaccttttccctgtttggtattcgcacaatcttttgaagtcccaactagatttctaacctaaagcttcattattccattcagaattctcgctatgcagtgaagcatcactagcgtctagcgaagactagcaaagaattgggaagtgccaaaaatggaaaccacacatgtctcctgccctgcctccggcgaggttaggattagggtttcggggtggggtcgggggagatcggggtttagaggatcgccgtggcggcgaggcggtgctggtgccgccggccacgggtcggaagacggccggcgaccgggtgcaacgggaagaaaagttacggtgaggggagcggctacgagaaagagcgcggcggcggcggcggcggcttccggtggtggactcgggtcggcggccccgcgccgatggtggccccgacggccacggaggttggggaaaccatatgaatatgagattagatgagactgaggaggagcagggagctcaccggagttggtcgccggaccacgccggtggtcgtcggagcggcggcgatcgtagccgggggaggcggccgccgatcgacggggatacctaggggagggagggcgccggagctcgctgcagactgcggccacggtcgtagggtcgagccgtcggggtggtggtggtggtggggatcggtggtgaatggggatagaaatgggtggggaggagtgttaattggatagggtgtccaacccgttaagaagacacggttgttgattgacccgttagaccttaaccaagcgaaaaccgcggtttcgggggaaaaaagcatatatgttgcacaagtgggcccatttgtcaatataatactgcaaattatgtattgttaggtatttaaattgatgaacatgagaaaactaaactgcattgataatgtttttttagattgaaatcttccggtagccttaacctgctatatttaggctgtgttcttttcttctctttctcaaccctttcagttgtttaacctattaaacggtgtacttttttaaaagttttatatctgaaagttgctttaaaaattatattaatctatttttcaatttaaaaatcatattaattgtttgcgttacttaattaatcttactataatcacgtgttttattttccgtgtttaagtaggcttcattagtaacgcaaacaatttttcgtttgcaaccaatgtgatgcaacatatccaatagaagcctggaatcttgagttttttttttcttatcatgaataagatgaaagttgctaagtaaaaccctcccctaaaattaattttaaaatcatattctaaaactcaatatgaattatagtgttttagaaaaagtacgaatggacaaattgttttatactcctaagttgttaagaaaagcaaataaatttctttagtacttcaaaactacttcctccgtttcacaatgtaagtcattctaatattttctacgttcatattaatatgaatgtgggatcctatatgtctagatttattaacaatcaatgtgaatgtgggaaatgatagaatgacttacattatgaaattgatagagtacttcatattactcctaaataatattaaattgttagaatcatgttttgtagtctaaacttaattagcaccgtagaaaaaggacgggcagagagctcaacatggtctacggccgagaaaacgatgacagttgatgggatcaatctagtggataaggataaaaataactggagtgctaaatgagttgggttttcagtttttcacccgatatctataaaaggacaaacgggcgaaggctgcacccgctaggctttccccgatatgggacgattttttaggattttgcagtagtggtagaaagaaagcgacagctatgatgattggctccatcgttttgctacctgccttttatcctcagaacctcgatgacatgtgggcccggttctcggggcccacctggcactgcagttggaggcacttctatagggtggattggaatggcggctggcgtccgcggccgctttccttttcctttccttgtaaagctatcctgctttccttgctccctctggttgtcacgttgtgtcattgtgtgttccattgtctcccctaaaatgcgattatatatacagtacaatgtaaaatactgcgtatgtaatactttatcaattacacgagggacgtgtatgttactacccatatacaagtaacaaaacacacgcctaattaagttgtaattctacattgattttttgttagcatgtttttcaaactacaaactttctaagtcccattagttgctcagagccaaaatttaaatttaaatttaatttttttaaaaaaaaattgaagttgattttaaatacatttaacgtagttctttttttatattgacttttaagtcactaagaacacatatataaattttaaccataaattaattttattccttaataaacagttttagtttgttagaaaaatatagtcaatcaataaggacctctatatagaagttgttctaaaatagcaaataaatttatattcaaattcataataattaaaactcaattaatcatagtctatttccgtatcgttacttaggttgtgtttagatggaggggtgtaaagttttagcgtgtcacatcggatatacacatttgaagtattaaacgtagtctaataacaaaataaattacagaattcgcctgtaaaaccacgagatgaatttattaagcctaattaatccgtcattaggaaatggttactgtagcgctacattgtcaaatcatggcgcggttaggcttaaaagatccgtctcgcaatttatgcacaatctgtgtaattattattttttcgtttatatttaatactctattcatgcgtcccaacattcgatgtggcagagcgtaaaattttgccaagagatctaaacaggcccttaatcttaattgtttatcaatctcgaacgtagacaatttctcaaagatgcggatagccggataccagcaacaaatttagcaggataacgtatttacttgtatgcgcatgagctcatcattctgaccggccgggccatgttgatcatcgatttcatgcattatattggctgatgacctcccttatccaatcaacacgttacacatgcatcatcaatctcctgctaattatatttaactacgtacagtacatctatgtgatgattgatgtcctagtagagggagtcctggatcagttggcagaggagctagcataattaagccatgcatagatgcaaggttgcttcgctgactgactaatcctgtgcttatcagttgatgatacgaaactactacgacttggagggccaactgtaccgtgtcaactccggttacttctctaagcactccttaaaaattttcttttatttagcttgctctgccgtgctgtttggtttgtttgaccctaggcattaaactgatgcctagcctaaccagagatgtttgattcccttcatctatctactctactgatttcattccatgatgattaccctgatgagttactgactgacatggatgaaaattttataggccaacttgtctcgaatgcctccactaatcgccaattagcagggcagataatctccccaacaacgaacacaatcatgatgcactgatgcacggtctgaagctgcatggactggaccactcttgtgcgtatgttcagttctgcgcttctgctatcgcatctgaatctgaatctgaatctgcctacagtgtgcagctgctctacctcacgtcctcacccggcagcatcggcagcaggcccctgcatttgtatgtgaatccaggacaagcttccaagcgtttgcttatcaaagaagctgcaatctatccatccatacatatgcagttgaacgtcgcattcctcctgtgctttcttcgaaaaggcgataagtcgcgctccgttgcgtcaccgatgcctcgcggctccattgctgcgccacaggcttgattctccctctagcttccggtacatctttacgctagtgtcatcgtctcaaaaggcaaaggaccacacgatctgaaacgtaagaacacatcggaccacaaacactagtactactcttcaattttctctcttgttatatagtactgtacagcactgatgctcagtgcaagatgatgtataattggtactccatttacctacgctggatcaacagttcttgattcgatagaaaaagaaaggaaagcaattgcactgaatatgctttctcaatgatgatgaatttttttccgaatatactttctcaatgatgatgaattttccttttgggaagtacattaacaactactccatccgttgcacaatgtaaatcattctaccatttctcatatttatattgatgttaatgaatctagacatatatatctatctaaatttatttacatcaatatgaatatggaaaatgctagaatgacttacattgtaaaacggagaaagtccgtagaaacagagatggcacaacacaagtggactggtggaacactggaaatgatgcggatcaaaacaacttcagggaacgagagaaaacatacccaagattactttggtggtagctggttgcctggatgggtatagtgacagggaaaaaggaatgtactgggtggttgttgatgaacgtgagacaattccaggatatatggattaactgaagaacggagaaattacccgttgaactggccaattgggtagttgtctcttccagctagctatagaacaaagggaatcagctcggtttatttctcgctggtttgtagttctgacaaaatctgttggacatcaatccactctaatcgtacatttcattgaggcacataaagatgagttgggtacttgggttagacttagagagagaactggaaaaggagttcagggactttacttgggctcgctcctcgcggacggtagttgtgaggtgtgggccgagattaaggcccatcctcgaaaatggactcgtccctacctcctgactaccattcaaatacggtacactactgactggacaatttttttgagaactttgaacttcgccagaacatcaacgaaatgtacgatgagagtggaataatatccaacaatttttgtcagaaatacagaaccagcactcagcagggaggataagggtgtgtttagttcacatcaaagttggaaatttggataaaattataacgatgtgacacgaagttggaaatttgtgtgtgggaaagttttgatgtgatggaaaatttgaaagtttgaataaaaagtttgaaactaaactcggccctagctgattccctttttcttccagagctgaagagaagagttcagattgcaaatgtgtcagaactacagactggacaaataaacctacccaattagccagttcttctggatagaagtagattgcaaatgttcagatatgtaagattcaaaacaagcatgttgttaatccgttatttactatgttacgtgattgttcatagcattatactacaccactttaatactttataggtacacaccaacatatttccggcatatttcccaacaaattcggttgcatacacttttgacagtttacaccacttgctacactcccccgaaaaatctcctccagcacggactcctcaccacctcctcctccacctccaccgccgctggcggcggcggcggcggcggcggtggcggcgcagccggcgactctccccagatcccctcgaggacctgatccaggctggcggggaccccgcacgtgtcggcggcgtcgggcgcggcgagcacggcgtcgaacacctcctgcagccccaccacgcggcgggtcacggcgcggcgcgcctcccgcacggccgggtagtaccccgggacggcgtcgaggcggagcagcacggccatgagcgcctccgagaaccgcgcccgctcgcgctcgtcgccgcggacggcgtccactgtctcctgcctccggagcagccgctccagccgcgtcgcctcgtcgtcggcgccgcggacggccgcggcgtgcctcctcaccaggtgcccccggaacgcggcctggatcctggccgccgccgcgtcgtccggcggccgctccgggcccggggtggtaaccgggatccgcacggtggtgggcctgtgggtgtcggtgctaccagtacccttgtagctggagtactccccctcgccgccgccggcgaagaagaagtgggaggtggaggtgtagtggtaggagcccatggcgccccaaacctgtgctttgccaatagtactatctggaatctggatgctgcgcagcggcgagctcgcgtctttgggaaaagacgggggcgtgtgctttcattgcttcgcgtacaggtacagcggcttcaccacatgactttgctttttttgtgcgatttggaacggatggatggtttcgtagatcagggcgtgttgggcgtgtttagttaacgttaaaattaaaagtttgattggaattaaaacaatgtgatggaaaagttaaaaatttatatgtatagaaaagttttaacgtgatagaaaagttaaagttgaaagttaaaaaaaaaagtttagaactgaattcggcctgagttggaggagtgcgcttattagccaaagcagtgcggccgtgacgccgagtcgccgacacaattcaccaacagtcgaatccaccgaaagagaccctggagctctccagaaacgtgatctagacgagcccccaccgaatgcgacggaatcaaccgcgcgcgggcgcacgcgcgatgcatcatttagatcattgcatctggatacctgctgatctgcgcaccaccatggccgaagtttcaggagccgataaatgttttgtcctcgccgcgttgttgttgactcgagccaccactggtagtttttgtttgctgcaacaacggtgagtgactgactaacacatggtttctaacgttttctccatgcatttgttttcgaactctcactaataaaccattaatatatctaataaataacgttaaaacacagcatcaatttttgggaaagtaatgcaccatcaacattcaagcccacggctccagggctcaccggcgcaggcttccatctaaggatctggcagccctcaaatttcttcactggtttttactttcgaataagttcactttagatccctcaatttatcatccaggttataatttgtctctaaaccgaaataccaagtataactcatccctcaactcataataccgtgtcaactttagtccttcgatggtatagtggccggtttttgctaacatgacgagtggagcctacatgttagcagcgaactcttcattctcctctccctacatgtcagcggtcaaacttaaagaagtttgactagaaaaaaaaacaaacgatttataatataagacggagagagtacaaagtataaagttaacatatagcttggaaaaaaaatccaagtgattgataagtaaaattttagagaaatcatacttttcaatcaagatagaaataattagattaattttctacccatataaacacaacttaagatacatgcccgcgtattcgcgtgggctagttcattttacttttactgactcacgcacacgtcgcatttaacttacaacgacaaacgactcaaagctagacaaaggctatggcagacccaatttgcagagcagctgggtgatcaatcggtccccaacaacacacactggcacgctacttataaaatgcaacatcgtgtaccacgagccgacgaacggataggttcagcgtcttgccttcaaggagagcacaatgacagggtacttggtcttcacctgctcgaggtgctgtgctacgttccgcgcgtacatgtcgaacaggtcgtccactatgcacctcccgaaatgacgagcgatgaggggctcgagcacggccctgatgcacctggcgacgttgacgccgctccgaacgctgtccagcgtcgccacgtcgtcgtcgtcactgtcgtcctgtggatcccagttggattcgaagagctggatgtggcttatgtcgaacagcccgctctgcctgatcactgccttcacttcgtccaccgatggcgagtagaacggcaggttgaagctgtccagcttctcctcctccacacgtccctgcatattagcaacaagatcaatcaaatgtgttcgtctcagtactacatagagtgactggttcaatgtgtttgtatatatacctcttggactagggactggagagcttgggcaagaagcccatacatgtagctcacttcgccgcggagcacgtccctgttcttcctgcccaggaacgtcagcaccatctggccgccggagacgagctcgtcgtggcgtagcgccaggaactgcgagaagtcctcctggaactgcctctggtacagcttgaccaccgacggcggcgtggtctcccagatgtacatgttgcccgcgttcagcacctcaccgctcgctagcttgtcaggcacctggatgtatgttctcatgtcagtaagaatcgaacgcaggagtttctctcaactcgttacgggaaatgagtttgatgaactactg

SEQ ID NO: 54191 - DNA, 5899 bp, Oryza sativa
tacagtagttcatcacaactcgttacgggaaatgagttacgtatagctagctcgatcatcattttcttttcctaattgttgcgctgtgtttaattaccttggagcgccacatgaggcagtaggaggagtggaagaggtggacggagcggtcggggaagagcctggtgtagaaagagcccggcaagccggcaatgtagtagggaggcagagccttcccaaactccatctcggcgagcttcttgaacagctcgagggactggaacacgaggttgaagtcgttgccggggaggtcgttgaggaagaactggacgtccgccaccagcgaggacttgtggtcgcatgatgagcggttggccaccgcgctgagcacctcggagacgacgaggagagtgttgggccccgacgagcagccgaggtcggccaccaccatcttgccgcctgcaggcgcgcgggagaggccggagagcgacgcgtgagcttcctcgacggccttgtgaagcagcggcctcgtcttcaggatggccttctcctgaacaacatgtcaagcaaaatcaagcatgcattagcttcattcggtataccagacgtgtgcaacattagttgtgttggttacttcctttatttcataatgtaagactttctagtattatttacattcatataaatgttaataaatctagacatacatatatatctagattcattaaaatctatatgaatgtgagcaatgctataaagtcttacactgtgaaacggaggaagtaattgcatgcatgtgatttgtttgatcacacggatttcacagtagaaagggactgcatacttgaagccttgagttggcggcgtagctggtctcgccgtcgccccggctcatgtggaggtcctgctctaccttcatggctaactactagctagagctagctgatcaagactaacgggtagcttgctctggagagaccaggttaactagctaggtagtaattcgttacaatatatggcttttgttcgctgtggctctttgcagctgaagagcacgagtacttgtcaatttatagggccagcaggttgtgttggcggttaataagtccattacaagtacgtacaatttctgtgacttgtttctctcagccttggtcggggccgggtggtctcgtcgacgcgcgtcgtcttgtttcacgctagctcatgcataacatgtgcttcatcagtcgacagtcatcactgctcatcaatgtgtaacgcactaacgctcactatgaacaaaagaaaaaagataaatccaacttatgaacagcactaatactatattaacgctcacatttatctcttttccccctcaatgtgtaaaaaacctgaaaaatatatactctacactgtcacatttattcataatttgaatgtgtagagtatggagctagagaggaagaaagagatgagtattttattaagttaccacgtcattcgccacggggaagtgcgatgttggatagccaaaccagaaccacatgaattggagtttcaaaaaaaaaaagaaccacatgaattggggagcgggggggtataaatgtacggattgaatggaaggtgaggtgtgtaatttacctaattttcgtagttgttggatattacaacgtacttttacaataattgcgaaggtaaatgagattaaactctacttatttattccgaacttgtttataaactatagggaattacatagaaattaagatgagttgttgcagaaagtgcttcctgagtccatacttcaacgtctcacattaagatctacatgggttctctccatcactccaatcaccctccttctttgcctccatcatcctcaccagatgcgatgagggaggggatccgtctctcgtctaattttaataagctcttaaggtttgtgttgaataaagtctttagcaattagatctattaagtcatttaagggtttgtctaccatgatttttcatggagttagggttggtcatagtcttttttttttgttaaaacaacccgcacaagatagtgcaacgtttgtattgatatagtagaaataaaatacaagtctatagtcctagaagactatagtcaagaaaaagaaaaatacaaccaaaccacgcgtctacgtctgatcgatcttgctgctaaaaaaataaaacacgcacacaacacccctaaggaatggatcttctaacgacgcctccaagaaggaaacggcgccaagaatgccgccgctgcccatcctagagaatcaggatatggttttcacctaaaaaaaccactgggagaggaaaaaaaacgcaacaaggacccaaggagaacgcggcgcccgcaggcgtcgccatagccatcctgaaggctagatcttcgcccatattttccctactctcccaggttattgagtgcctgttagttttgacaatcaccactagctaatcctcttcaacgcacagccaccacgccgacgccttgtcgccggccggctatcaaagtaggatctcgacctccggtgcgctccagatccatccacatgggtgggttggagaagaagatggtgagagagaagaatggatcccctctcccctgtactagcccgtccaacgtggccatcttgcgacggcaagccgccactgcaagggtactaacgcttggaaaggagctcgccgtagccttcaaggaccacttcatcctcgaccaagctacccatgtctctccaacgagtcgcctgatcgcatcgttgttgcgtctgtcctcataccgcagtagcctcgccgccgcatcaccctaggcctggcatgctcccaccccgacaggctcgccgccacaccgctccagcctccgcgtcagcctcaccgcctccgcagcgcactctcctcgtgccttgctggcctctcgctgccggtcgtgctcctccgtgccacgacaacttcccctcgggagctccaccacaagcctctgtgccatgctctgcatgcgcctcgttggccacccaccgccggccatgcgcctcgtactaagccagtcttcctttgggagccccacacccagcagtcgctgcctgcttctccccatccccgttgtcgtctccaccttcctccaaacattggcaattgcccttcgtcgatgcagcgttaccgcgctgagacattgcatcgctgccgaaattggatatgggagcaccagatctggcaccattaccaccaccttcgcttccgcggccgccctccacagtcgtccatgcatctgccttgaggggcatcagatccgacttgccctttccgtgtctggccgccagggtccggctaccgccgtgcaccacttcatcctcccacgccgaggacgggcctcgtcaggtcttcttgtctctgcagccgccttctcagctggctgctccgccttcccagctggtcgctcgactttccgacggcgaactccgacggaggcgaggtgtcaaggttgggtgggaggtggcggcacgggcggctagggtttcgctcccgagccactcgcacaagagtgatgcgaaggcttcagttctatctatgcgactcttttttgtcatagtcttttgttttattttctatttctatgttgttgtctactttgtttgcaagaatctaaccagagacataggaatatttgtttatcgggttgctgattacataacatgtattgcttcattactaattttaaattttataattttcaaatgttggaaaaaaccaaaaaagaaagagtatatgacatttccaattacatgttttatttaatatgacatacttcgtagaaataagctcgatcaatccaatcaacaatgatctttctggttaatatggaagctatgatttataatcttgattggttagcgaatttcgagctgtatcgatacgttgattttcacagtttccaaatgaattttaaaaagtcaaaacaaaacccccattcgatatctaagcatgctcgagatgttcaaaattcacaaaaatcgtttggaattaataaagattgtgaacactggtgcaagctcccgcaaagtgctactccaatttagtagcattggtatggatgcaggtcctctgcagtactgcatgtgcagtacatgcagtactgctcactgacatgtgggccccacagcccctcgggcccagatgtcagtaagcagtactgcacatgcagtaccacagaggatctcaattgcatgggtatagatgtgggagaaaaatagacgtaagcagataggtcacctagtaagatattacttagttccttgtctctatactgtgcgagagtcacagatttgttcgtcttttggtcttttggtctatttggttcagctttctttgagcttgtgaaagaaaaacgtgagcacacgagtcacatcacacgcccccatctttcagtcctttcatgtccttggctccccgcatctttcagccatttcctttcgtcctagcctcctggcatatcgtcctaggctgacttgctcggccgccgcccgtacagcccaaatactcggccagtcggcctggcaaatgaaatatgcttgcttgttgaattgaaattgcgcttgagttgtatgcgtggtgaaaaattctctcactatgcttacgcctatcttgtcaggaggcaggcacgtaactttgcttagtttcgcttgtcgcagtctgcttattagtgtcatactcgctccattcctaatcgatcttcatatatgatttgtgcatcaataccaagacaatcatgtggagcacttaatcagcatcaaaaacatacattagcgtttcgtatccgtgaatgtaacgccatcaattttacatgccgtgtggctggccaatcagttgtgagcgtattaaatcgatgcatgcagcggctcctaatcagttctacatgccgtatagcctaaccaatcagatgcatgtagtgttcgttaggaagtgtcattaacgtccttcccgggattttcatctcctccccaccgtaatgcgacaatcaaaatggaattattattttttttgcaatacgatgatcaaaagggaacggagggagtacttgcttattagtgtcatactgtacatgacctcctatccccaacaaccgtctccgcgtattaccgttgtatgctactcttttctaatatattgacgtgcaaaatttctgcacattcgtggaaaaaaaacacacgtccttgatgataagagcaagttcaatagtatagccaactactggctccaattcatctatagccaatctaatacatattcatacaatagttacatactacactatcaataactggtcccacctgtcatacacacattatgtattggagtccgtattacagctggctataaatctgtagcccgctacacttctctctcctcatttatcttcttaaaatatatttgtagctagcttatagcctgctattgtatctgctctaacagaggccagaatgttcgggcctgatccccacgaggccaatgtgtgtcaacatgctgtagctgaaagcctgaaatcaacaatgccttgcacgcgttgttgaccaacctggacgcgtgcgccgcttgtgcaacagtgcaagtcagtttcggactcaccgcgcgccatgcggttgttgactgttgtgaatgggggtagaaatcgcccgcgtagcagccgcgcgaagccacggcgagctagcgcgcgcggccgcggccgcggaacccgccgtgcgtgtgcgcttcgccggatggtagcgttcatgcgcgtgaaaccgctgaccttgggttccatcacccacgcgaccttggccggccgtacactggctgcgcacgcatcacttcccgtccgcgattggaaaaagtacgcaccaaaggtccctcaacttgtcaacgagttataaaattgtgtcctaacc

SEQ ID NO: 54192 - DNA, 19738 bp, Oryza sativa
cgacatcccttaacttacaaaaccgtcaactttagatccttctatgggtttgatcccggttttatccgatatggtagctgagccagcatggaacccacgtggaccccacatgtcggtgtgtccatgtcagcacctactctctttcccctcttcactttctatgtttctccttccttcctccctctcgctctctgctttcacacaggcatggcactagggttggcgcccacggtggcgcgcgcggctaaagggtggtgcggctggcgacggtggctcccggggatcttagcttccccaggtggcgacacacgggctcagagcggcacgagctcgccggcctccccgcacccctcgtgtgggtcagctggaggggcgaggcaggaaagggcggccggcgacgggttgggcgcaggcgggcgccgcagtgatgggcacagaggtggaaacaggcaccgtggtagccgttggtgagcttcttagaggcaacagacaagcaatggaggagctggaggacctcgacggtcgaaccgaagccatgaaaggcctgcaccaagatcgattcaacggcgccgccatcaagttgctgtcgtcggtgatggcggtgcacggctacggcggcgggggaggcggaggagacgacaccgccgcacgcgtctgcaccgtgtgcctgctcgagtttgccgacggcgacgagctccgcacgctaccgctttgcgcgcactcgttccacatggactgcgtagatgtttggctccgtgcgcacgcttcatgctcgctctaccgcaacgccatcgcactcccatccccggtgtgcgccgcctgcgcgtgtgctagagcctcgatgacctcctcttcttccaccccgtcccgcaaccactccacctccatgcccaccgccgcggcgcctgcctgctcccgacccgccgtcgccgccgcgttgccccttctctagtgttgccgatgtcgcgccaccgcaccgcccgtcgccagctgccctttcccacatcaccccaccgcctggcccgtatgaggagaaaactgggaaagagagagagagaaggaagggagagaagagaggaaagagatgatgatgacgtggtcaccctgacgtatggggcccacatgggtactatactaagtcagctgtcacgtcagacaaaactagagtcaaaactatcgagggttctagtttgcactggttttataagttgagggatgcgttgtatccgattttacggttggaggacgattttgtaactcgatgacaaattgagggaacttcggtgcacttttttcgtccgcgattcgcaatctcccatgggccaaaggtagtgggtcgtgatgggagcgttgggctataatccctacctggctgttctctcgtgtgggcttaccatcgcataaggccggcttgtttcctttggtttgcgttgtcaatggtagccggcccagttattgcccggttggccggttatcgacgacgacgaatagcgtaaaagtcaagccataattcgatagattttgatgaaatttctgtgaaatttgttgataaccaatccgttatcgtgataagtgtggtgttatcgcggtagtagcaacataattccttctctcttttcgcgtgctcaccgttcctcggtgggatagcccctgaagtcatgaacacgtcggcgcagcccagcagcagaaagttcatctaagtggactctggttactattgaaatctttttttcttataaaaaaaactacaaatacagacgcttataagttataacacgttcacactcacctcatgatgacacatacgtacacccgcatctcaggcatagcttgagattaacgaaatcagcacgaacatctcactatcgatggtatgtcacttaccactaaaataataattagtcgtaaatgcgagtacttatattttcatcacaaagaaatatatttagttaagttatgtttacttcgcgctactgaaatctcatctagatatttttacgagcatcgtatcgtagtaacggagtggagcactcaacgtttggctcagggccgtgcacaggggtgtgcggcccgtgcgaccgtacagggcctgcaaatttctagggcctcaaaaaatcagcccaaccaaagaaggcacatgtatttgtatgaggctagagcgccagaaccccgttcgagtccgcgcgtatctccgcgtggcgacttcgcgtgcgtggcgcttcgtattctcaacttcgagccccgaggccccacaacgttttgtattctctttcgttttcgtatctgtgacttattcaatttgtctcgagtctcgacgtctcgtctcctccgagcaccaggccgccagccggctcatccaatttcacattttcattcaactagcgaatagcaacttagcaagcaaccaacaagcaaggcactaggcagcaagccagcaacatcaacaaacattctccgttttcagtttgacagtttctaattatacaaaacaagagttaaaaaatatactattcttgatatatcacatttgttttgcagtatatatattattttagctatatttggtacttgatttaggcctcacttagagccttgtacagggtctacaaatttgacagcacggccctggttcggctggatcatgactcatgagaactccggctcacctatttcaaaaccagaaaaacaaaccggcggtccgcgtttgatctaggctgtgtttagatccaaagtttgtatccaaacttccaacttttttcatcacatcaacctatcataaacacacaaactttcaatcacatcgtttcaattttcaaccaaacttccaacttcacagtgaactaaacacagccataatcgcattccaccattcctattcgcgaccagaccacctggaccatgcgtagcgtagctccctgccatcctgccactgttgagtaccttgcagcaggcaagcagccaatctggcaatgcctctgtctgagcacatccatccgattcaacctcgactacttgtttcgcatggatccagatttttacttgtttggcatggatggatccagaatttttacttctagccgacgacgacgagacgggtcgagatcgatctcgtggtactacagtaattttgaggccgggaggcgctgtgctgccgatcaaaccaaaaaaaagaaaaaaaaacggagtcaaaccaggcaaccaacccggcaagcgcggcgtctctcgcccgtgtgtgcgtgtctcgggcgtgatgcgagccgcgttgtgatgcgggtggttggcgagatcccaaacaagggaacgcacgacgcggtcgctgcgcgcggctgcgcctgcgtgccgaggcgacagaccgaccgaccgaccgatcgatcgaggcaagcacgcacgcacgcacgcgagcaaaacgacaggcgggcgtgcgagcgagcggagcgccagcgacgacgacgacgacgacaacccctaccgcgatcactcgtatcggccgccattgggtaccatctccgctctcagcctcaactactcaaaaggcatcatccaatgtacagtcctgtgcctactgctagtctgaactctgaaccatgagcgttcgtgaatccgttttgaaggggaaaaaacaaggagagcacaaactcgagcaccaatggggagcttttgaaaagctaaagaacatgggcagggtgctaaactttaagctctagccttgcatagttgcattgttttaggccagcatgtgtccgcgcatccaaaattaaggaactagtggtagcaatttactgggtagggatggcaattctagtccgatacccacgggtatcccacccgatgagcgtaggtttattttgttacccgtggacatgtttgatccgatatccaaaattcttttgagcgcatatgggttttatattatgccagtgagtaacccatgtcagacctgatatatgtgtctattgctgattttgacgcattcctatttcatttggtctctaatctcaacatgtacttatatatactcaacatatatagaactaatctaaacacaaatgcgtcttatatatagaaaattttccgaaccactttaaaacaaatgtgtctggatataaaaaaatactcaaaccgttttcacccctagacaagggatatcaagtcttaggccggacgtgttaatgttccgtctattgtctgatccgacccatgccacctctactcttacggagtactactctaccctaaaaaagatgaactgtagctataaatttgaacacacagccacatatccaaatttataactagaactttttacggaggagcactccttaggtacagtatattactctcctactcaccacatcatccatcagtagtcaccacagtactagtcagaagggaggcagcactgtggcgtggcacgccagacaaatgggccgggccccacgcgtcagccggcagactgcagctcgtaggttgtgctcgtctagtaagcccgtgtggtcatctcctaatgctgctgcagcgtctgatgcggtggtgggctggctggactcgaggaggactgggcagcagcgcagccgcagtgcaaggcaatggcaatggcaatgcagattgcagagagagcgaggcaaatgaggctggtccctgccctgtctgcgcaagtactaataatccgaccacaatttatgggaaaatcagacagcgacgactgcatgtgcggatcgtgcgctaagtttttttggttttggtaggactcccatccaccgtagtatcaaactatcaaacagcccaagtactagtagaatatattgtgcatgtatgtgtaggacgcgtagtaccggtgagaaaaatgctcttgcaggcagcagcgaggctgggggagtgatcgctctcgcacagtgacagtgccacagtggcacgcacacacagacgctgacacgcagctaggcaggccattaacgcctttgagagttctccaggcgatggcagtaaatggctaaatgcatgctgctgtgtgatgagctagctagcgcgcggggcttcaaggacgaacaggggaagaattaaatgaacagatgatgatcgcaagtggcagtgtgattcctcctggtgtggtagcattgtggcatgcatgtaggatgaatatgcaattccagtgaaggaatatgaaagtgttgaagatgcagggatatggcacaactagttaggaatgaaagaggcatttcttgccccttgggcaaaggacagcatccggaatgcatggttagagtagcagatatatatgccgcagcagagacaagatattcccaacccatgctacaagaatttgatcgtagattttggtatcatgcagagtcagagatgctgtgttctttgttcttactatgtcaccacacagtttaaaactttttgttctttcgaaaggagctcgaaaagctcttgtgtaaatatgttgtcctgctatgctacccaaatgccaaagggcaaactgtacccgccttgactcgtggtacttgccgagagcctgtacgcgatgctgcgtactgtttcagcagcatgcgaacgagacgggcattaggatttcagttagctactgtgcaccactgaccacactcctgtcatggaatatttacagctataactaagcaagaagatcgagtaattggcgcacgaaaaaagaaacatagaaatcatcacgctgttctagcttttgcagatcaccaacctcaattctcaccacaggaaaaacgatacagagatcaatcgaccaacgcgagcgacgactcatcatccaaaacgcgagaggttattcacatttcacagcgccctctgcaacaatgtcgccgcaaaggaaaaaaaagaaaaagctaaggcagcaaaagaaatcaagaaagcttaagctaacaccaaaacgatcgagaagtgaactaatagctagctaggaaatgataatatgtagtagtagcagtagtagactagtagtagtaatgtaggtaggaaatcagatgcctggcctgcccttgtatgccgcggaatggatacgttttaggccggtttaatccctcgaccgccgccgcattgccgtgtcaggtgtcaccaccaccaccagcagctgctgctcatcatctccgttctgcgagatggatcggagtaggaaggcggccatggcgaaggcgaggagctcctcgatgaagcgtcggtttgcatggagaagaagaaaggaggagatgtgtggtggtgttagagagagagagagagagagagagatagagggagggagctgtgggcgatggtgtccaggcaccggcagcaaggcagctgcgtcgtcttaagaaagagcagaaatggcatggagccctccaaagcatctgatggctggccctgtatgcgtatttatttatgtaggggctaaaggcatcttttcgcaagacgtacactgcacactgctctcattttttgcaagacgtacgctgcacactgctcttatttgagagagagataagagatagagagagcagcaacagcagcagcaattttttctttaaaaaaaataatcgaaaacgcagcaaattctaccactccctcagttctcagatgcataaggttcacaaaaccgtttgctgaccgaaaatcgctcagtgttggttttgtcagttttggcgaaaattgtttgaaaagagatggaattcagataaattgtcaaaattttaagattcaaattgatactccaacagtcaacagagtggtttgtcaactcaagccagctcaaaaccacgaaatgtcgtgaaaaccaagtggttttcgtcggttctatgaacctcaaacgtggaactggtgctcttcgttgcatgatgaggcagcatcgccaatgtgaaaagagaactgaaatattcatggttgatcactttcagcattctccaacggaacaaaggcattgtttagttccaaattttttcttcaaacttcaaaacttttccatcacatcaaaacttttctacccacataaacttttaacttttccatcacatcttccaatttcaactaaacttccaattttggcgtcaactaaacacacccaaagactgattaaaacaggtgtcatacccgaactgtgtttagttcacgctaaaattgaaagtttggttcaaattggaacaatgtgacggaaaagttggaagtttatgtgtgtaggaaagttttgatgtgattaaaacaggtgtcatacccgaactgtgtttagttcacgctaaaattgaaagttttgttcaaattggaacaatgtgacggaaaagttggaagtttatgtatgtaggaaagttttgatgtgatgaaaaagttggtagtttgaagaaaaactttggatctaaacacggcccaaatctgctagtagagcatagagatagattggtgaaaagagtactgtaaacaatgaacagggattcttgggaaaccagatctctccacaatattatgttatatacagctcatgaatggtccagagcagcagcagattacaaacgatgccagtacattttgacaggtccgggaaacaaagtgaagacattgaaatcaaagtatactaagagtacaagaaatgcccaactagtgacctatgtatagttttttccctgtcgtatgtatagagcaaaattaaatgaacaaacggcaactctatctatctgtatctgtatctatcatgctacctcaaaagtaggcttggaacagaagcaggaaaaaaatcacttctggcagcaaacgttggacaccatgacggtactagttccaccataataaaaccgctatcaggacagaagaacagcccgtgtaatcatcatcatcctgccacaccatttccattttctgctggcggggcatttgaaatagcatcatatgtggtcaaattggacatactatcagatagcgaattcacctcttctccctcagatgcagctgttattgaagcagcgtcctccgaagcaatatcagaagctgcatccgaagccatactagatggctctgattgttctgacgtttcagattgtgactgtggttgcttctgtagactccaatacatgatgctagccgtaagcgttaggatcatcttctgatttacctgaaacagaaacataagagtacgattagtcaacagataataaccatcatttttcaagataaaagagaagaggatcacagacaacaaataatgtagacagtaaagcatttagcccagatgctagataaattgctgaaggtaaagcatttaattccatctgtgatggtaaaagttgcacgctcaatttcatgcttattagcatcccttacctcaatgatgtcctctggcagcagaaacacggaacatccgattttccttgcaacactaatggtatatgtagcatttagcttcttttcctcatctgcagaattgaaaggaaatagtgaatcagccaatgctacggttttccaaaaggatacatatataaacagtcagaaattatcatcaaatagtaattcaaacgtgcatatgaacagaccatcttccccctttgtaacaactttccagttgacaaccctcggttgtactgcactaagaagttcaaggaaaaaccgtccatttgataagctcttgtcctgagagaagataagaaaatttattaactggagttatctaacaacaaattaaaactaattaaacagaaattaataacaccttgaagctttccatttgagatgttcttcctgatgctttcactttgctgtttgcccattttagtatatcagcatcagtaatttcttttccttgggatccttgggagtgggatctcagtctattcaacaattgaagcatattaaatctcatcaattgccacagaagtgctgaaaaacaacagatatggcttcaattgtgtgctaaacagataacatcaatcagaaaccactaaaaagacttgattcagtcacactcaccaacaatcaatttcttgttaccctgaacaatatcattcccagctaaatttactaaggaaaactttaactcctttccgatttttaccacttgattgcaattctccaatttcctgaatggtagtttaattggaggtttcgaggccagcttccaattgacagatcctggagaaactttgtccagtacttcaagaagtacccatctgcatgagaaaggatgtaagtgcccaattcatttggagacagacacaaatgctcattcaaataatctcatacccatggcgaacatcttcaaaaacattgttcacgtaagagtcaaccccaagactgttgatccacatccgaaaggacctttcttctctcgataatagaacatcatcacgtgatgcagtctgattgagagtaacttgtctggtgtcactagttagaccattcctgtgcatcatggaacaatagcattcaagtgataagcagatgaccaattcattggcagctagctaagaaacttttaaagtgaatatactgcaacatggggaaaataccttagctagctttatgataaaaaaaagaaaagttaatgcctttggagaaacaagaaacatactacttaccgatgctggaatatttgtgccacaaatgcaagattcaaattggcagaaccctcagtgatatccttaggagtcaagtatcttttgcaatccaacttctctgcttgttcaagtaccaatttagccctctcactaggatcctttgtctctaatgtggtttcaggggaatgctctggagcaagagcttttagaaggtaagcatatgcttcaccatcctgtacagaactaacgtatgtgaacattggagattgaagtaatattaattaaatgaatgtagtttgattcacttttcccacatacgcatttagaaaggggatttacagcataagagtgagtcataaataattttcaaagccatctgttgcttagtcaatgaaacccaaatgcaaagatgttgcaagccaaacagtggattagcacaagggcagcttcttttatcaaactgcacataatcaattaattataatgtcactttgttctatgtcatatgcaccttcacatctgtagagaaattgctgacggttttcttgtagccagcttttttcagatgatggttcatccaccgaagtagcatcttttctggtgacaagctcaacacttcatctatatcctgcataataatcagtaaaatgaattttgttctaagaacatgtgaattaaattaatagaaggacagaatgtttatttaccttgctgtcatcaaacaattccaccagctggggtgtcttcttgagattcagatcagccaaaagttgaatctgatgataagtgcaaaaagatctttatatgatgaggcaggagtttaaccatagtatgtcaaacatcaaaatgcaaaactcagtgcaacatttacctttatgatttgagatatcaatccaagaattaaatgaggctgcaaaaaagaagcatgttaaccacaacttaacttttagtgaatttcttgaattaaatagaagaagtcacaaagggaaggcggctgaaaacatctgacacatggacaagcatatcaaagaataacacatacagcaaatgagcaaggaaatatgaggtggaaccaattagcaggttatacagcgaaggataaaatggtatgcagcaaattagtggtgacaatgactaattgacagcatactttgtacccaaactacctagcacctacagggcattaaagtatttcaatgtagtcctgaatgaaaattagtggtaaaaataatttgcatagactacaatgcaccatgaattactaaaaagaatttaaagtagggaatgcgttgcatacccttccctccaccaaatcttgtgtaccaatgtttacaactgtacatccaatggccttggcagagttgaggcacagggtgtgattttcattcctctcccatgggttaagaactcttttcttatttattgctctctcatcaatggtcccaggtacagctaaattgatcaatttactgagcaaatgatccataaatgagcaaatatcagctatgactcaagggcagtttctgttcaacgagtaaatggatatgcaccctttggttagctgtaaagaccatctctcaccatagcagaacaccgtccctgacaagatcgaacagctggttgtcggtaggctcgattggtaaatacttcttcagaaacgggtcttcacgaaggtaggtgttgatgtgcgccacataagacgacttctccgcctggttgagattgtgcagcaatgtagtggtactggacttgaggaaagatgacgcggtcttgccaccgccgccaccaccacctccgccttctttggcgctcaccttgactgcagattcaggtattcctacaaacacaccacacataatcccattccaatcaaatcaacaatgcaatgacgctctattcctctcgtcagtaccaacaggaattcagaaaataaccgagttgtacccgtaggaatgactcgaactcaatctcctggtcggcgtcagggtaagactgggacaagtgggcggcgatctcctcctcggagatcacctcattgagccccctcagcttcttcatcagtcccgggaggttcttcgtcgtggcatgtcctccggagtctctcttcagagatagaaactgccaccccgacaaaaaaaaaaaacccatcaattccaccccgaatgagaggcgaactgcggcttcctatacaacgaactgaagaaaccggggataattttaggtcaccctggccttgagcgatcggagctccacctgcgtgaactggccctgcagcgacgggtcggagaccacgacgccgacgaaccccgacatctcccccctcctccccgacctcccctatcgactgcaacaagatctcagatcaaaacggccgcaaccaaacccccctcgaaaaacaaagaaaaaaaaagcaggaacgtggagatcgtccgcgccctcgcgcacgccgcgtggatgggcgcgtggcggcgcggcgaggcgacggggggaaggggggggggacgagggtaggggtaccttccgaatttctcgcgacgattcgtcgtcgtcgacgctcgccggaagtgctttccttgcggtggggggaaaagagaagaagggttggcaatggcgtcgtggctcctcccagatttcgtgggggcgggagaggggaggggaagtggtggagacgaggacaggaggtcaggtgggtcggtttcgtttgtttgttttgtttgtttattcgctggtatgtctccgattttaggtttcctcagggttaagaattagcacattcgttgtttttttttcaaagaaaaagaaaaggaaaaggaaatagcacctgggctctacgaggggctataatgaaagaaataacacagatatggagttttttttttaaaaaaaacattttattgtttgttttctttgggcttaccacatcttaaacgattggaaccaaggtctaacttatttggactttaaagggttgtgcaaaatagatgatacgtaatagaagacattgaatgctttacattggaagaggtttcgattgcgagactttaacaatatgagtgtccgttttacatattatcggtgtatttttcttttctcaaaattgaacaaaaatgcacataggtcgagttcctaaataggaggatttttttaaaaactttttacatatatagttatcattataagatgctatttcaaatccattctttttaatcttgtaataatagttaaattattgtttgtatgttccattacattgaactcaaaagaacacacctatctccctagaaagtaggagcaatggagcaccagctatatgaatacaaattaaagatccttttgtgaatacattatctaaaaatacaattaaagatcctccaacttttcctcgagaagaaactctctcgtgtaattttcttattcgagtcaaccagctttcgtgtgctcatgttctcaaaaagcaaccaagaaaaccaaaatttgtccggcacctgtttacccggagctcgagcggatcttgctgctcatgccgacaaatcttgttgcccttgccataatttttcgtggggtttttatcccctgccgaaagcgtcgtcgccacgggcctcttctttggcgtgttccgacgtgccactgttcacagccagaacaaaccaaacacctcttacctgtacaacacatacccccccccccccccccccaatccgtgctcccgccgaacgtgaacccgtcacgcagacacgcgtgcgcgtaccttgggcacacgtactgcacacagcgcgcatttatccgcaaagctatcgaaatattcaggtctccaggatgattcaatgcagagaagagctcattctctaaaccgaagtactagtaatccagttttgaattaatcaggttgtgtttagattggcccaaagtttagagtttggttgaaattggagacgatgtgactgaaaagttataaaaagttacgtgtgtatgaaaggtttgatgtgatgaaaagttagaagttttaaaaaaaactttgaaactaaacacatccgaagtatggcattttctggccgaacggttcgacaacgtgatgcatcgaatcgaagaccctgggaagcatcgacgagttcgtacggagccgagctgacaccggagctcctccactgtcctgcactgtcgttccagcttcctggttaatgccgttttccgaaagcgccagatcgccaggcttgcagcgcgccaacacacaataactcaacaaggacggctaaattccacgcacgttatttccatcggcatccaaagcgatagcacgacaaacacagcgcgccgcggggggaaagctggacgaatccttcgccagtgcgcacatcggttgcttgttatttggcgcggatccgatcgccggcgatgtgacggcgtacgggggaaaaaaaaaaggaaaacacggagttgagaccgatcacgcatgcccaggaaaacggcgaaatccaccgctgttgatagagagacgtccccgatggttttgcttgcgaattctctcgtctctcgccccggtcacatgcgaccgacgagacgacggggtctgaacgtgctcaccgctttccaagcgtgaaagttttactctggtcacgtgatgacgtgaagccgccagatcctgttgcttttgcttgcctcgggctcctctcggacgtggtcgccgaggagcagggccgactatatcttctgaatttgacccaccagcttgggccgcgaagtctacctatccaaaacatgggccacgcgcgctgcgcgaaaaggggggaaggtgacgggccaatccagcattgccggctggatcgtcctctgcgcgggccggaaaagtggcccacacgaacggtaggtttggttggaacgttgggtgggctgcctgaaatcaccgctccagcctgctttctggcccgcttactcgagttgctaacttgtgttgctattaattcctctttaatcaggtgaacggaaggaacccacatgtttgcaactttgcatcccttagccaatcgctgcaactatatgtaagtaaagctttgaccacatgcatcttgcgtgatgaatccgccgaggagttggagtggggacccatgataaatagtccagctactgcttgcttgcttgcaccctaaattatacgggaatcctcagacctctgatccgcgaagttacccactctaatatacaaggcataacactggtaaaacaagtttagacaattatacatggagaggaagtatcggtgatgttcgtggtggagggtgcatgactaccacccactatttaagtcttggtctctggttgccacgaatattatatactcacagctatgtttttaatgggattttagtataggaattctcattggtttctgtctttgagtatgtattagggagtatatttattgatttgtgtatgtatagtgatgtctatggcctatgggtatatgtctttcgtgtaattgcagagagaagcacacagaatgggaaatttgtaagggaagcgtcagatacagtcccagtgtttacaagaaatgcagctgcgttgctctgaactcaaacaggcagttcgatcgaaacaggaccctgacagagtgacagaagctcaaacacgcacactgacataacacatagcataacatcaacttgaactgacaaagcgtacgtctaacacggcgttaacacagcaaacaaccgggacagacagggcaacaatatacaaaagaaccctagggtgaatcaaaccaaaaaaaaaaatgagtggataagacgcaaacgagacgaaaaaaaaaatgtccacttctgctcccaacggtgacgacagtaacacacagcatgaatgccggccggccggcgcctcacccttctactcggcgaccaccaccggaaaaacggctcagctgatcattagctcaacgccggccactctcggcgtatgtcgaaggtgtagttgatctccaggtaacatttccggtcgtcgtcgaggaactgcaagaataaattaacaacacattgctgagcgactgaaccttgcaggtttcctgaagcagctgatatctgacaaagaaaattcgcgtcatgcgtaccttcgtcctggccgagtaggatcccctcgcaaacatgccggacggcgtggtctcctccggcgtcacgtacgtgtacggctccggctgggggctgaacgtgccgagcatctccttgtggctgtcaactgcacgccccaacgggaggaaccaaaaccatgagtgcgtttgcacaaattcaaacgcgctaaatccatcggattttataaaattttagtagtaattaattgttcatctattggagacctaattaaatgtttttcgtgtttgggtatacctttgatgccggtcttccagacggcattggtgtagcggaggccggagacgatgttgttgctgacggagaaggtgaacttgagcttgtagagggagccctccttgagggtgaaccagacgcccttggcgttgggctccaccggcagcggcaggaagatgtccggccggccgggcgagaggatggccaggctcatgatcttcacgtcaggctccaacgtctctgcaccgataaaatcaagcgtgacaggttcagacttcagacctcattattgggtcagttctttttgggacattattgcatcctaatggccaggacgtgtaggccaaatgattggccgtagttttgagtttaaaattctaatggaagacaagcagatgccgaatgaatgatcatcgtaaaaccgaccgtgaagcagctagccatcatcctcggattatttggttaaacaaccacaaccatatgaatcatggtttattcaacactagtctaaaaagcatagacaaaaagccaaggttcgctagaattatgcgatgcaaaaatgtgtctttttaggccactattcaaaatccatttgatcttaaaagcaccaacaccctagcatataaactaacaacagaaatgcactgttccccagtattaagatcagaaggcattgtcaatgtcatgatcagatgaaagcattagttcaagcttcaattaggagcccggaccagattcattatcagacaagccgaacatgcacggcaaagtacaggagttattaacaggaccatctaaccggtgcattgaaaacgccggacccgtccagccaagcccaacatatttcactttttcttttgctgttctaccgtattttctacgtacaaatcacaaatgtacggagtagaatgcaacacggagctcacgggggcggtgcatgcatggatgaatactatagacgatggatgaatctagtcgtggcccatagaacgggggctaagcacggacaggtacacaggtgcattatcacgggaccatctttgacaagggcacaaggcggtgctcaggctcacatgcaacgctgttgcatgtgccggccggcgccattaaacgagatcgcgaggacgacgagacgacgcagctaaaaacgtttagtagaaatggatttggttcgaggaatttttacctcctacggagttcaaatccacgctgccgagcagctgctccttccaccgcctcaggctctcgtcgtcctgcaattaagcaagaacacgcagaaacgcatgaagaattggatgcgttgtataaaatggcgggtgcttgcaagaattcgagcaatggcgggaatgagtagtggtaccttgtctttctcgagctggtccttgatgctgacacgcgggccgaggtcgatggccttgggggccttctcctcgtcatcctcctcctcctcgttgctctcctgcggcaatgcggcgcctcgccgcactgcttcccgttcatcgtcgcggcgtcgccgccgtgctccacgccgccgttcttgcccaccaccgccacccgctccttcgtcgcctcctccgtcggcggggccgcgatgcccttggaacaggagatggcatccaccgccgacgacatcgcctccgcacgcacgcacgcacgcacgcagcccgcgtcaacccaagaacagaatgagccgaaccacgggaggagacaatgaggaggaggaaggagcgtggcaaggcaaagcaaacgggagcacagataccaaagaagcaaagcaaggacgctcgccgaggcggattccgggttcgggacaaggggaaagtagcggggcgcaaggctccaaaacgagggcgcggcgcgacgcgcgcgcacgcacgcgagacggctagcgcgagacgaggcgtggcgggggcagatggttggatccagcaatggcagcccgggggcagagagaggataagggggttttaattccctcagctcggctctgtccgctctcatcaccagaggcgagatgcgaagcgagggagtggactagtggcgacgacgtgagcgtcacgacctgcgcgcagcggcagtggtacaactgtagcgcgttagttaaggcgatgccagtatgccaccaccaatttctcttcttttctttgcatatatgctttgcacagatgatgtctggatgatcattggggttggtccagtaattaatccatttttttaaaaagtggtattaactatcctgtctggctgtctgtctcaattcttcagtggcaaactggcaaagcagctagcgttcgaagtcaaaatggagatccacatctactgagccatggatgtgagaatggtctgggtttactacctgcttctgctttctgtgtgttactgatcgggtaggtgaagatctgagtgggtacctgcccagccagtccgtttttgtcccaggtgatgtcggcttgtcccgttgaatcgggcccgtccatcacggcccaatcatagatctgcgcgcagggcaactccattcatttccacatttcaatgcggcgaggcgcagtgatgtagtgatgccaactcattttcagtaccatatggctggagtcattgcatttgcacacaccgtccaccaggcaaactttgccaatttgccggtatttcagccatctaaccagcccagataaacagggccctgtcgggggcctaaactactcgtcaggcttttcgtcacctgaagaaacgtcgcaatggaggtgtgatcacagcatttgtttattttaacctataagtggattcgcgggtaacccacttgcactcttggctcttgcagacctcaagttgctagtttcgtttatgtgcagagtatctcaattgctctaagcatactgaagtggctacagtggtgaacatttgttcgtagcagaaagaaagctggattctgttactgaattccttcataggcgagtaacaatctccccgttacatatggacctgagttagggaggtggatctccctgaaagagcagatagctgagagctaactggagaagaagtatagtgttacaaatcatgacaaactgaggaaagagaacttctggctggcctatctctagctcacaacaccagtttgtctgccattttgttcaccgatcacggtatccacctaatttggactcctgtccctgcaaaacttgctgaaaatggtagagtggccggaggctccagtgtcctcgattgcttgcatgatatccttcctctcctgcaaaaccttgacaacagtagtgtaatctgacaagtaaatggcattgttcaattgcaagttgcaaagtgctgcatataacatgtccaaagatgagagccataagctctgctgtgaaagaagaatctgactgcgaactgtccttcgataactaaagtagagtgaggtatagagttgtctatgaagaccccagtccgcatcaacataactaacatcttgttcctgcaggaatggaatattggaatatgtttgacagatttcaaaattcatcttattatatttttattgaaccttgaatacataagaaattaacaaaaaaattatatgttcctgcaattcataaattttatgtgacctcaagcagcaatttagtgcatggaagtatattatgtgaaatctcaaaaacagccaaggacagaaatagagttcaatgattcagttgctgaaatacgactggtaatttagtttgatggacctgatattcaggggtgctggattgaacttcgttagtaacaaccactatagtcaatgagcggcacctagcacaaaatcatcttggattccagttcagaaaaaaaaaacattgttacactatt

SEQ ID NO: 54193 - DNA, 9878 bp, Oryza sativa
aatagaactggttaaatgttcagagagatgcctcatttgtttagtttgtgaggacaacatagtcttgcacacatgggcctatcgagtggttaaattagttgctgcaagattggttggtgatcaaggtaaaaccatacaatttttagcaatctgggagtttgcaaacaaagaagtagctctcattcagacaaagaagcatatgcatgtttctcagtccactgatctcaatatttgcatgttacatctaggctctcatggagtatatgctgatagtagtggtgagaggacactgatcttgatttggggaaacgggaatcaaactttgtggagaagtggctgagaaagggggcgctcttgcctcaaaggctctgacccgccgtcaccaccttgccgccgatgcgtatgcgactgcgccggagccatggccgatcccctccctggctcgctgctgctgctgcccccctgcgcactgcctgctgctgatatgcgcctcccgtccgcggatgcgcgccgctgccccgccgacactagtgcttgtcgccgcccgccgccgtgccgccgtgcgcagtcgccagtcgccgtcggtgatgtggcagacaaggagaggcggagagctgagagcgtgagaagagaaagaacgcgaacagaaacagatgcggcgctcggtgatgcggtgtgatgcgcgagagagaggaggtgggattagggttggcttctattgggctgtgatgggctggttgttgggctgagagatgtgggggctgaaacaggccatgtgtggggctgggctatagaatttgggaaaatctgaaaaatatgtaggtactagtccactaaattttttttcacaagtagggcttgggtccaagctgccctaggcccagttccgctcctgtatccactgattttgcgactcggatactattttatgcagattttactggaaaataaccaaacaattcatgatgtgcatcttattacattcttaggttgtgttcggcagtgcaggatgggaacctatccctcttgcacgcaaaacagagcggtctattatcacgtaattaattaaatattagctatttttttttgaaaaatggatcaatatgatttttaaagcaactttcgtatacaaaaattttgcgaaaaacacactgttaagtagtttgaaaagcgtgcgcgtggaaaacgagagaggtgggttgggaagatgaagtgccgaactcagccttaatctgcatatgaactgtctgggtttatcctttttaaaattttcttaattctttgttgatgggaaatgcagcaccttgatcgagaaggaattagcttttgctgtcgaactacatatgatgaaaacgctattactaatgctgttgagatattcaatactaccaggtaattgccttgttctgttataaagttcattagatgtgacctttttgaacttgcatctgtattaatactgttttatccccagtggtgctgttcacttcatggcatcgaataatgactctggtgtaagagactatgatatggagaggtttcagctctacaagcattttcagtttgaatggccagtgaatgtaagtcttttttgtttatttgtgacaccttgcttttggtaaacctactataattagggtatgcatgtatgattgtgtagacattcataatttcacattgccatagtttcgctttatgtggttctgtacttctttcttcatggtgtcgaataatgactcttcaagataaaaccttttgatttcctttttctcatgaaaacataattgtgcactgccttttaaatgtgttgttaacaaatagatccaacatcagtatacggagatcaaaaccaatggaatgctttggatgttttagtttctgtactctggtctcacaattcattgttattttggtgatgcagcatacagcattgagtcctgacagaaagcttgctgttattgtgggggatgatcctaatggtttactaattgacgccaattcaggaaaggtatgccagcacacacgcaaacctgggcataaaacgtcacatatatatgataaccaagctgtgatagaaaattatgtgacattgaagtatggcatgcatgataactggttactttgtttccctgtgcagactcttcattccttgaaaggtcactttgattactcgtttgcatcagcttggagcccagatggcagaacatttgctactggcaaccaagataagacatgccggatttgggatgcgcggaatctctctaaatccctccatgttttgaggggtaaccttggagccataagatcaatccgcttcacgtcagatgggcagttcatgtcgatggcagaaccagcggactttgtccacgtcttcgatgtcgggagtgattacaccagaaggcaagagctggacttctttggtgagatatctggcatgtctttcagcccggacaccgacatgctttttgtcggtgtgtgggatagaacatacggcagcctcctccagtttggccgtctgtataatcactcgtatcttgactcgctgtgttgaggtgaggaacacaaagcagacgttgggcgcgctgtgcctcagctgtgcaccctgtgctgaatcttgtcatcatacattaggtatcccaaatcagaatttgaagtcgtttacccgataattcaattaataaaacttgtacccttctgtatgtgtatataaagaatgtacagagatgcctatagcctgtaccagggtagtgcgccaaatcatgtgttaggttgcagtgagaaatgtgatgtgaaccttaagatcgatgatgctgtaaccggaactgcatcatctgtctatctatcaaccgaagccaagtttcttggtgttttctgggtggaagctgtgcgcctgtgcctgtgctttgtgcttgccttcgcttcggatgtgatcgtgcaaaggttcattccttttagctggtttggctagagtggcggtatcttgtttatgttttgactatctgcgtgctattcgtattgcagtcttgtagtccatcagggagatctctccggatgagtaggccggaatgaattttattttttttaaagaaaatgtcgatacaatatgacaattagtcgtaaaatcggtatgcgccttatcttcgaatactccattaccattttaaaagatgacaatccaatatgacgccttctgttctccgaatacgtaattttccgttggaaaagaggtaaacccaaaccaaaaacagattatccgattcgaagtttcgaactcgccactacgtatccgaatccgaatacgattagaacgatcgtcatctctactatataacgatgtctccccgtggatctcatgaacccccgatctctctctctcaagccacaccgagtagcacgtacgactgcacgaagcggcagagaggctagggccgacgtgcattacgcaagtgctcgcgaggtggcaacaatgaccagcgaatcgccggccatggcgacggcgccggtgccggagccggagccgcagccggagctgtccacggcggcggccagacggcaggatgaggagcggaagacagcgctcaggatcatccgcaacgagctgaggctgctctggcgtgacccgccgccgtacttgcggcccgggccggagcccgtgacggaccccttccactgggaggtggtcatcgacggccccgccggcaccccctacgccggcggcacgttccccgtcgacatccagctccccgccgccggctaccccttcgtccaccccaaggtcaccttcaagactctggtaagcgcacgctcgtctgcatctctgcttgttcctccgatccgttttgcgtgatgcaatgtcttaaaacctcatctgttatatggtttaaattgcataaaattataaaggttttgacgtaaggcacgtaaccccgtatattattattctgaagtttcacgaaaccacggtattgatcattttaactttgatctaccacactttttaattctacaattacatctcaaatttataaggattttatccattgtataattgttacacctggctttttaaaattttaatatagaagtatgtcaaaatggttaactatgtgattttataaaactttaaaaacatagtattttgggtttatgtgtcatgtgtcaaaatgtttatggttttgtgtaacttggacgatgataattgggttttagttttacgaaacttgctctttcaaaaaaaattgcatggatcgaatttgagtgcttgtctctgcaaccgcaggtataccatcccaacatcgacgaggaagggaacatggtgctggacgccgagagctggagctgcgccaccaagctccgcggcctcctcatcggcttcgtctccgtgctctacgacccgctgctcgactacccgatcaactacgacatcgccgagcagtacgcgtacgactacgagcggtacgaggcggaggccagggcgtggacgcgggagttttcctcggcgcccgtcgtctcgcactacccgcccaacgccgtcgtcggcaggacgccgccggccgttcctcacttcccggcgacggcagccaggagaagagcggaagcggaagctaggagacgagctgctgccgctgctgcatcttcaggttcaggtgagagcctgtggaggagggtaattgggtatattcagagctggtctccttaccggctacttcatacagactagctgaacaaactcgaggaaaattctgtgtagaatggtttatatgtttactgtattgagacttgagaggtatatatatatacctctaatgtggctgtaaagaatttgtacgtgattagtacaggaaggctgtgctgacgagagtttgtctgagcgactggtattgttcgatgagttggcatctttaagactttaggtctatattgagacttctagaattcacaagtcagaacattatagtgataaggaaatgttgattgtttggctccaaattagtccgtggggaaataagcaaacccttctctcgagaaaagaaaactggtgtaacccgtctccacattttttttccttctctctttggcacacggaaggccatgctcctcatgttttacaaattacgtccaagactttggctatgttttaaagtgattctcggattggctactccctcatttcttgttagttgcgagcatgtttcctgaatgttaaatggtgtaatttttttacacttgaggtatagaaccatgcacaaatagtttgtcttggggagtacgcattttccattgaagaggcctatgtgttggtctgttggagccgacgatgttttcaatcacaactaaaccgagaatatagaggatatggtaagcccaaaaagaggtcagttcttgaatggaggaggtaccatatgctagccatccattccacttaatctaatggcctgggaaggcttggtacttggcgctggcggtactgcatctctcgaaaaagcaggtttcgaatgctgttgatggtgggatgacaaatttgtactttcgcattcaggtaccaagtcggagcagaacaccgtcaccatttcttcgctgcagtcatctactcatcgcatcctcaaatcgaacaaaaattgtagaggcgaacatggtgacgagcctgacgcaactgatgtggcggtctcccgggcagcattgaccttgggggatgtgggccgatggggaacgctggcgatttcggggtacccccgttgacgctctcgtttcctccctcctcctggttcgatcatgacgacagtttttttcattaatatctaattagacttataaatgactaattagggatagggattcgaggtggggctaacacccaacgagccccaacagtggatccgccaatgatagtacgtggagaagggtagtcaagtatactcaaagctggtctcctaccgtttgctgcgtagagactagcataacaacacatggaaaaattgtctttatattttcttttggtatatatagtgccaattatggcataaatacacctccaatgtactggtttagtgttttttcttatattttaatatagggccatgtttggtgcggctctatatatatcccaaacctattgatagatttgaattttgtatgttaaattatagtggattaaaaaaagtttgggatgatatgtaagcacctctaagttagaagaagaggacggcgggatctggcagctcgaggcatatctttctgccctcttgcaccccgccgtatgtacgttcactgcaatcatcggtctttggtagaactctaccgcaatcatcggtctttggtagaactcaagcccatcggatctgggacgtcagcatgaaggaaggcaaagggtggcgaggaggaccaccagcaatggtgagaagaggaagacggtagcaacgacgacacccctcaacctcgagagcacactgcacacacaccttgcctcgacacctctaactgggtgtcgctgcacccgctcggcccgcacccgcacatgggccgggcctggtggagtagctccgacctggctcggaggtgcaatttgcacgcgccgatcctggctcgctcgtccactgtcacgaaccaacacaatcacaccaaatctctcacacaaatgccaccgatatattgcaatccactaagaatacaagtgtttagggatacaaaattgaggagaaagagaggtatagtttgggaagagagatcagacaagagaagcaggagattgggactagagaataggaattgagaggggaagcagcagcaaggaggaagaagctgtcgcctgaggcgttctggtaattgattcatcgatgaccctagctgctggctgctttgcctcttttctagtctccttctccctagctgaatgggcccaaagccagcccacttgtctagcctcctggaaggacatcacaacagcccatgtacatgacattcttcccccgttaagaatcggcttgtccccaagccgatgcaactgactcgccagattaatgcccccaagatcctagggtacctgcagggaaatgtcttgttgggcagaatcccagaacaattgtttgatgaccttcgaaccatctgatgtagaccctgcccactgttgaatccacttatccagcatacataaaacctgagcattacaaccacactctctaccatgcttttgctgcctcaaccaccaagccttcacgccttcttcaccactactatcagcatatactccatgagagcctagatgtaacatgcaaatattgagatcagtggactgagaaacatgcatatgcttctttgtctgaatgagagctacttctttgtttgcaaactcccagattgctaaaaattgtatggttttaccttgatcaccaaccaatcttgcagcaactaatttaaccactcgataggcccatgtgtgcaagactatgttgtcctcacaaactaaacaaatgaggcatctctctgaacatttaaccagttctattccacgagaattcttactgaaagtgctagcttccaaactgagatggactgcaccaagttttagctgctccctttgtaacaatagctcatgtgtctgcccatgttgattccattgaagaataagctcagatgtacatagcaactgttgtagcactgcccatattaaatcccaagaattggcaactgacagccataacaccttgtttgtatattctcttctaataactttcacatttgtccataacattagtttcccttcagatatacacttccaagaaaaattgagcccttgccctcctgctgcacacaaactgaatacctcactcctccattgcgaaggaggaggccaaggttacaagttgaccaactttcttgttgaaaccctaaatgcctcaccattgtttgatccgaattgagtccaagaagtatcatctagtacatcattgttgttactctgaacctgaaatgaaattggaatagtgtagcactgagcatggcgatgggtacgtctctcatgtgacttgcaagtgcaattaccatcaacattagctccactgaacaaacaatcacaccatgcatcgggtgatggatgggaaatcagcatgagcagcaagaacaattcatgatccccatatgcccaaccataggttgaatgatgtgtgtgttgataggccttcctaaaggcaccagagagacatatctcataccaaatacactatccaacaatcagattttgcagcaagccctcagtggaattaattgttctactcatgaattgggcaacgctgtagttcaaggagacttgatgagactcaccatataaattcagtgtttcaatttcagtttgaacacttgtttgaataagtggcggccagggttgtaagagctttaccaccatgcctccgctgccttgacaaagctgtggatcaggccatggtaaaggccgagaacctgaggtcatctcagctttgttccatggaattgctgctctccaaggtggtactggtggagggctagctgtgtattctgagctccggtcaaagcaaccatagagtacttgcaatttcaatgaaacgaaagagaggcagacaactccaaagtagtcacggctcaagcaccaactccagttcctgggaggaattgcattgatgattaacaatggatctctgaagcataaatacatagtggtgaacttggtatccacttccatgagctccatccactcctccttggccatgtctttgccaccatcatcatcagccaactggttctcacacttcattgaacactcgatggttgttcccatgccaagcttggctgtgtcaacatggttagttgagccggcctctgtactgacctccaatgcgatggaagttggatcagtgttggcactcaacgctgccacatctctagtggaatccttgctcaaggataaatccaccttggtgtggcgaaatgcctccagcatccgatcgatcttggtgcacaggtcttgtctaagttctccaccgccttgtccatgtcagtctcagccttcttggtctcgttgaaaggaaccgatgtcaccatggctgctgatgtaattgagggtacagatgaagctgttgtagcagggaacacgcgttctagtgcagcagcaatactcttggccgctggcctggcggtggcgctacttggtaccattgtcaaacaggtggtgtgcgtggcggtggcgccatctccagggaacatctagacgtgctgcacatccagtaagcagcccccatcgtagatgtcgcgaccgtgggtggcggaccgagccctctccgcgtcatggctggacataaatgacacaagagccttgacttgccatgtgctcactgcaagaacctgcaccgccactgctccataggtatcgtacacttgatgcaacacctcatatgtcactggatatatgatctggctcacggtgacgtgaaggacagcagctgagtcgcctcttggacaggacgatatttcatcgaacaggtggtgggcatctcctccaaagacaccaccaccaagttgctggcagttcctctgaccaccagcgctctcccacttcatctccacaccagaaaccccacgaatcgactactctgataccatattgtcacgaaccaacacaatcacaccaaatctctcacacaaatgccaccgatatattgcaatccactcaagaatataagtgtttagggatacaaaattgaggagaaagagaggtatagtctgggaagagagattagacaagaggaagcaggagattgggactagagaataggaattgagaggggaagcagcagcaaggaggaagaagctatcgcctgaggcgttctggtaattgattctgatgaactact

SEQ ID NO: 54194 - DNA, 1581 bp, Oryza sativa
actacacataaattaatttctcttccaattttccacccctattcggttttcacgctttctcgtgatgcgctcaatttctcgttatcgtgggcctacagcgcagcccgcgggtagagttgcctcgtgccacattggcggcaaaagcgcgcgcaccttcttccactttccatctttccctgctttaatttcgcgatcgctactgcaacactaaggcagcgaaagaacagcggtacaacggcgaagtacgacgatgatcgcatagtacagagagaagggatatcaaatctcctgcccggcaagagaagtcgtagaaggaagcactgaagcatcctgtacttcgatcacctcgtcaattcattctacaggttccttttttctccctggttttggtcggatcatgttttatgcatgtaattgttgtattactagattcagataatcgaatatttgctctttgatttaggttgcaaaccaataaattggtataatctctgcagatgggtcgaactagtatttccttcattgttcatactggttgtacaactggtggaagccctaggaaatctggtggggaaaggaattgttcatcgatctatcttttagacagggattctctgaaattcatcgatttggaggagtcattgcttatacatggatatcaaaaaggagatggtgtatactacttgaagccttcttatgtccctccacaaggtcttgtactgattctaaatgatgaacaaatcaagatgatgttggatgatcataagacggaaacagagtgctcactgtacatttttgcgaggccgcaggaattagtgactgataatggaagcacatcaaggtttttaagcccaagtagtatcccattaatcggacatcataatagtgtcccaggtgattttgataaagatgatttgacattgcatgaagagtatgtacagcaacagttgagggaaaagaaaaaaggcaaggaacctgctattggcaaggagccagtaatgttcttccaaggagactctgatactgaggacctatatggtactagccagatagatgcagaggttaaccaagcagaaccacatccgggaaaaactacacaggaaaaagaactagtagggaaaaaaactaacaagagaaaagtgaaggatataggccaatcagctgaggtggattatttgtcagatgagcccaatgatgacacaatagatttcaatgacgaagcacctatctatgtgcacagatcaagaggaattgaagatatcattttttatgagtccaccctacggcgtccacacatgcaagttggcatgttgttcagtaatgttgatcttttcagagctgctttgaagaatatgatcatcaacgaggggagggaggtgttcaagggcaagaatgataggaatcaagtttctgtcaagtgtaaggcagataattgtccttggtacatatatgcttcaaaattgcctggtgaagacacctttaaaataaaaaagtatgtttcaaaacataactgtgggaaatcacacaatatagcacagctttactggagatggcttactaatgaatacatggaattcttta

SEQ ID NO: 54195 - DNA, 13288 bp, Oryza sativa
cagtagttcatcaatgctcatgctgtgctatctgctaatccgggaagtaaagtttttgttaagtgcgaagtatcacctgagccagaaataaggcctaggtttcaaaggctgttcttgtcatttcatgcttaaattactggcttcttaggtggttgtagacccttcatcggtatagatggatgtcacatcaaacccaacaatggttctcaaatactaacagcacaaggcagggatgccaacaataatcttttccctattgcctttgcagtagtggagtctgagtgcacagaatcttggacatggttcttactatgtttggagaaggccattggaaaaggagaagagtttgggggctgggtattcatgtcagatagacaaaaggtaatggctatcatatatgtctactttgcattaatacatgtcaactgtttttttaacattttgctgccatatatagggactactcaaggcagtggctgaagttttcccaggagctgagcaccgttactgccttaggcacctacatgccaatttttcccaagcaggatttagaggggaatatctgaagggtttgatggaacgagcagcatatgcatatagacaatctgagttcaatgctgctatgcaagaactaaaggttaacaatttgagtgcatgggagtggctaagcaaggttccaaccaagcattggtgtagatatatgttcagttctagagcaaagacagatcttcttcttaacaacataagtgaaacatacaattcaaagatactgggagctagagatgaacccataattaccatggttgagcacataaggataaaaatgatgggtgatttcaataataagagggaaggtgcaaaaagggacaattggcaaatcccaccaaatatattaaagaagcttgaggcagagaagagcgaggcaagatattgcaaatctgtgtgtgctggtaggggcatttggcaagtgtccgcatttggtaatcaatatgtagtggatttgaacaagcacacttgtgggtgtagaaaatgggatttaactggaatcccatgtttgcatgctgtttcagctattcaaggtttcaagcaaaggccagagagctatgttgatgacatattgacaaaggatgcatatgcgaggacatattgtgggatgatttatcccgttcctgatgagacacaatgggaaaaaactccatttccagatgtagacccacctgtggctaggacacaaccagggaggccaaaaacaaagagaactagagcatctgatgaacctagggttcaaggaaggtcggttgcaaagacaacaattagatgtagcgtctgcaaagagtttggtcataacagcagaaagcatggaaaagacaaccatagttcttcatctcaaaatgtgagtacactactaatttatcatataaagacattgtactttgctacttctcacaatttgttgtctgtttctctcggtgtaaaacacaaataactaggaggaagaagaggagcaattcccagcctattagttctagttcaagagatgatattccaacaacatccacacagccaccagtatatatggacaatgcatttggtgttggtctctaccatcatgtgccagatggggcttatatcggtcctactggaagaaagctgcaaattagaagaaaatgatctcctatttttatgcagtggtattatttacatcaaaattcttagctacaattagtgggggatgttgatcccttcttaatctcagtactatcttttttacgacaaataattttctgtacttctaactatcagatttgaattgtgatttttaaggggattctacttcaataagcatgtcttaaatattctggaatgtgtttttgacttggtgtttccattcttcatattgatgtggaatcacgaatcatgaggcagacactgttgttttgcactggtggactagaaattgttttcctgttttatattagcgtcatgtcgtcctacccgtatggctcgcggaattaagagtggatggagatgcgcgcggttttgccgccaaggtggcacaaggaaacttcgctcatgggctgagctaaaggcccacgataacgagaaattgagcgcatcagagaaagcgtgaaaaccgaatagggtgggaaattggaagagaaattaacttatgtgtagtgttttgaacaatattgagttgtaggggggagagtagaaagagcagtgacttgtaggggggtatttggattttccccttgattcatcgatgaccctggctgctggctgctttgcctcttttctagtctccttctccctagccgaatgggcccaaagctagcccacttgtctagccttctggaaggacatcacagcagcccatgtacatgacatccacccaggaccaggtgcgtgcatgcccagcccaatatatgcctcgagccacacaagtctatcgtaccagccttcctatttatcttgcacgaggcggcagggaggttagggctttttctacttctatacatgacagtgatcatcgacgagccgccgccggccccggcgccgccgcagccgaagcaatccaccacggcgcgcagatggtggatgaaggcggatccacggaaggccgcgcagcgccgtatctcccgcgagctggaggatctctggctcgacccgccggcgtactgccgccccggccctgaacccgtgacggacctcttgcactgggaggtgatcatcgacggcccgcccggcaccccctacgccggcggcacgttccccgtcgacgtctggtaccccaacgagtaccccttccaacccccgaagctcaccttcaagaccaaggtaaaatcactcgcccaatctctgagtagatcactagcttgtgttcatcgccagatatcccaattgatgcttcaatctcgtacgtacgaatgcaattcgatcgctgcaggtgtaccatccgaacatagacgacgaggggcagatggtggtggacgtgcttcacggctcctgggcttcgtctccatcctctacgacccgctgctcgactacccgatcaacgacgacatcgcggagcagtacgagaacgagtacgagctgtacgagaaggaggcgagggaatggacgcgcaggtactcctccacgcccatcgcctcgcactggctacccaaggctatgaggacgccgccggccgttcctcacattccggcaaccgcagagagaagagaagaaagcaggtcgctgcatctaaggcttcttcttcttcgctaaatcaactgcggcggcggaagaagaaatccatcgaggatgagagtttgtggaagaggatggtagggaggatagtagggtttcttcagggctggtggtctcctaattaccgtctactgtgttggtgatagtacaagtattgggaggcatgtaaactagtagtgtcaattatgagttacttcatccgtttcataatttaagtttttctagcatttctcatattcatatatatgttaataaatctagatatatatgtgtctatagattcattaacatctatataaatataagcaatgatagaaagtcttacattgtgaaacggatgtatatatacctcgaatgtgctggtatatacgcaagttacctcacctagctagacggctcgtcgattagattcatggttatatatagctgattccattaattgttcgggtgtgtcacttacagataagtgttagtgtgtgtgacattatgttgaaatcattcagcatgacgccttcgatcatcatggcattgcagtcattttttttaaataattaatatacaatatttttagtagaaatttaaatagcaccccaaccagcaatctaaagactaccttcgtttttttattaaatgacgcatttcactttttcataatgttgggtcattcactctacttaaaaaaatagtgtaaatatgctaaaatatatatcatacttaaaatttatttaatagtaaaacatgtacaacaaaataaatgatatttgcataattttttaataggacaaatggttaaacgtcatgttaaaaatcaatgacatcatctactaaaaacatagttgtattgttgacaaaatattgcccacaggatgcaattgtcacaaccaattgaaatccgataatacatttttagtgttctattaaataacattatttcttccccaaaaaaataacattatttcaaataattttgttgcaatcaacatatcaaaaattcaaaactacatattcagccctaattaagctcccaacctatgaaaatgagttaacaataatataaatattacaatcatgcatagaatggtattattttattctgtaaataactatgagatgggcattggggttgatttttgcgggtaatgtttttttcgcgggtaatatttgactcgctctttttcttagataatagaaatgtattataccctcggtttctattatatagcacacagctagctaacaagctttttaactcatgaactgaataaaaaaaacaaatagatgataaaacaaatccctaattaccataaaaagataaccttgatagacttaaggtaaattttgctatatgacatcgcgacttcgtggttttaataccatatagattacaacaagtaagcctatatatatcatatcactcatagtggaataagatatactccctccgtcctaaaatataaatatttttagcatagtgacaagtcaaacattttcaattttgactatatattaatagcaaaaaaataaaaaagatcactcatgtaaaattgatgttactagatatatcattaaacaaactatcataatatataaccatttttatttaaaacatattacttttatagctattgttggtcaaagtagcatatcagagacggtaccataatctaaaaatgtttatattttagtactatgggagtttttggttatcaactttacaagtgtagcatcattacacaataatattaattgaactaacacgggtcaacgattacgagagaagtccactcatgttcatccctaaagaatagccaatataagtgacctggcgccgtgtggtctactgctttattgacgtgctgcattttccattttaacaagatcggcggccgttacacggagccaaaattgttcatggggagcatagaaacgaagtgatgcaaaacacaccgctaagcccaacaataaaccggaatatccgctccaaactctcctaaacctccccgcggtacttatcaaccccaagatcgcctctctctctctctctctctctctctctctctctctcaccacaccgagtttccatcctgcccgtcaggcgctaggccgctagggccggcgtgcaatacatacgtggtagtagtagtaacaatgggcagcgagctgccggccgcggcgccgccgcagccgaagcgatccaccgcggcggcggcggtcgcgcgcagacggatagggcgcgagctgtggcagttctggctcgatccgccgccgtactgccggcccgggccatcccccgtgaaggaccacttccactgggaggtggtcatcgatggccccgccgccaccccctacgccggcggcgtgttccccgtcgacgtctggttcccctacgattaccccttccgtccccccaagctcttcttcaagaccaaggtaatcgcttgcgtaatctacgcgttcctcgatctgtcgcgtgatccaagattgctcatgttcatcgccagttctcgctaatttgttttgctacctttcaatctcatgaacaggtgtaccatccgaacattgacgggaaggggaggatggcgctggacatcttccaggacaactggtcaccggccttgacgatcaacaaactcctcttgtgcttcgtctccgtcctcttcgaccccctgctcgaccgcccgaccaaccgctgcatcgccaagcagtacaagcacgagtacgaggcgtacgaggagaaggccagggcttggacgcagaagcactcctcgacgccgatcgtctcgcactacccaccgtacgctgtcatcggcagcacgccgccggctgttcctcacttcccagcgactgcagccaggagaaaggctgctgcatcttcagcttcaggttcagtaagcagcagccgcattccgttgcttatgaaggatgagagtatctggagaaggacaatgaagttttttcagggttagtcttcttaattatcgtctacgtactgcacagacactgaaaacagataagggaaattagagttctttcttcctcacagatgaaatatgttatatctagaattttattttactgtattgtgaattgttgagaggtatgcatacttgtatcaaatcttcaggttatgatctgtcaccacacggtaatgacatggagctgctgactatgaggagtgataaacaaagtccttatttatctttttagtctgatgtgcagcacttaactttccactctgtttctgatgtgcaatctttttgcttgttcgcgaaacttttcattctgttttgtaaataagtgttgatatatatgtgagcactggagccagtgtgatctgtgagactgtgacgcattatgtcgaaaccattcagtatgccgttgttttggtggtgcgcctcgagccatatatatcccacaaggaatgaatcaaaattttagaaaatatgttagttccaggaaaagctttgctttgcttttgagataaccaagtgaaatggctatccaaattacttcagtaatgtgtacattgtactgttggaggttacctcatcagccatttagatgctatcagctttccgactttagatgaccatgtgtacgagcacttcctaaactaagagagattgagccgacaataattaagttaattgtcagcatgagttggtggtgactaagttatgagaagaaagttataaaagggacgaggaaagatacaaaacgtcaagcgaactactagatatagtcatatcaatctacgagatatacagtcatataccagctcaattactaggaatctaatggcgcagcatcacaaacaaacaatcctgaaaagtatcgtgaaccactttgggatccactagcggaccgagagacaccgagtgtttttggcacgcttcttcatgctagcatacacttatcgagctgttgctaaacttttcttgctcggagtggtagcaatgtattgtagcataacactaacacgtgttgtagacatctgtttgtaccgtgttttcttatttaaaaaaagttgcagcgcgtagtgtatgttagtatgtactacatccgtcccaaaataagtgtagccgtgggaatccgtgtctaacgtttgactgtccgtcttatttaaaaaagttataaaaaaatttaaaaaaagttagtcgcgcataaagttctatttatgttttattatctaataataataaaaatattaattattaaaaattttcaaataagacgaacgatcaaatattgaacgtgaatagtgtaaaacttattttgggatggagagagcagtgctatgagttcatgcaaaggcgcagcacgggcgcacggccctgtactccaggcctccggggcatggcagccggggtaaccggcccacctgcggttgcaacgtcaaacggcccacgcgacgcgagcgatgcgccgcacccaccgccgcgacacaaacactcgtgggctacgcacgcgtggccgcgcgagcgaaagagctatatagcccacgggctctacgcccgcgcagccacccacccggccgaggccgtcgttggctcgttgccgcgtagcgagcggcagcgacgccgtgagacccgtagtccccaccacacagccccaatccggcgaggaaaggaaaaccacatgtgtgtcgtgccaccgcgccaagcaaaacggtaagcgcgcggtccgattcgggcgcgcgtatgtcgcccacgcgtgtgctcctgtgctactgcaagcaaaaccgccaaataaatgcatgcccatgtaaacgaaacgtacaaacagtcacgcgaaggaaattgacacacacatacgcacacctcacacgtccatgtcgaggaaacgtgtcacgccagaacacgtcgacgtcgatacgctatagcgcagagggcacagtgcgcacatcacccgaccgggcccccaaaatcacatcaaagcccaatcctccgaaagtctaacctccacacgcaacaatgaagcttcttgtcaacaagcgcgtccgcgtctgcgtctccctctttggcgcttcgataggacacgcagcacggcgcacccccaccctccttgtacgcgcgatcgaattcgattggcgcctctcggctttttttttcccagatagcccgcacacacacacacctggttggatggaggctggcacgacggccactcgcaccggaaaatgtatgcatatgcatgcgtgccatggcgtgccgcgtcgggtggatggcgacgtgttaccggtggacgacgacgacgactcgggtgatggatacgtagccggaaaaggatcagattatcaatcgatccaacatgctcggatcgatgcagagtaccagccggtgtacgtgctttaatgaagtccaagttattagccgtcgcccggccggcggtcgatcagcaccaggtttgtttcttttagccaacgttcaaaaactgttgctgagtaactgaccattagagcagatacaatagcagactataagccagttataaatatattttaaagagataaaagaaaagagagaatagcagcaggctatagatttgtagccagctgcagcatggacttcaagatataacgtgtgtatgataagtgggaccagatattaatagtgtagtaaacaactattatatgaattggctattacattggttatacataatttaaagttagtagttggctatactattaaagttgctcttacaactccgagtataccgatgaatgtcttgcagtacttgcctgctttcagaacgtgtcaaaatactccatttggcatccattcgtgttcgtcaaaaagtagaaattaatgtagagagaatcagaccagctagggaggagtagaaccatgcttcgacgtaagaacaaaatggtttgcattggcatgcatgcctcgccatcgtcgccgggcgtcttagcccatcccgtatcttttcgcccatcgtcataacgcgcggtatacgtacttgactatacttgtgccgttgtgcggttgcgctttctgtgttgccattattgaagactgaagagagtgcaacactccagcgactaaagcctctctcactctctttattctcgtcgtaacaaccagtgcaacttgttcggcttatggatgtccaatcatacatttgcaaaagtatctgaaaattcagatagcaggaatatatatatttctttggagtatataaaccaacttgatttcattgtccaaagtactcacacacgaatacaggcttacagttttggagctcttgtacttactaaagaagaagctacaaacgcagcacacacacacccattaatttacatttacagagtaaacatttcggccagtacttgccaaagaattactacatgacaagctatatatgtcacctctactggatttgtgtagtgtatcatatttggagttctgctgttccactttcaaatactctgtaccccctggcctcgacaacataaattaattaacattacgctaatattgtttttgagttgtgttttcttatctaagcgctagagcaaacacctttaccaattcgtttttatctaccttgtgatatgttcatccccatgcttatgtaacagcttgtgtggttgaattgatgaatggcgtgctagctagtatagccaatagcaaatggattgcccattaatttacccaagtatccatgcggaccatgcctgggtgcgcgttcggcggcgctctcggcgttctcagctgcagccgccggcggcgaacccgatcctgctgctcttgacgtcgtagacgacgctgaacgtctgctgctgcgtgttcccgatgatggcggcgctcctggccggcgcgaacgccaggcacgtggtggagtcgtcgacgtcgacgaggaggttctgcgccgacagcttgagcgccgcgccgccggcgaaggacatggtgaccgccggcgcgctcacccgcgaggcctggcccttgaagcacgtgtcgaggatggagtacgccgacgcgcgggacgtccccttcatggccgccgccaccgccttgctcagcgccgagtacacgctcgtcggcaggcgcgtgatcaccgtgccggagtcgatgatcgtcggcaggctggagtacgccgacgacgacacggacagcggattcccggcgaccgtcatcccggacagcttgatgaagtagagcgagtcgtcgagcgagctggacaccatcggcgtgtacgagtattgccccgggttgtacgacccgagcgacaggtaccccgatgacgacgacgacgggaggcagtaggtgaaggagtagccaaggcttggcgcgagctggtacaggagcgagagcttgttgcgggcgaggccgatgagcccggcggatcggccgaacaacccctcgttgtcctggccacagccgtagtagaagtttggcagcgacgtcgagccgaacgagacggtgtccttgctgaggtagccgacggagaaggagctgtcgccgtagctggcctggtagatgcagacgttggaggaggagcaagccgacgggttgagcgtggcggaggggaggtcgctgcactgctgcgcggagcaccccacggaggcgtaggtgctcgacgacttggggttgaacaccgggccggactgccggtggcacgacacgaggcacggcgagcactgcagccaggtgagcgaggagcccgtgtccacgaccatcacgtactgcgtcgccggcgtgccgaggcccatgcgcgtcacgtagttgcccacgcccacggacgcgccggggctgagcggcacggacgcgagggagccggcgaggccggcgtcggcgtcggcgtccagggaggtggcgcgcgccgacggcgtcttggcgaggcgcgccgccagcgacgagatgcgcgcatcgtcgtgggtgagcaccgccgtgaacgggaggtcggccgggaccggcgccggcgagcaggggctccgcgggtggtgcagctcaaggtgcaggcccgtgctgttcaggtactggaaatctgcacaaaattcaccggcacgtccttaattcgcccgcgtcaattcatccaatttttaccgcaaccatgacaaaaaaaaactactttaaaattagagattctaaacaaattctgccgcggctataaggccatttgcaattaatgggaggtgtcatttttatgttttcaaataagccacataaacaacaatgcatttaattgatgattgaaaatacactatactccctccggtttcattttatttgacggtttggacaatgacacggtttacaaaatatatatttgaccttatattttctattataatatacacaataaataaatgcatgtttacttttattatagtgttttgaaagacaaatctacgtatgttctttaaactaaatatttttaaagttgttgatagtcaaagttataaaagtttgacatcaatcttatccaaaacattaattattatatagaaccggagggagtagctcgttaaacatggccatcagttccgttgcgccatcttgtcgtcaattttttacagtagtagccgtcttgtgactggacagtgacgtataacgagacgtacggacattatacaactagggagaagtactgggcatcagattgtataaatgtcccagctcatatgatttccgttcccaatcgagtgtggatatgtcatcacatgatccaattgtccaaacaatcatgcaacaataattcatttatttatgttacagataaggagtgtcgatcatatatatgacttgcagctgtgttgcgtgctactggggaatatataaatgtacgaacagcgtacaacccgggcacgtacccaagattgcggtcacgtatcgatcaagcattcaagctcttattgatggtaggatttgcagttggcattatctggtcataaccatattaaatcccaagacaacgctggatcgctgtaggtggtagataggctagctagttaaccagcatagtcattgtgaaattgagtgaaatattctcggtagaaggcccacgcatggaatagtagtctcagttaatttccagtgtttgtgaactagtgcaaaatggaagattctactttggcattgcttagacaatctaagagcttggacgtgctaacattagtccaacaagagaggaaacacgtcaaaaagggactgaagttgatgcatttggttggtagttaacatgatacacaagataatggagtgattgtctgatgtctataacgaggaccacaaattaacacaacacccagtcttggtgcctaagtacagaacacctacaaagcatatggtaccttgccttcccccctctattatgacgagcaaccaaagatattttttctcaagtgggaacaaccaggattgtactgctgctttggatgactggagaactaaccacttctgaagaagccagggggcgttggactggaccatcacgtacaacagtagtactacttccatatcaaaatatagcaatgtaacgtatcctagtgtctcatcatatattaagctgttatacttattttgatacggtgagagtacaatccagaggtggcccagctaactaggcaaactatttacagcagcaccgagtttctgttgagcgtgcctacatgcagccgtaatatcatcgatcggtgctggatgattcaagtcatggcaaaagaaaaagttgccaaaaaggaagccatttgcaatggcattgaaaaaccccacgtatcggtgacgttttctagccgatcgatccggtgcccatctcggcggccatcctgtccggcgcatttgtggtcgcgcgcggcgcatgataggctgatagatatggtggtttggcatcggtggtttcacggggagaggcgaagtatggctaccgttagagcttcacatcatggccttccatgacagcagtcaatcgaaccactaaccggccatcaatttcgactgagaccatatataaattgcgatggctcagtgaacagtgtaccgtgttcggccttcaattgaaggctggctttggtcgtattggaaagaga

SEQ ID NO: 54196 - DNA, 1673 bp, Oryza sativa
atgtcaacaaagcacatatctttcatctacttgcagaaaccagacataattaacagcatgaatcaagagaaagctaactaattaagacaaggaggattattgatacccttgatctgtgacgagcacacatcggtgatgtccctgataggggtcgccactgcgaagagcagggagaaggcaagcaggtgaagaagatgcagcgccatcttatctctaaactctgaaaccacctccgtcttgcaggtggttcagtggtgcgtatgagtttatgactacaagctcagcctttttatagagattccgagtgagctatagcgcgcgctagctcttcgggcttcgtgggaatctcacgagtagctttcagttcagttgctgaagtaatctttttatccatggcgttccaagctagcttccaaccacctggttactgaaataactaacgtacgtttcagtactacgactagtacctccgtgatcaaaatcatcaaagatcttttttgacgtggatgatcaccgtagatatatatatatatatatatatatatatatatatatttcaattgaaagtcctcgttatcgacataattatgatggcataaatcaacagttcaagtagtatagtctttctcagtttatttcctgtttcatatttttgccttcttttggttctaattcggaagcttctgatgtcgcttgtgctgctactgtatcgttgccctcaataacaagaatctttagttaatcatgctgtaatgggacggtgatgcaaaagctgcttagctgcttttgttcctacggctcaaagtaagtaaggttaggtgcacacaattatggattcggctaatcaggctcaattaagctggcagttaagcgcacctatctagcaaaaatgcagtatgagccctctactgatgaacacatctgtccatcaagcaacatcgatcagtattagcgtcgacactaaggtagttttcagggcaccacattgactccggtattagacacaactacaaaagtgtgagaaagatgacgagcttttaaaggctgcatgccatattcttgagacaggttatccaactttttgtcaattttggacagaggttcacaaacagaattcaataattttgtactctttatcttaggttagcagtctttagtttgtttgtttttgatgattggtttcgtctttttaagtttctttgaacttcactcattttgagtgtgaggttataataattggctgtagctctttgagcaaaggctgggatgctctattccattatctaaaaaaaattagcatccacacctatagacatagtagctagtgcctggctttttcatctaagtccttttaaaaaacttatttattttataaataaatccaaaaaaatagacctttttcttggcgccagtaatcctacaccgaggtccaacatctctgttaacgaccaaatttggtaatatcagcatcggaaaaggagattagatcaaggtggagttgaaggcggagattgatccgagaacagagcaagaatcggctgaagtccagatcggctacgattaggatcagctgggtctgagtcggacaaggtgagccgatgcagccgattttaacattataatttggtgtgtgatatcgggttgaattgaggtgcttcaagattattgccgca

SEQ ID NO: 54197 - DNA, 24845 bp, Oryza sativa
agccgatacatgttagatctatctgatcggctatgctataaacatatataatcctgttattaatatatatttcgatctaagtgatttatactgtctcggcatggtgaccgatctatcccaatcacttgatttaagtatatattaatataagaactatatatcgttaatatctacagccgatcgaatagatttagttcctcactatctatttataaccgccaatcgattcatatatgacatcggctcaaagataaatgatatgtcatcggcacctagccgatcggctatcatttatagatttaaccacgaattctttgtctctatttcttgttgattacaggatcaaatcaattggcacgctcatacattcgaagacgagctttggacctgcattggagctttggacaaaggtgctaccgacggttctctaggaagtcaaggttacaactctcaaggggtccatggagttcaaggcgatggagcgcatggagttcaaggtgatggtgctcaggagttgcaagggggaaatcttaatcagaatagtgatgcggcacaagattttagccgattgtaggttagatgacgatattaccaaagattatgtaagatatatgataactcgacgaattatatagacaagattagagtgtcataaagatggaagcactaatctcgagaacacaagtcgtcataacaagttttacctcttgttgaagatcaaaaccgatgcagctcaacccgaaagcaagaactcgtcgaaacaaaattaaaacaaaaaggtggcgatacgccgaaattgtattgaacgtgtgtgttcaaaattacatagggctcggggtctatttatacccgagaattacaagatatgtccataccggacacgatcactatctctaacaaactctaagataccataagtctttgcggcagacttttgcccaaacataactctaaggaagttacataaaacatcctaattaatagatacaattgccttctcaggactctatccatgtgcggcaatcatcttgaagcacctcaattcaacccgatgtcatacgacaaattatactgtcagaatcggctgcatcggctcacctagtccgactcagatccagccgatcctaatcgtagccgatctggacttcagccgattcttgctctgttctcggatcaatctccgccttcgactccaccttgatctaatctccttttccaatgctgatattaccaaatttggtcgttaacaatctcgacaccaatgatattagtgccaacacccttacacccctatggaagctaactcactaatatgaaggggaatgacgcaaatgacattggcattgaggacctatctacactacttaaaatgacatcaagacctatttataagaaaaaaaatatttacattgtatccctttccaataaaagaaaaaacaacaggtccttggtgttgtcattgtcgtcgtcccccttcgtattggtgacttagcttcgacggggtgaagcgtcaatgctaacgttggcaccaccgagatgttggacctcggtgccaacaaccatggcaccgagaaaaggatccgttttgaaaataagtttttttacgggtctatttataaaataagcttttaaaaatgactaaaagttgaaaaatagtagtaccgctttcacaatctgtagactgcagtggttagtgactgctaatagtaagctagcttgagcaaccatccaaaataatcaagttagaacaggcccgaccaaaataacagaatttttaatctgaactagtacgtactaactactactcatacatagtctcagtccaaatcatagagaaagaagaaagggaacctacccatcgatatagtactcatcaaggaaagcataatgctatcatgttcgttggtggaaattcagttatcagagagagtgattgatcagattgagagagagaaagagattcccatgcgtgatttagtcgatcgatcgatgaatataccatctttttctccgaagcttcagcactaagcctcctccggcgatgggggcaaattataaagacaatggccttatgcacatatcctagctgaaaaccatgagagactgtctaagaatataatctctcgtcgatcaggctcgtagtaccaaccggcgagacgaccgtcaccagcaaaggaaatgaccatcttaccaaccacgtgagatgtcccgaagctaaagcgcgctcgggcaccaagaaatcatgcccacattatcgaagtagttagttagttaccaccagaaagaatcatccatggcgtccattggcagcaggtacgtatactcgtacaagtagtatagtattaggtgtagctggtatagtgcgtgtatacgccgctaatatgatggcgcggctacttattgtgttagggtctgttcactttgatgccattttcaaccatactaaattttagtaaagttgtcagaaaaaaatggctatatttagtttactgtcaaaatttggtaactataaaagaaatttggtaaggtttttttttcatcaaagtgaacagtcctaattaaccccttgtcgcgagttgagagcttgacatagcttaggcttcgtcccgcaacgggcggcggcacgccaccacatgcagcgtctttgcgttggtttggtgccgcgaagaggaggaggaggaggaggagacgacggggcgacgtcagaaaattattagatgggctacaatgcatatccggctagcccacaggtttatagcccattagttgcacttaaagagacacaattgtttgttgggctgtttcccttgccagttgcctaaatgcaagcatatcagagcccaagtttatctggtccaaggcttgtatagtatttccctctacttctataactaatataaatattcgtatttttccggtcgtcacatctaattttcgtccgtttttcgtccatacacaatccgattcagttagcaatagccatgaaaaaaattgtaaaaaaaaaaaatcggcggctgccgacgccaccaccgccaccggagggagaagagaggcggcggagggagctaccaagctatatatcccaccaaagcaaggctgctcgttcaggagcttgatgatggatatccaatttaactctcctagatggataaggattttctagccaaagtagactagtttgataagcaaagctaattttaaaagtaatttaccaaatacctaacctagcttaacaaggaaagaatgttgctagtctaggatccaaacacacccatatctctttgattaactttaagcttagcaacgatgatttgtgtctaagagtaggcagaaaaagaccgaactaaaagaccgagaccgagaccgagaaattcgttcctaggcagtgaaagaccgaattttgttcggtcaattcggttagtttcctcggttaaccgaatagaccgaaaagactgaattaacaaaaaaaaagtctaaatataacctacaatttactaaattcaatagaattaaactatagttttcacatccctactttttctaggcatgcaacctaataagagacgtgcttacggaatttttttttgtgatttttgtgttgaaaatttctattatttctttgcatatataaaaatgttgttgaatttcggtcaggaccgagaccaagtccgaatttgtcagtcctgatatttttgcgttgaaattcggtcttcacttttcaaaaaccgaaatgaccgaaaaccgagaccgaaattttcggtcagaccgaatgcccacccctacttctgactgctctctttagttataggtcattaggttatgttgtactactccgtcccagagaaaaacgaatttctagctacgaaacagacatatatgtgtccaagttcgtatgtaggattggtctttttttttttttaggatggagggggtattgtctaatgcaatttttgttgtgttctctatggaggcgttttagtcaattttgctccaattaattatgcagttataaagttctagggatttttaataaacaagttaactcttttcttttataatgaaaagaaaaatccatctcttttcagaggttttctttggggaaaaatatctatgaggatttgaatttaaacactaaagggacctgcactcctggttcgattactgggtcgaacaaaagtttagtttgttagctgcaacatttgaaatcgatcatgagacccacttagaaaatgaatctctaatcagatgcatccatcgtcccttgcaccgtcagtcacaacggctgcataccacctttttcgtcgctgagttctattctttctttgtgatcgatttttatctgacgagtaacaatcggttgttacagtgtggttttctccatttttttttcatgtatactccctccgtctaaaaaaagacaaactctgagtttccgtgtccaactttgattgtccgtcttatatgaaatttttttataatttatattttcattattgttagatgataaaacatgattaatattttatgtgtgacttgtctttttaattttttttcataatttttttaaataagacggatggttagacgttggacacgaaaaccaatatttgtctttttttttgggatgaagggagtaattagttctattttactcctacacacaggagatgctctaatgggtgaagtcatggtcccttccgttttaagaacacaatagctggcttgttagcatgtggcaccggcacgtgcactactcgcccccaggccccagggcggaagatccgggtctcactgcacgaatctggcaccaccaccaccggcaccgccacgcaccgcacaagattcacccagccgtttgcactgctttgctcgccatcgatctcgcgcggccgcgacgactgtctcgcactgtcggctctctcgtctctcccccttcctcctcttcctctcggtcccgcgcgcgtcaacttctccgctttgccgcattcctccgcgcccctcagatctccgctgactccgccgccgcccgccgacatgtcgtcccgcggcggcgaggacgacgaccacgcctcgctcctcagatcccaccccgcggccggcgccggcgccgggtccggctcatcgtcgccgtgcccatctccgcgggctgtcggtggccaccaccacaaccagcacgcggacgtcgaggcggtgggggaggccaccgtcaccgcctccccgaggcggagcggcggcgtgcgtggcctcctgcggcacctcgaccgccgcctctccgcgcgcggatccggggggcgtcgaagccagcagccgccgcagcagctcgatcgccccgagccgtccccgacgtcgtcgccgcagcagagggagagggtcggggaggagctcggggatggggcgccgccggagtgggcgctgctgctcatcggctgcctcctcgggctcgccaccggcatttgcgtcgccgcgtttaaccgtggggtgagcatttcactggttctgctcacagactggaaacttgactatcctctgcaagtagaaagcaccggagtgaggctcatcatttataggatctaaacgtagttcatggatgctagcaaatgtgaacccaagggactttgcaaatgtgattttgatccgtttatttgtgcaaactaaactagtgcaaataaattcacccaaatgatgcaaaatcagtttcatttaagtgcgcaaattcaaagcaacttaacagagcactgaaagcagtaaatgaaaagccttatgtcacatcatatctgcggttgcccaaaacgcgataaattttgttaaaatttaaaaccttccaagtgattccaatgtaagttaaggttgagatttttcagttctgccttgcatgactgattctatagacagctcctgttatggtatttttaggttcatgtcatccatgaatgggcttgggcaggtaccccaaatgaaggtgcagcttggctccgccttcagaggctagctgatacttggcacagaatactgctgatccctgtgacaggaggcgttgttgtaggaatgatgcatgggttgcttgagatatttgatcagctcaaactcgtgaaaccgcctcagaaacaaggaatcaatttccttgcggcaatctttccaactgtaaatgctgtccaggctgctgtaactctaggtactggttgctcactggggcctgaaggtcctagtgtggatattggcaaatcatgtgcaaatgggtgctcggaaatgatggagaataacagggagaggcggattgctcttgtagctgctggtgctgctgctggaattgcttcaggtatgtcattgatgattacgtacctgtttccttagtagaatatcatgacttcgatagctagcaccttacaattattatttaaggatgtattacgtaatggcaattccatgtaaattggatagcatttatagttaacatgtattgtttcggatatctttgtaaaataacttgaaatattgtatttcacgactcccatgtaactctaaaatttaacattttgattttgttcctacccttttggcctttttgttgttagcgcttgctaatatactgtttcttgtgttgtgtgttttcaggcttcaatgcagcagttgctgggtgtttctttgccattgaaactgtactgaggccactgaaagcagaaaattcacctccttttacaactgcaatgataatattggcttctgttatatcatctactgtgtcaaatgttctgcttggagaaaggccagcttttatagtgccagcgtatgagctaaaatctgctgccggtatctcccctgattctttttacctttatctttaagattgaagattcatctattaactacagtaacaaacactaccaatttttatcatgttatgatacaccacttgcaccactaccaattcttggttcatcaagccctaatatgctatctccattttgttgaggcctatagtaatatgtttcagagatgatgttatcataaagtttagcagcacttgccctacttttataagttattcacacaaacccaacttttctattatcttgacatggcttcttggttgaataattctctccttttgtattgttgtatatgaacagcataggttctaaaggatattctgtcgtctcattttctgttctgcagagctacctttatatctcatcttaggaatgctttgtggagcggtcagtgtggtatttggccggttggttgtatggttttcgaatttttttggatacttaaaagaaagatacgattttcctattgtagtataccctgctttgggtggactgggagctggcctcatagctctcaaatatcctggcattctatactggggtttcacaaatgttgaagaaatactacatactgggaaaagtgcttctgctcctggtatatggttgttaactcagcttgcagctgcaaaggtagttgcaactgccctttgcaagggatctggccttgtgggtgggctatatgcaccaagcctaatgattggggctgctgttggagctgtttttggagggtcagctggatatttgataaattctgctgtacctggtaatgctgctgttgcacagccacaagcttatgctctagtaagttgctctgttttcctttttttttttcatattgcttgaagcaatactgttatttctacatccttgtatatacaaaaactaattgtcagaactccaggttggaatggctgctacactagcttcagtctgttcagtcccactgacctcagtgctgcttctctttgaactgacaaaggactacaggattttgcttcctctcatggtaagtatgactgtttatgtagtgtgcccattgttttgttttgatatagtctttctcttttgtcacatcatgatgtctagaagaggacataaatgttgtgattttatgtttcactattgcattatcaaaactaatgcacttattttttattgtccaacagggagcagttgggttagcaatctgggttccttctgtagtaaaccaatcaaaggatggtgaaccatctaggtttagaacacccaggcgtggttattcttcactttcttcagaagatagaaatagtaaaagctggaggcgaggtgacagtgtaaatgatcttgagctcactagcttacggactgataactatgacacctataatgaggaaatgcttctagatgatttgaaggtttgtaggcctctaattcttattgttaacggtctagctgatgcaatggtgcgttcaattttcaatagaagtacatgttattatgttaattctatcctaatttgtcatttgaactcttttaccaggtctcccaggccatgtcaaagagctatgttaaaattccaacatctgccatggtgacagaagctctcaagcttttgcatgataagcagcaaaattgcggccttgttgtggattgtgaagattttctcgaaggaattgttacattaggggatattcgccgtatgggatttgaattacatggggacagtttcacaagtggagaccagctcaagcccgctgtacgtttgaatggtgaaaatatgtatttccattagaatagttctacgtaaataagtaatgaattggtgtgcatcatttcacttggtctggtctaggctggacactgattttgtttaaaccattgccatttaatgcgatagcttaaaatgaattctaaattgaatgtacatgctttctatctctgaaaggtaaaaacaaaacaatttacacaggctggcaaggaatgtgtactaattaatggagatgttgcaggaaaattcttcaaccatatcattgtgtcttactcgaggattccagtacgaggggaatgaacgtggattgctaacctgctttcctgatactgatttgaccactgcaaaaaaccttatggaggccagaggaataaagcagctgcctgtcgtgaagcgtggtgtcggccatagaactgaaggaaaacgcaagcttattgctcttctacattatgattctattggtcactgcttacggttagtcataagcttatatgtgttctttcaaactttatatttttttgggtttattcagctttaactcaagataattgaattttttttccgcttgtttaattcatttgaattatactgaaatgtcaattcatttggttatgaagggaggaaattgagaactggaaggccatatatcaaataaaagaggacttccatctcatagcaaatgggcattgaacagcattacattgaccaatattacaccacatcaatcgcatgcaatttgatatccttaaggcatttttgccaaatggggatacaggaggtatacacgaagttcaacttgtacagatttgaggctcctctacaaagaattaaattgccatctgaggaaattattcaggctagctagccaattttgcaatagaggttatggtccattcttgttgcgaagcaacttctacttcacacgggaggagatgggtatgtatgaattcagttattcagaattggaaagtggcattgtaatgtatatcttgtacctgtactatttgtaactgtgtaacatcctgttgctgggaagcatcatatgcgccagcttgtagaggtgcagtcacacgagaaactagtgtaataaagtgtgcagcagaaaattttgtcaagaagccgatgttgtaggttgtagcgtcacattgtatgtaacactttatatcagcacttgaactgaatttctccctttccgtgcagttacataaagcttgcagagcaaagttgctttatcaccatcgctgtcctgagtcggagtcatgtttacagcgaccgccgtcgtggcatgttttttttacggaggctgctttctcttcctgtaaacttttcaatagaatttttttttaaaaaaaatcacactggttagcaatttaaaaaatatgcgctcggaaaataagggtataagttaataaggatagaagttgggaaaaggaaagaacacatcatccttatatgttactcctgccgtcttaaatacagcttagcactaaattatacacaacttaattatacaatataggtagaagtccatttccacttaaatccgtaatagtttgctactaccttcgttttcaaagtactccgtataagttattttgatatgatgttatacatttcaatactatgaacagattttctgttcaaatttataatcctaaaatatattatatccgatcaaaattaagatagtatatgtatattttaagatgaagacagtagcgatgaacaacatgctcatgactcaggagtcaggagtcaggacaggagtcgcagcttcttccggggtgccccgaaacggagtaacctgggcactcttttcctcatcttctctacagcaaccgcaccgtgccacgtaaatctatcggtgaccgtctcgacctccatggaccgcactggtcggtcgggaatggcacggccccaagctagcctcaggcctcagccgtgctccggcaaggcggcacccggcaccggtctagcatactagtctgtcccaaaaaaagctaaaccctggctatgaacgtggacacgcatgtgtccagattcgtaggtagaattggactttttttttaggatggagggtacgtcttttgacgatgcgctgaaacactgcagttctctgagccaagccacacgtagcctattgcgcatgcatgctatgcagacgaccttacaaaatttctactcctctccgcccaaaaaaaaaataaaaagttttatcccttcaatactttttacctgcctatcactatcactatttttttaaatgattaaggttattatagtcactctctatttcctctatttttatcttgagatgttagaattgtttttttttttttttatggagggagtaaggtccaaggctagcatctcatctcacgcaacgtcacagtcttcgcagaaacgccgcaagcgacaacgcgatacgctgctgcgtagaagcatccggctttggcctttcacatcaggcaacagcatcgctattgtatggtactgtactgtgtcacataccggtggtccatctcactagctaccgttgtccccgcccagcccgggtgcaaaagaccaaactatcgaaccgaacacctcaagccaaggagccagacggagccgggcaaggtgaaagctcagtcagtgcacgtgtattttactactcccaacttttccacggattagcaacgcgttttctcgaaccgaacaggggacaggggatgcaaaaagagactacctgcgaatctacttatatgtcaaataagtaataatctatggatttctacgttgtggctcgatttaattaccgtaactaaaaaatgcaagtgggttgattaataaatctatttatatatcaaatttagtaagtaacccgcaagttaatctacgagttattagattatccattaattttgtatataaataagttcgcgggtttgtcggttacatcccccaggcaggaggaatcccgaacgaacccgtttcatgccactgtgcgtagcaacagaacggcgcggcgcgctgattcgttgacgagtgggagataattaagccggggttttgtatccgcgcctgctcccctttggcggcttctgcgacggggaaggtgtcgccgagcgcacaacagacggggctagtggcacaaaacggcaaaactagaaaaaagaattggatttttcttttccatttacgtgcgtatatattatgccttgtcattggctcgtcgctgtcaaatatttactatcttttttttttactgtcaaatgtatatagattagtgcgcatattaaaaattcaagccgaacaagacatgttcattattgcccaaaaattaaagcactttcgatgttttgcacatgcatgtactcatcattattacttcctctatcttcaaatatatggtcttttgtcggatgtgacacatcttaatagtatatttacgaatctagataagatgtgtcacatccaatcaaagtaccctatatttggaatagatgtagtaatatatattcaaaatgcattctcaactgtgtgtctatatatatatatatatatatatatataaattcataactagcattagataaatagctatagtacattttaggatggaggaggactgtattagaaagagataactatcgggatcatgtcatctagtctctctttttctaaaacaacctcgttctttttaagctaacgaaggtatgaactatccgtgtgacgcttaataaagtacaatttctttaaaaacatgttgtctagtagatatatattttcttttgtctaaactagtacagtatttattaactttagaatctacaatgattaatttaattaatttatcggctaatgacctggaaccgggctgtcagctacagctgtggtcttcggatgtggttgttgcgtcagcgtggaggttacttggggtcttcagagacttgcaatgggctatataatgtacgtacggcattctagctactatggcatattggcagttgatgtgatgtttggccaaacatctacagtacagcctgcatgccattccacgaagtgcgactagaagtaaacggcgccagtatgccatgccacaaattgggcagagagaaaaatgtgccatatggtccgtggtcttccatcaacaaaatattggtcgtagctacactaactgacgaacttgaattcacgatcgagccgtccatgcgcatgcacgcaaatgtgaacgtaccttgattattctcactgattagttatcagaaatttagtcctgcagagagatgatcataagctgccagccctgagactgtcgatcgtatcatgattcacaagtggcatactggcattttctgcggtgatcacggattaacggcagcaacaccacatctgaaaatgacgggataccatattaaaaaatatatatgcatggtcatagttttaagatgctgaatttcacttgagcagtacgttcaattctctcgtacgaacttgaaaattctctgtttcagttaagccctatgtttacgcggacaactacgaccgcacgttataccgtcatagagcggtataccgtcataggcctcgttactgggtgagctatggtccactggactggaaggcaaatcgaggaaggaaagtgctagctactccgtatatgatacctcggcaatattatgatcgagatcccccgagatattaggatttattaatcctaaggtgttatgaaactttgaaaagaatcaatattgtcataacaatactagcatattgtagtttcttgaaactccataaacatcattatcattgaatatcactatcatggaggatgggcaaaggatttttagaggattaaatttcctaaggaatttttattattgaagcctttttcgcgaacacattattgaagcctttcattcatatgaaaagataggaaatatccatatgaatacattcttacggtccagtccaatcaataccataggaaattaaagcaagaagttagagttatttaaattttttatttaactagaaaagatgtctgtacgttgcagtgggtgaatgctattttaatcttgttattgttatacggtttggctagggtgaaattcgctatgagaattcgcttggatattttttttctagaaaatcttgagctgcaattaagagtctgaaattcataagttagcatgcaagtgtttttaaagagatttcttatacgactccttttgtattttcaaaagcaaacgaacttaaaatctgacttaaacacggatctgtatttttaaaagtgaatgaacttaaaaaccgactcaaacgcggatgacgtaccaaaataccggtaaaaacatcttcaatttttataatagtaaagatttgttcaatttttcctgtgatgtaatgaaatggcttgtcttctagtttcttatgctttcaattcagatagaatttgtaaaaacataccacttcaaatttttgttctttttcttgtttctgtatttttcttatcatgcgttctaaagggggtcttattatgtatcaattagcatcggttagtatcaagtatcaaaaagtgtggtttcatcatgtaagggatatcccctcgtttcttgcagttttataataatgaaaatgatttatatttctggcttctgtgctaaggcacacaaataaaaaagagacgataggtgatgggacaaaccctcaagggcctcaactccacattattattaactagcgttatatcaaatagattccgccaacaattctaatagaaactatttagatgatatgtaaaaaagtgagaatatattctcaaggatgagaatccatcttctcaagcaattcagatctactgtagtagtattgcagatacattactactcactgacatttgggctgtatgtccagtgctacagaggacctcactccttctcaagtatcatcatgtatcaaagagtatttcaacgaatatcattgcgtatcaacgagtaccatcgaatatcaaactattcgtcgtggtgtatcaacaagtatcatctaagctttgtttactgagtcaactgcgagtctccgtcaattagtaggtagtaacatggtttgcgtgctatggcatttcgtgcgtttgcatgcacgcatgaaagtctatcctctctctatatataagttgataggaatttaaagctgcaattatctagctgatcagcttgcctaggaagcaaggaattagccatggcttctgtttcgccgctactgcttctcctcttgtgcagctaccactctgtagttgctcatgcaggagatggacagagttacaaggttcttgagctgaattctgaggccgtctgctccgagcgaaatggtgactgtccatgcaagcgcatagtttttctgcaattttcgtgtggtttttcagtgaaattgtaatcgttttggtgcgtcaaattttgcagcgatttcgtcgtcgttgagtggaaccacggtggcgttgaaccaccggcacgggccatgctcgccggtgccgtcgtccaagaagaggccgaccgaagaggagctgctcaaacgcgaccagctccgagccgagcacatccagcggaagttcgccatgaacgccgccgtcgatggcgccggcgatctccagcagtcgaaggtgtcgtcgtccgtgccgaccaagctgggctcctccctggacacgctggagtacgtcatctccgtcgggctcggcacgccggccgtgacgcagacggtgaccatcgacaccggcagcgacgtgtcgtgggtgcagtgcaacccgtgccccaacccgccgtgctacgcgcagacgggcgcgctgttcgaccccgccaagtcgagcacctacagggcggtctcctgcgccgccgccgagtgcgcgcagctcgagcagcaaggcaacggctgcggcgccaccaactacgagtgccagtacggcgtccagtacggcgacggctcgaccaccaacggcacgtacagccgcgacacgctgacgctgtccggcgcctccgacgccgtgaagggattccagttcgggtgcagccacgtcgagtcgggattcagcgaccagaccgacgggctcatgggcctcggcggcggcgcgcagtcgctcgtgtcgcaacggcggcggcgtacgggaattccttctcgtactgcctcccgccgacatcgggctcgtccgggttcctcacgctcggcggcggcggcggcgtgtcggggttcgtgacgacgcggatgctcaggagcaggcaaatcccgacgttctacggcgcgaggctgcaggacatcgccgtgggcgggaagcagctcgggctgtcgccgtcggtgttcgccgccgggtccgtggtggactccggcacgatcatcacgcggctgccgccgacggcgtactcggcgctgtcgtcggcgttcaaggccggcatgaagcagtaccggtcggcgccggccaggagcatcctcgacacgtgcttcgacttcgccggccagacccagatctccataccgaccgtcgcgctggtgttctccggcggcgccgccatcgacctcgacccgaacgggatcatgtacggcaactgcctcgcgttcgccgccaccggcgacgacgggaccaccggcatcatcgggaacgtgcagcagcggacgttcgaggtcctgtacgacgtcggcagcagcacgctcggcttccggtccggcgcgtgttgaccggggcgggcggcgcgacgccggcgcctggcgggccgggcaacacgacacacgtagaggccaagagggtagcagtaggttgctctcatgtggtcgtctacttgtttgtggttgcgaggtaagagtcgtgacgtgtgatgatgacaagatataatgatatatattgcaattgtaatccaacaaccaaaatattatattagtccctagctctaaaaaaatattatattaggagtgaacttttcatgattttttatgaataataaagactttatactgattaattcgatcgtttgattcccaatcgacggatgcatcattagtgatccaagtgtctggccaataattagtgtgtgagaatggtcttggtgattcccaatggactacagtttgccctactgatttaccaacagaatgttagattgcacgtaactgcgtatggtggcacttgtgcaatttttattttgtttttctgtactattctttgttttggtttgattctttcgaatggatttaagagaactgatccatatgctcctccgttttttttgagatgctaccattcatcatattcaaaaaattaatataaatattattttattttgttatggcatgttttattattaaaggaattttaagtatgacttatactttacatatttacactaattttttaaggagataaatgatcaaacattattaaaaaaaattaacggcattatctattaaaagggatgtactatattaattttgtggtggagatttcgatatcgtccactctgttcaccagaacatatgtaccccatctctctatttcttactcttgagggccaatagtcttggataataatgggattttggtatgaaacatcaattctattttcttttcctttggagcaccggaaagcagctgtcaaactgatacagaattgtgccaccaaagaatccctagtagagtacacatggcatttcaaagagaaaatcatgttattctcctagaaaacatctaatggattcttcttctgctatctcatagtctacttgttgccttataggttaatgttttgttcttatttttttatgtctacaaaacgaaaatgttaattcaaaagttaattttgaggttttaatttttttaagcattgactttaaaccgttacaacacatgcatgaaagtatttctttttttttgtaaaatttattttatcatggcttgtcagccgtatatcaaacagagtttataggctggtccacgtgtatccctactaatttttttttgtgtatttgctatgaccctagtattcttgtgctttatcatcatgtgagttcataatttgtgatgttttgttcttagttttttatgcctgcatatattaagagttatgcattccaaagaggaatatcttcggtataaacatatttgaaattgtatatgctctaaattgttcaaactataactctatggcccttgactttcacacaaatatcaggtgaatgttcggctaacaaccatcaacaatacagatccagcattatctacgagattaaaaaaaaagataacgttttctctctgggccttgggccacagcagccacaatgcacaacagaacgaggtggccccacagtcccacacgtccccctaactgtccactagttttagacttttagtcgtagcacatcagttgagcaccgtgccactgaccacgacgcaccaaatcaaaccaagcgtgtcaagcgcctaacacgtgcacatggttagcccgtttaactaatttattattattactctcaaaaatcgtatatccactaacgaaagtactatgccttacaacctttgtgtatttgtgtactatgtactctcctactactagtgttatgttatgtatatgcgcctatcatcctcgtgtacgtacgtacattgtacgcgtatatctatacacctatacgccatgtacgtactaaagaagaatactgtcgtgggtgagttgttaggatggatcgatcagcaggagcgggcatgaagccgacggtgctgccgtcgaagcgcacctcgaacgagcgctgctgcacgttcccgaggatggacgcctggctgtcgccgccggtgggcgcgaacgccaggcacccgctggtgaggatccccgacgtgccgaggtccatggccgcgccgccgccgaacgcgatcgagatcgtcggcagcgtcacggtgccgtaccgggtgaagtcgtagcaggtgtccaggatccccgtcgccggcgccgacgggtagccgtagggggccatggcggcgcggaacgcggaccgcagcgccgagtacgccgtgggcggcagccgcgtgaccaccgtgcccgtgtcgaccaccgcgcccgacgcgaacacggacgcgtcgatgctcagcggctgcccgccgacgctgatgccggcgagcatcacgatgtagtatgtcgggtcgttcgacgccgtcagcagcggcgtcgtggagaagccggcggtgctgctcggcccgcccagcgatatgtaacccacggagttctgcgtcggcggtaggcagtaggagaagacgccgccgtaggtgctcgacgcctgcgacaccagggactggccctgccggccgaggccgaggagcccgtcgacgccggcgaagaggccctgctgcgcgtggccgcagccgaagaggaaccccttgagcgcgttcgacccggtcagcgtcagcgtgtcggagctgtacacgccggtggtcgtggacccgtcgccgtagctgaccacgtagccgcactgcccgccggagcagccgttggagtacaacgccagctgcgagcacgacgccgcggcgcacggcacggcggagtaggacgacgaccgcgtcgggtcgaagagcgggtccctctggctgtagcacggcggcgaggggcacggcttgcactgcacccacgacacgtcgctgccggtgtccacctccaacgtctgcgccaccgccggcgtgccgaggctcaccgtcaccacgtactgcagcgtgccgatggagaaccccaggttagccggcaccgtcgccgccttggatcccgccagctgcatccccggcgcggcggcggcggcccccgacaccctcctctgtatgtactccgcccgccgctggtccgcgcgcagcgtgtcgaggaacgacggcggcgatcccagcgccgacgccttccccgccggggcgcacggcccgtgccggtgcgtcagccgcagcaccgccgacgtgccgttccgcggcgaggcagctgaaactcgcaacgaatcccaatctttcatcacaatccggccccaaaaaccagaagcaacagttcgatctccccgctcgctcgctgtctactactactaactacgtacctcgtccagggagttcgtcggcgcaggtggagctcaccgcgaagctggatgtggagacggtgacgtagcccctcgcggcgtcggcatggcggggcaagaatccgaggccggagaggaggatcagcgtcaagaggagagccatatgcttcgcttcgcttcgccgcgcgcgcgcgcgttggcaccgagcgggaaggggacggtgtggctaaataaggcgtggtagcaccaccagttggcgcgtcggcggcggcggcggcggtgcggtgcgagcccaacccatgacgatgaccatatgatgcggttgcgctgtgcgattggaattcttcgttcgtgttgggttggggggggggggggggtcccgtctcccaccgaaccgaagcgaagcgaaacgcgacgcgacgcgatgcgactttgcgagtctcgttttggtgcggcgccaacgaaggtgggctttctgcgcgcgtcagatgcgaacgtattattgcgttgatggacgatggatgattggagaatggcacgtcttttttgtagtcgtacggtttagcgtatcggcgccggcaagcttgaggctcaagcttagtatagttctggtactaggaactaatcccaatcctaaaacttttttttcctgatgatataattctcataacctgtcaaattggtgtctgaaatttgaaatctgaaaatgaactctactaaagtttgcatatggttctttcagtgcctttacagtttctcaatcgattccttttagaagtagtaccttttacatgaaatgaaaaggatgctcaaagtcccaaagttgtgtcacacaactgttacgctaactgttcgtctccctgacggagacctttatctaccgctattttcatcggtggcgtaagggatctatggccgtgagcgcgacacgactgatgtgccagcaaaatacccaagttttcttctcccgtccctgccactgtttgcaccctgcgtctccccaaaattctcttctccttcgccgacatgctgcgagcctgcacactgatgctggtgtatcgcaaggctgacgacttcgcgttgcttatcgcagcgtggctctcttgagattactggtctaaccgcccggattatccgccgggtcagtcctgtcctgcaattcgtgtacagtggatggccggtctgcatatgtatatgtagtggtgcattgccgaacattggacgagtggtttgacatggattgggtgggtcctgaacgatgagcaactgagcatgcatacttaggtagttggtactcctacttggtagtgccttggtcacatgcagagcacttctcttcattctggtctactgggaatttggatagataatgttggttcgtagtggagcaggcaatacccgggtttggtgcttcttgagtccctgatgactgaaaaatcacaggagtcgcactgcatgactaaccggcagtttcatggtcgaccggtaaaacaggctttcaggcggaagtgcgtgtgccagaatttgagtggtacagtctttttcacaagtgaggagtagcaacacgctttcacaggaggttggcagccatgcatcacgatccagtgcagttgcaagcatgagcctgtttggtatagcttcagcttcagttccagctctcccttgaaattggaacttagccaaatagttctagctccacgtaaaataggagcggagttgaatgaagctttttcacaaaatgaactggagaggtggagctagatttaggcagctccacaactccactctatatctaactcctgaagttaaaactctaccagacagaccctataattgcaacttaagcagttgttcgggagttcttaaaaaaaaagccagttgcttcggcggcacatgatagagaagttaaaactctaccagacagaccctataattgcaacttaagcagttgttcgggagttcttaaaaaaaaagccagttgcttcggcggcacatgatagagaaagtaagggcctggatcattgtgtgactgtagcaaaaatatatattttatacattttgtagcaatgaatgtgaatcgttaaatcaaaatatgaacggttgattacttacagtcctttttagtaccaactgtatttgatctcaatccggtaggcataggtatctgaatttacaattttcagataacccactcttgttttatccgccaaataagccatccaaaatatacaaattgtacagacactaaaaaaaaaactcactacagaaagcaaagaagagtgacggttcacagtgatgattgtgatgcaaccactctgcatcacaactcacaactcataaccctctgaaaaatggtaccaatctctcctttccgatggccatctccctgcgcccaatctccattccgcaacgcttccggccgccggacggcgccgtcctagctccctccggcggtgccgccgccgccactcgctcgtacggtgcggaccacttggcctgcacgtaccgcgcccgcctccacggcggcaggtgcatgcccgcgccgcggatggactccgccgccgcggcgcacattgccgcggcgacccccctgaaggcctcgggagtcgcgacgagcaccggcgggagcgagaggaggaggtcctggtactcggcgctcggcctcgcgatctcgaactcgccggcgacgttgacctcgacgatgtagcgagcgcgacgccccgtcgccgacgccgccgccgtcacgtccacgtactcgtggctgcccgccggcacgctgccggttctttcccacgacgacctgcacacgccggcgtcgaaccctcgggcgcgaggccgctcgacgactcgcttccggatcacgtcgccgccgttgcgaacggcatcccggacggcgcgctcggcctcggcgcggatgcgggcggccgccgcgtcggacgtcgcgtccgctagcgcctcgcgcagcgcgtccttccactcggtaggctccggctccggcgacgacgacacgccgcccctcgccgtggcgtccgcgccgcgctcgccgtcgtcgtagaactcgtgcaccagatccaccaggaggtcgtcgtcgtcgtcgtcttgatcacgccggagggacgcggcaccgctggcgaacgggccacgcagccgtgccctggccgcctcgtccagcaccgccgtcgccttcttgtacgccatcggcgacggccgcgtcgctcccatccaacacgccaatcgggcggcgcgcgatcgccgggttgcctcgatcgaaacgagcactgcacgcggcggcgcgaacaagatttgttgccgtgtgccggcaaagccgtttccttttccgttgcaggttcgggtggattggcgtcttgtacgatacgaggcggttttatatatgtttcggtgtgtggacgccggggcgtttgcgcggctaggttcgttggtttttacaacgtccaggtgcaatgaaccttgtacgtccaggtgcaatgaacctttgtacgttctgtatgtccagatgcatctcgctataaggtttcagaatcagaattggttgaggcgtacggaagcatgtgagaaactaaggccccgttggtttttcagttggacggatattttcatagaacgcgaaacgagaatacatatactagcatatgattaactccctctaggttttttatatgacattggctagtttaacatacatatatatatggaggtaactaactatcaaaattaataaataattttacttggttttttaaacaacttctacataaaaactttttatatgaaaagcatgtgctaacgaaaaacgataaagttaaagtttagagttgagaaaaagaactagcctaagaataaactattggtcatatcttttcgcttatgcttagcaaccaaaatttaaatttgtaatcttaaatttaaaactgattttgaggtttttttttcatcaaagtttatattaaacatttgcttttatatcgttaagaacgagtacatataaattatattcacaaattactttatgtttgcaaatataagagtttcattaataagccaaacgatgggccgatgctggtgttaacactatggtttgtttgaaggtgccctgatgttaacgctattggccgatgctgcgtccagatacactatgcatgacatgcgtacgtaatagaagtttcaaggttattcatgggactgaaaaagcgtgccatcatgattaacttagtctattgcatataaacccacaggtccatttgccatgattggcagtcagtgcatataaccctgatcaattgccatcatttgccagaaccattcatcaattctagagaccatctaaataacatcccattttgcatatcagatatgcctggcagtaatatccattcactaatcactacagaggagattgaacatgtcaggtcctcttatgagttatgacttgttatgagctgtccatcgggttatcacctgaagttggtgcgggcgcgccattgtcgtccataggagtgttggcctccattgctccaaaagtaaaattactaggaatattacttgggttgactcgctcgaagatggacggcacgggctgctggttgaatacgggcgcttggatgtcacctgccggttttgggaaaccaaatccaagaggacgaaatgattcagttggaaccgacgattgagcaggtgcgccaacattgggtccgaaaagcttctgttcatactcaacgagctgattctgtgaagctgtatatataacaaataggttactgttagctcatgatcaaacatttggattaaccatcaattcataatgttacttgaaaaacaaaaggcgaaatctataagaacaaaaaagcttgagtagtagctatgcataagtactagggcgctactatgctaggtaaatgagccacagaagctttcaaagcttatctatgtaaatttaagagcctgtataaggtccccgtcaagcactgatgctacatcctattttgcaaagaacatctcgccaagcacctatattaatcactcgtatcttgactcgctgtgttgaggtgaggaacacaaagcagacgttgggcgcgctgtgcctcagctgtgcaccctgtgctgaatcttgtcatcatacattaggtatcccaaatcagaatttgaagtcgtttacccgataattcaattaataaaacttgtacccttctgtatgtgtatataaagaa

SEQ ID NO: 54198 - DNA, 5683 bp, Oryza sativa
tactgttagctcatgatcaaacatttggattaaccatcaattcataatgttacttgaaaaacaaaaggcgaaatctataagaacaaaaaagcttgagtagtagctatgcataagtactagggcgctactatgctaggtaaatgagccacagaagctttcaaagctatctatgtaaatttaagagcctgtataaggtccccgtcaagcactgatgctacatcctattttgcaaagaacatctcgccaagcacctatattaatttgaataggggttggcaaagatttttcaggcatgaaagaagaaataaattatttggtatgggatcataccatctgtcagttgcacctgtggtcgccggtctttcacccattggtaagactgtgaaagtctccatcccctagatttcatcaagtagcctattacaatagctgcagacctggaaattttgtaccagagaagtattaatcgatcattcacaacaatgctaacaacatgaatgctcacaacactgctatcacacctgttttttccagacatgcaatggacaagaacacgtgatgtctccctttcacactgttctgcaatggcagataacgaaacaaatgataaaaacaaaaacatccaccatttgtttctagtttagcactgcccaagcaaactacagcataattcctactacaggaatgcatttccattggttcaaatgtcaaaacaagcacagagactatctactggagtacgaattcaagaaaaacttgaaatttcacagggaaaaaatagagatttcattccattccaaacaaaaatgctcaaagaatagaatggattttacctaaaaacctgtttgcaccatcaaaatccaagctcctctcatcctgaatgcagtgataagtgaaagaattccggtagagattctgacaatctggcacagtctgcgatatatgagaaaaatgcttacatgattaactaactaatagaggaccagtataatactaagatatcagtttatcacaataatgtattaaaaatgaagagggctatggtaccaacatttctaagctacaaaatgtccccaacttttctttactccgcattttgtcaaatctctttgtttctcttgtaggataaatcatgtttagtgaaaagacatatgtaaagttcataaaatacaaacatggcaccacagcggcacggtcatccctgataaaaagaaatatgcagcagaactacaacttttaggcctatagggtgtaaggagaaattactcaaccaacaagaaagaatacattatgagcatacgatgcatatcatccaaaagtaggaagataattagaatatgagcgaattaattacaaaggagtagaatctacttcaatctaacatgacccaattatcaatctacccagttgtgattgtgtgtttatctttacactttctttcgatcaagtcccctaccccaatttgtctcagatatctagtttgaagaaactctttacactaattgttttccttgtttctaaaaggctaatcattcattaaaaaaggccaaccactcagggggaaaaatatgcttgatacatttggtactgaaaaggcaggtcataagtaaggctccgtctgattcaattgtttggagggatattttcagcgtacgcaaaacaagaaaactcattagcacatgcttaattaagtattaactattataaaattgaaaaatatttttttaacaacttctatatagaaactttttgccaaacgcaccatttaatagtctaaaaagcgtgctaacggataacaaggaagttgaagtttggagttgagaaaaagaactggctatgagggcatgatataccatcaaacaaatgtacaggaatctgtgacaatgcaatcaacacatcccatccttcttccttgttgcaacttttctaccagcgataggagcgaccacattgtattgaccaatggatgataaccctttccctgtcaacatcaaaccttaccaacactctacaacttcttcgagacaacaagataaacttacaaccaatagtccccaaaccctagagatacttcacaaaaaaaaaatattctcacccgcagaaggggagatcatgacatcgcgcctcaactccatcacgcagaaaaacaagtcaaaataggagcgattgggatcatgagaaaggggggcaacacattacgcacgttgaggatgtgggtgatgctgagcgtcttgaggacctcggagcgggaggcgttgttgtagctgccgaggaagaggaagtccttgaggacctcggtggggaaggccgggtccagcgtcgccgggggctccccggccatcggccccgaccggtggccgcagaccccgcaccgctccccttcctcgctgttgtggtagtgcccgcagatctcgcaggggttctccctctcccgcttcctcatctcgcctcctccgccggcctcgccgcagccgccgccgcgctcgatcggccggtggtggtggtgcggtagtccagtggcggcgcgcgcgcttggagcaaaagaaagggttcggagttgggtttttctttttttttttctttttctttctaacgcaaagcttttcggctttctgggaatttttttttaaaaaaaacttcggcatttggttgggtaaaaggaagactgagccgtcgatgtggatttggacggctgggatcgtctcggcagttatggcggtgtcgtactcgtacaaggttggtgagattgcgtatgggctgatgactcttaagctaatcattttgatgaagtatagtgctagtactccgtactggttatttttcattgctatgggataatacacaagttttagataaaacaatatacactgtgttattttagttttaggtgttgggcgattaagaatttttttcaagaaatatcaatttaagatttctgcattgggaaagggttgaattagtgcccgcctgccaggttaaataagggtcctgtttggaagattagcccagggctaattttgagagctaatatttagtcatgaattggtagactaaacattagtctagggtggcatgtgcatgtttggatccatgggctaattcaaggctaaaaggtggagagagtagaaagagaggagaggagagagagagagagaacagggccaaggtcataccaaaccggacccaatgttgcactgaacagacatgttgtaaaaccaataaaacttacgagaggctaattttacttctgacggcaagattagagctaaacagctaatataaaccgcccatatgtttgaacaccactcaggcactaaccaccagtcaacagaaagaaacgacaggtctaaaacctaacaacaagatactacaacgaacacaataaagggtgtcaaaaaagacagaaatcaccattcatctgtaccacatcgagatcatgtcgagccaggaaccggatcagcgtcgaagttttcggtggatgagtctgcagcttccttgtctgcaggagctgcttcgttcagtgaagttgccgtgttcttcgacgcgcctttcttgtcatccttaccagcagaccggccagtactcttgctctcgttcagctgattgccggttgatagccttctactcggtgtcccgtttgatgcgccaccgtttggctttgtgccagccaccttctttgcactggtcactctgtagggattgacccgtgttccgaatggcccctcacggtcgatgtttagtagctgttccgtctggcgtttttgttcctggaatgtgaaagaaatagaacagatgattttgatgccaattgcaacatctgactcatcatttgattgatcgaagcgtggataagtagcaccaccatagaatccttgttgacaagggcatttggatgcaatatccagtcgatactaaggagcttctgatagtataagaaaggaagtgtcactaacccgcattcttttcttctcttcttccctctcttgcctaagaatgacatactcatccagcattgctagcagagaaacaccgtcatacataaatggcagcccgtgattttcttcccaagctctcgtcttagccaccagagtttcaacaagggctaaaaaaaattgctgtcattagcaacgaacaggaaaaacaatatttacaggagaaaagatatagcctatcctgcattatgcccaaatgcagagcttcttgagttggattgtgtaaagcttagaattatcatttactgccaaaactatttacttatgcatcacagtaggcacctggaatcttgctgactagaatacgggccttttctgcacgtttgagattcaggtgagcacctcggcctgagttatacctgttgtcatcctgcaaaaggaatttcatgctcagtacttcatagcttcagaatataggtgggataacacgtttcactagtagtcagaacaaccatactctgctatagtcttcaagccagctttcctcctcgcatgaggatatccatctctcaactttatctaatatttcttttctgctcagagcttcctcctttgctttcagtatctgactatccatgtcagcaatcagttctgaaggttccatgttccctgactcaatcagtgcctgtattttctcatgggcaactgctgtgtctaatacaacatgagtgctagcataaatatcttccagtatggcttgcttcttaaaagctatttctttcatcttgctgtattttagctgatccaacctttcaacctcagtctgtgcctgaaatattgggtaatgaagatcaaaatcaaacgagaagtaaaaaatatatatgaagggatgctgaaggtggtccaataaaagaccaattagtatattgtgtgactcacttgatcaatcacatcaacagcaagtgcaccaggaaccatgacctcctcaacagttgctgttctatgcacgaaacatgatcaaacaagctcctttcttccaccggggtgtccataagatcccatagatcatagagttgagtggcaagctcttgaagctgaataaacagtataaatcatacatgagatccaggataagaatggctcttggttgctaagtataaaactgaaagaaagaaaatatgagttaccttctcaagtctcaaccttttgtcctcattaagagtaccaatggtcctatcaagttttgacagggtttcattgcttatgttcttgtgttcgttaccaatagagtcatctagactgctatggacttgagttattgttctaaaaaaatccatcccaagcacattgcatagatcatgtaccataccaacatgctcaagaaccttttccagcctacgactctgtgatattcatggaaacatatattatagtctctatgaaaccaaaaacacagagatcaccaagcaatataaattacttatgaaaaccaaatgaaacagacaaagtttgtaccttctctttctcaagctcttgaagctgtaactggaactctcgaagcttccgaactgtcaaatcatcctcattaatctgtggtagtgccacttgctgtcccatctccagagtaccagcaatctcaccacgtatttgctcaattcttgactgtatattagctattcctttattctctcctttttcttcttgcccaattgttcaagtgttggagctatagcagttagttgttccttgat

SEQ ID NO: 54199 - DNA, 4272 bp, Oryza sativa
aacaattagattcagatatagtagattgcatccaattccatttgcaggtgtgttctaatctaaccagttatactttatggtgctagattgctagctgtattaataattctttttccagtattagtaaaggcttctttgaaacacaggattctgggatggaaggagtacttcactatgaattcctcgattccaaaatagccttatattggttgttccctgtttatttgacttagggtcgatgctatctttaaagcgatactccacatttgaatgctgttttatgcgtttcaacgatgtcatccgtaacatatttactgcctagtggacctgtcacctgttagcgaatattgtgctcgagaccttgagttatctaaccattatgcagtgctgctagtttttgctcaaattctaagagttaaaacctttgacaggcatatcagaaattcaacaatttgtacctgaccctatattcaattatttttacagacgcgatcgtgatgaagccacctgtagttcggttagtgcctagcgtagcttcagtgattaaccatgctgtcaacattcttttggaccagtcaccataagttcatcatgtgctgccggccatttcccatgaggtttgtgctacgcctctacatctcttaaaacctttcattcaaaattaaatgggcagctggtctcataatagaaactatgctcaccagacaaagcccacaatttaatcacttcaaccaacttatctttttttgcatttctgttgacatgtggtttcttttaactcgtgcagtgcctacttcctactggacttgctggaatcaatgtagcgcgcatgaaggatgttgttaccttaccgtagttccttcggctatcactcctagctatatttagtttctttacctgtcttgtcttcctctgcgctgatcttataaaggctgtaattacataggatttggttgagtgactcataggttctgtcgtaatgatatgattttttaccgtaaagttcatcaccatcggggccagtgcaaggtgcactggtgttctcgattgtttgatatacccgtgaatctctgagctgtcttacaaccgagtgtttcgcccagatttctcaagtattccagtttttggccggttctgaagtttacctgaaacgagcgacctgagaaggacggggacacgttcacttgggagttgtgatgtaaactggttgcgagttgcgacgcgcaacgtgccaggttagtgtcacaagatagctgcaattacacatctatcttatttgcatttctactcttccgagacttatgttgtgcaattgcaaatattatatcatcaatattacaccatatatgtcgccatatgagacatcacccataggatagccaaggtaactaacgttgttacggccggtctgactgtctcgctacgagcctaagatatcacccataggatggccaaggtaactaccgttgttacggccagcctgactgtctcgctacgagcctacgaactagtaagatcagaaagtcggtaaatttattctcgaaagtaggctaggcgaagatatacatggtagaatacaacaccacaattgacagatcagacgaaacacaccgtgctccactgctccatgttcatatggccaggaacaggaggcagcacagcataacgcacgtccgcgacgtggcgactccgcggccgccgctggacgccaacggcgcgggcgccggagcggcagctcggtcgcccttcctcgacgaccctggcggtggcgtcgtaccagccaccggagcccgcacgtcgacgcgcagcttcagcccgccgccgcacttgtccgggtcggcgctgacgaagtacctcgacccttcgccgccgaggtcgacgcggctgagcccctccgtgtacatcctgacggggctcccggcgtcgcacgactcgaactcctcctcgccgccgacctccgcgacgccgccgtcctccgccgagtacgcgaaccctgacaacaacagcaagttctctgaaactgaatactgaacagagatcgacgcatgcattcgtcatggacttacagagggtgtctccgacggtgaagagcctgtccgcggaccaggcgaggacgtcggaggccaccgcccaccccgggtcacctccgacgacgtggtgacgacgtgctccggcggccgctgctgctccagcggcgacaaccagaatgagaacgccagctgcggcggtggcagtcgtgacggagacgatggccatgtcgtcgaacgaatcgtacgcgcgcggcacgaccgagtggcgcaggagggaggagcggacgcgcggtatggtcgatggatgatgacacacggtcgtcacacgcatcgctgctttagattggatcaaatgtctcgaaccaaccagtcctctctcctctcgatcacgagaatggtaggttcaaaatccataaaaaagacggagagaatgttaggttaaaacctgctgttctgttctggtaatggccatctcctgctttctcctttctcccagtgatgcaaggcgcttgatttgctatgcagctaatgtgcagtatttgactaaccagcgaattccaatttgttcgatgctcacaacgctacatgaactagcagacaaacacctgaaaaagaacacgagtactagtactcttgagtattgaagtctcagagaggaatacaggggaaaaaatgcttgggagagatgccatgccgcgctatgttgttcaacttcaaacaagccattatagaacgaaccagaaaggtcattgggaatgcatccccgcttctggacgagtcaagtttggtcaacgtcggactgccaacaaggccatcggatgatcgcgtcgtcccatcggacggtcacgaagccgccacgtcgcgcttgtcaccacgctggccactccggactcgtggactccaccgcagcagcagcagcagcagcagcagcagcagtgaatgctactctcgctctgctactcactcctggcgccggtgacctctctgccactccaccggacggcgacggcgaggcgggtgagctctctcgccgcctccggctctcctgccaccgggcctccacattcggcgtcgcactccttcgtcttcgcgtgatccggtaagccgtcgccgctcgtggcaacggagatctggttattttggtgcttgatgtgtgtggatgagctgagagtttcgtggattagtggagtctaagagatggccttggcttgggtggtgggattggcgcgtcgcggcggcggaatgcgcttgtctgtctctcgacccctgatttggttagtctcgatggttccggtggttttgttcttaggaatttccgaagaacttcatccagttgtcgaccaatggcgttgtttgtagttctagatttggtccagttgcgtgctcggtggagatgatctcgatgcagagctatctccatatgaattatcgattttggttgcgtttcacggatggatttgtttaggtttgagataaatgttgttggcctgttgaaactcccaggtattgagctgttttgttgttgttgttgtgtgcggcagtaattaatgttttttcccttgggccatcagctgtttctgcgattggcatttaatagtatttctgtcaattggtgggggagatgtgatgctagaacgatttaaaatgctagtagttatatgtgtctcttataatcatatctgaccaattcaaatgctcagcctggcagatcgggatcgactaagcattggcctttgcaagttttgaagtgcatttcaccgttgcttttgtcttgagcaagagtttatagagccatacagctccgacaaaaggattcacctattccagaatgtctgctttgctccgtgaaacttcgtgtggatcattgctgcaaaaactgcaggtatgcgtgtgaactgctccatacttgttcatgtcataactcattagagatttttttttttgcttgtgtatttgtgttcaagtagaggttcttcttttctatttttgaattatcagtcggtatgggatgaagttggtgaaagcgaggaggaccgcgacaaggttctatttcagctggaccaggagtgtttggatgtctacaagcggaaagttgatcaggcaaccaaatcaagggatcttcttctccaggcactggattactcaaagacagagcttgctaggcttgcttctgcccttggtgaaaaatccatagatataagtgtaagtaaatatgcgcgtcttcttccagtacgcataggct

SEQ ID NO: 54200 - DNA, 1569 bp, Oryza sativa
taatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgctacactagcttcagtctgttcagtcccactgacctcagtgctgcttctctttgaactgacaaaggactacaggattttgcttcctctcatggtaagtatgactgtttatgtagtgtgcccattgttttgttttgatatagtctttctcttttgtcacatcatgatgtctagaagaggacataaatgttgtgattttatgtttcactattgcattatcaaaactaatgcacttattttttattgtccaaca

SEQ ID NO: 54201 - DNA, 1019 bp, Oryza sativa
accaaaatatatgtacttaagtgtcaagtgtcaaaatatgtgtggttttctgcaacttgaaccataaaacatgtagttttgtgaaatttactcttttttttattaattcctcattccatctaattctaagtaagatgcttgctttggtcttggtcttctggaatattgtttagagcttttgggtaaagcctcatatgtaaatgttctactaccattcccttcagattccagaccaagagaagtatcccttttcctggacctggagttgattattcagaagcgcagaaacaaacctgaaattcaacagtttttatgatttcaactttggacatagaaactattaagctcttctttatgtatcatttatatctttcttaaacactcttgcctagaagaatttctttcttgtgtctcaaaagtactttacatttataattctgattatgaaaaagagattcactttgattctcctagctcagaaactaattaggtgtatttccccctgcagcaacctatggcaacttgaacaaatcatttcatgatacatgtgctaggtccaatctgaacgctgtacagagtccaatccggtggcgaaaaatcaggacacaaagacagcatcaattgatgctacagcaggaaaccctcttacaggtcatcatgctacaccaagcgtggcacctgttcctccaaaacctacttttgctaaccacagtgaaatagcaaaaagtgttcaacgtgttctgcaccaaccagctaatcatcctagctggattccgccatcaactgagtacatgcgttctcgtttggactgtcaaatatgcaaagtagctatcatggatatggaaagtttgcttgtttgtgatgcttgtgagaagggagcacacttgaaatgccttcagcattatggtaataaaggtgttcctaaagctgagtggcattgtccaacatgcctgacaaagagtaagggcaagcctttgccaccaaaatatggcaaggttacaagaactgctgtcgaacca

SEQ ID NO: 54202 - DNA, 10444 bp, Oryza sativa
  unsure (1)..(10444): unsure at all n locations
nnnnnnnnnnnnnnnnnnnnnnnnnnnnnnnnnnnnnnnnnnnnnnnnnnnnnnnnnnnnnnnnnngtcgtgatgctgttccccagtacatgatttatgggttcaagcaggtcagcccacggttccagcgatttaattggagttacatctggtagagtttccaagtggcaggtccctccagtcttccagtcaccacctctgtaagaaatatctaatctagttaaagaaatagtttgactgaatatttgaaagatactatgatgtttgttcacaagtccaacaataaataccatcagcattgtttcatgatgctaacaatatattggcacaattcacataaaacaatgaaacaatgtatggtcaaaagcatctgatatcattcgatacaacatacacaatcaatcaagactgtcaaataatgtttgagcaaggaattaaaaccaagggaaacactcactatttgagtaattagagttggtgattcacagacctgaaatgcacaggagcatatgtacggaagatgatctgggtcttgtttgtgttaacttcattgcgaagccaatgaaacaatgtctgcatggatctttggtaagcatctctaacagtcatctccattttgacctcgttgccttcttggaaataggcgccactggtgcaagacataacagtaagaatagcatgatctctcagccataagacattaagtagagaatgctgttcagtcaatagaattcaaacatttatgcttaccctttgattgttttctcatggttccaccagtgccccgtgttaaagatcaaaagatcagcatccttccacttaccccggccagacatccaatccatggcatctactctaattgtatattttacgactgcaggggctccagctggtgcacgaccttgaaggactatgaaaggagacctgtaatactccacagtgcaattgtactctctaaacttgaaaattaagaaacccatgtgttttgtaataggattcccattaacttcaaagatggagctcttgtcaggaacagcagcagcgagcatacaaagcagagactcccattggtttcttgcaatcgaatccccaacaaatacaactcttctgtttctgagtttctctagcatatttctggcattaaatctaagaaacagaaaaggagacgaaattagagtgagacaccagcattgctaatatgggcatttgaatttattgataatggtacatctcagtccacaggtatcaagggagtaccatacaaggtcacaaaataatgaacttacaaggtcacaagcatgctctttccttataaaataattcactgagaaatcaaaaggcatgcaatacattaaaaaacataagtacaacgagattatgcttctaacaaaaaaatgcgagtccttttacatggtactatgtaacacatccctaatgttataatattccacctttgcaaaatttcatacaattagcacttatgaaggatgacaaacttaccctccaagtatagctactgacatttatggtgacaagaatcaagattaaatattcttttcaaaaggtagaaatctaatcttggaaccactttacttttccaaattgaatcaagcaaccacttaactgcaacaaaggcagttagaacacaacaaaacagagccctcaacaattaacaggacaagaccacctctccatcgaaggtaaagatgattgcaacagcatgacagtcgcagatcaagtaaacaatactgatttaataaaatatatcttctgcaggactaagcaataaccatacgggtaacattgtttcctacttttgtaatcatgtgggaagcaaaagggcatcgaatttccaatcgtggcgcacagttccaaagtggagttggtcgttgacagcatcatgatcatcccatgttccaataatctaattttaaccagggtgaagattgtaaaatgcacgcccactgatccaatctcagcaagaatatcccactggaagattgaagtcagaagcactaacccaaacttaatcctcatcatgccagcagagcagcatgtttgggttctagattcaacccaagtttatttaagtccgtcttaatttctttgcctttataagttaacactcaagttgtagaacattccagcagacaaaattaagtagcacggtctccaatccacatctccttaattaatttatactaatcaattaatcattcgccatctccgcaccgttctagatgcttggattgcagcaagagatctcattaaagatttcttcattgatcttcgtcaagctctcgaagtaaacatttactaaaatcgatttctatctaaacctccaaactcgccaccccaatccaacaatggaatcaatggaagcataatatgcaagagtaccaaagatgagaggaagaagtagaaatcgatggaagaggaggaagcaaacccaacctggggagatcgcagcgggaggggcgccatcgccacttggtgtaggagtcgtcggggcggccgttctcggagcagcggaagccgacgtcgaggaaggggcaatccctggaggcgtagagcgggtagccgtcgtcccacacccactccccgtcgaacaggtcgcactcctcgcctccgccgcctccgccggcgccgccgccgcggggctcctcgatggagaccccgccgctgaggagcttcttgggcgccgccagcgccgagccgacggcggccgagcagcggagcgaggcggcgcacacgagcaggagcagcgcggcggcggcggccagcatcgcgaccagccccgccgccccggccttctccagcggcctcctcatcaccccccgcgccagccgcttcgccgccgacgtcgaccccaccatcatcgcatcgatcgatccccccaccgacgaagcagtagcaccggcactagtagtaccactactactacctgtatactacctcgccatggccatggagcttacgcgcgcgggaggaggggagacgagacgaggtggcggagaggaggaggagacggagacacctcgagggagaagacgaggaggtatttatgaggaggtcatttgaaagggaaatgcacggagtttggctgcttccaattggacggaaagcaatgtgattactatttccctatttcataatatataagttattatagcatttcttacatttatattaatattaatgacttacattgtaaaatggagggagtagtactcctctccatcctataaaaaaaactacttaacctaatattgaaagaaaaattttctaatacaacaaatcagaacagatagaaactcatccaatactaaattatttttccaatacaacaaatcagaacggatagaaactcatccaatactaaattattttttttaaagtagaacttaacctattactaatataatatcgtttcgattcaggaaatattatattttatagtagattaatatatttttgagacgaagtaagtacaaattagtagtgtggtttgtggcaattgtgttgtgcgtgtggagaggggaaggaagaagtggatgggagggggagggttgaagttgaggtgtggggcctataaattcggctgtgtttggaggggttaagtatgagtcaagtcaagcacgatctatccctcggtcatcaaaaaatacttgctttaggtcgagcgcaagttaaatttgattaccatctgtctaatataatgtcaaaagatgtactggtattttattttaaaaaaactttgtttaattttaggccgctaccttttaaccacatcgatcattttcgatcggggcagttgctaaaccattttcacacaagcttcattgtccttgttggcttgtgaaaaatctagaactctattttttgactacagagagtacgtctacttgtgtgatggtaacgattccttttggtccttcccacgttttgtttttaactgcgttgttagactgtattgcgtatagattgtgacaaccatcgagtttgtaatcaaagataattgattttggtggggattagtagtagtagtgtgggttggggcaaagaatgatgcatcgaaagatgatgagggtgttacgaaagcaaggttgttggcttgtccttgtacgcaacgcaaacgcaatcaagtttaatccacctggtcatctcgataacagcaaatacactactaaacgagccatgatccaaaaccaatctttttttttttttggaataagttcaccagaggttcctcaacttaacaacgagattttttaaaatccctcaattacaaaactagaaatattcattcctaaactcactcaaaccgttcaccggaggtcccatgacagtatttgcacctggttttattgacgtggcatcctagtcagaaaaaaaataataataatatgtggggcccacatgtaagtgagagaaaaatgtggggtcaataatccagtcagcaatcttcttctcagtcgccgttttctttgccacggatggggagcggtagtggctcgcggccggaggcaggcggagcggcgggcaaccgcggcggtggcgggcgagcgacggctctgggcacgggaggagcaaaggggcgggtgagcggcgaccgcggagcatcggcggtggtaggcgagcgcggctgcggagcatcggcgttggcggcggcaagcggtgggcaagtgtggcagcgggcgagcggcggctccgggtcgccgccatcagagttaataccgagggagaaggagggtacgttgggagcctcataacttcgccgttgctcctcccggcggcgctccttatcgccgtcgctgtcggagtcgatgccgagaaagaaggatggcgcatcgggagcctcataacgcttttgttcctcccctccattgccgccgtcggtgaggtgggactcgtcgccgtcgccctcgaaatcgatttcggcagaggggggaccggcggcggacgagcgcgatagaggggagagcggcggcgagcaagcgcggaagaggggggaccggcggcggggcggagcggccggaataggccggcagaggggggacggcggcggcgcctgcgatgcctccgccgactccgcaccgagtcgagcgtgcaccgtctctctcccctctcccaccatcgccgcccctactcatcgccgtcgccggcgtctgcatcggcctcttatccgccgccgagctcgccatcgcgccagccgtctctttccccctctcccgccgccgcagcccctgctccgccgccggccgcctcacatcgagtctaccaccgcgcctactcaagagaaggagagaagagaagagaaaaagaaaagaaagagagatgtggggctacatcattttctctcacttacatgtgggcccccacatatttatttttttattttttgctgactaggatgccacgtcagcaaaaccgggagcaaatactaccatgggacctccagtgaacggtttgagtgagtttaggggtgaacatttctagttttatagttgagggatctcaaaataatctcgctgttaagttgagggacctccggtgaacttattcctttttttttgggccaaagccttgtccctacacaagcctagttagttagcctaggaaaagtacaccgaaggtccatcaacttgtaatcgggttacaaaatcacccccaaccacaaaaccgttcattttaggtaccgttcattttaggttcctcggtggttttgacccggttttatccaacgtggcggctgagtcagcgtggggaggaggcctgcatgtcagacagtccacgtcagccacttcttaccctccctttcaactcacttcctctctcctctcctctccacgtcgatggccggcggagagcagccagggcgcgacaggacagtgtgacgagcgcggtcgtcggtgcaacagaggagcacgtcgcggtcgagcgccgccatggcctcccttgtctctgacgcgccttcatcaccgctatggcctcccttgtcttcaccgcgtagagcgaggagcgtgcgggcgaagtgatgcacgaggcggtcactaacctcgccccgagggccggcggcggcaagcacggcatccgcgacacggcgtgccccatcgaagtccccccggtcgacgaggtcagagcacgcgagctctgcagaggttggtcggctggtggggaggaggcctgcgaggtgaggcggaaccgtcggcgaagtcctgtaagccatcgcagcccaccaccgccacaccctcgctcctgcacgcggcaggacgctcgtccgcacggcctgccaggacccgaccagcgcgaggatgccgtgcagttgctcccctgctggacgccgcccgctgcagatctggcgcccgcgcctcaacggcggcggtgttggggaggccctcctgctccggcggcgtgggaggacgaggcggaggcggatggcgccgacggggagaggaaggatgccgccgtcgtcatccatggccgcacgtggagagacgatggaggctggcggtgtgggagggcaagcacgggttgacgaggcggaggcagatggcgccaacagggagagggaggtcgccgccgtcgtcatccatgtccgcacttggagagacgatggaggctggcggcatgggtggacgaggcggaggcggatggcgccgacggggagagggaagtcgccgccgtcgtcatccatggcgacacgtggaaaggcgacggaggccggcggcgtgggagggcgggcgcgggaggacgaggcggatgcggatggtgccgacggggagcgcgaggacgtcctgctcccacatcgtcgcggctgccgccggtcgccggcctcccgacatcctcctctcctgcctggcgccctcgccccgccggccgtcttgctcggattgagaagaaaaggtgagagaggaggaagggggagaagaggtgaaagagagtgatgacgtgaacaacctgacatgtggggcccacgtgggtcccacgctgactcagccatcacgtcggacaaaactggggtcaaaaccaccgagggacctaaaatgaacgattttgtaagatgagggatgtcatatatctgattttgtggttggggacgattttgtaactcgattgcaagttgaggggccttcggtgtactttttccgttagcctactcagacccagtcacttctgggccaggccgtgataccatagccttcttatgggccgtataagcccaaacactgcctcctcgtgggcctattgggctaatactccaaggcccaactagctcccactccatcagtccacaagtcaccatttcaccaaccacctcgagtaggtaaccggcggcggcagtttgacggcgggcgccgtgccaactccggcgtcctcctgccgccaccgcagttcgacacctccgcccatccacgacgagacacaggtatacggcgctattcctctccaccccagtaaccacagattgggagcagatcacacgaaggaattgtgtgaaaggactggacaaatttgtttcttcgtcaggcttgagagttcagaagcaggtgagaacacttgtatagtttctacgacctcttcttcttctttaccggaatcatcagggatcaaggattttgtctgcatcacggctgtacattgatgaatccaattgcactagtccatgtctctctaaagtcaggccatgaaatgccatcacgcttgagaatctagcaacttttgctttgctagctatctatccagtccagggtacgtggagtagttggttggcctttctatcatcttttaattcgctgccatgacggttgaggtagacagcattctatctgcacctgcattattgttgatccctttctcgtcgtttttttggttttgttttgttagagcaggtaaaacagcaaactataaatcagatataaccacatatcaaaaagaaaaaagaagagagagaagaaagcaggctacagatttgtagccggctgcaacacagacttcaaaacgttatgtgtgtatgagaggtaggaccgggcattaatggtgtagtatatttttataattaactattataagaatagactattagattagctatagatgatttggagtcagtagctggctatactattaaacttgctcttatctttctatctttttgaccttttagcagccagttgaagctagacatgttcacccataagcatgtgaaaatggaaataataaattaaacaataggactaatgtaaaggtgtccaattataaaatgatatgcaaaatcatctaagtttccgtaaccgcagccaccttggaagaatcgtggactaggaatagagtatttgtctgatttggactttggaaactatgggcacatataccgttccacgcatagttcccccgagatgatcgcataagatgcatcgtccaagtatgaatcaagaacaaactaattagagccattttggtttgaagttaaaatacacccctaccaaattattggcactttaaatagtattttggttagtgtttggttttgctactaaaatgtgacaataacatatataacttgccaaaacttgggccataacaaaagtttgcttaggttttggcatggtggcaaaccatgcaaattctaaggaatcacattaaagaggcttagtgctccctgaaaaggtgctcacttcattctattttacctgttgttttaggacatgttatatacgttaatttgatcattgtctttttgactatatattcaataaatattatataactgcatgaaaatatctttattgataaatctttttttaatgaacgcaaaagatttgcttccattaagcaaagacaaaaaaaacagtcttctgataaattatgtcatgtctttttcacatattaatttttaaagtaaatttcacaaaactacagatatttgactaaattatcacaaaactatagatttaaggtgatttatcacaaaactacagatttaacaataaatttatcagaaaactatagattttaggctaagtatcgctaaactatggatttactaatgaaattatcacaaaactatatattttgggttcaaatccttagcactaatgctatgtttgagttatatatatctaagttttgtgattaaattgatattaaatatgtaattctgtgataactttgttactaaatatgtagttttacgattttccacttaaactgtagttatgtggtaaatttagtgttaaatctatagttttgtgatacatcatgttaaatttgtagttttatgaaatttactctaatttgtaatattgaaaatatcaagagtttactccttgcgttttatgttataagtcgctttgacttttttaaagtcaaacatttttaatgttctatcaagtttaaaaaaaatatagcaactttcatatcactaaattagttttagtaaatctagcattgaatatattttgatagtttctttgttttatgttaaaaatattactatatttttaatataaatttggtcaaagctaaaaaaagtttaacttagaaaaaaaattacaatgacttataatagaaacagaggtagtagaaaatatgcgacgttaaataatttgataaataaatagagaaattttatggttctggagaggtaccaaagtaccaaaaattttattgtaaaattcagtaccttcttatacctagttagtaagagataccaaaatttacatgagaaattttatgagaaaaaaatacattacaaatgtggtaacttcttaagggcagtaaaatcacttgaataaataggagtaacatgttgacaagtgcatgacactcattgggtacgtgtgagttggcaattacagcgacaagattctttttgttttcttgtagactgttttctaattagttgtgcttcacttgattctagcaatcgccttctaggcgatagcaactgaaatgaatggagtaatatataactctaggtgtgcttcttgccaactttgcttgcatgatttcaactcagataaacagataaagtattgtaagataattacagtgcatgtctttctcatgataaggaaagggtgaaaacaatagtgctgtgtccaattcacaagttactagtactggcataagatattttgctgaaaatttcattctgaaaaggatgtgataaacccatggtctgatcaaaatacgctacttaatcgaatagaagaatagatatgcaaactattgctgacagcgttagagatgcaaagtccagcccacttaatcgaattttaactaaaggtgacaagtccccatgcatttgagcaatttgcagaacatttcaatgcatttggatcagctaaagaaaaatccccttcgcactgaatcacatggttagattctctctgcagtccacgagtactgcaaaataaaaatcagcaaatctgtgggtctt

SEQ ID NO: 54203 - DNA, 14148 bp, Oryza sativa
attgtagtcaccttgctacctactgcaggtgctgaattctgaattgctgactaggtaactattgtccatttagattagtcatgatgatatttttttagagtaaattgcactttggtccaccttttattatccacgtttcaatttgaaccacccttaaacctatctttttaatttggaccgggtaaatttatcattgttgcgatttggactaccatgaacaactttttctcgttatgtctaaattccctttcggtaaacatatgagccatacatagaggagttcggccgtatatcagagctgatgtgtttaaggtcgtgctgaaaaagatcattcgtggtggtccaaatcgcaacaatgataaatttatttggtccaaagtgaaaagatgtgtttaaaggtggtccaaagtgtaattcgctctttttatatttgaaccttgttctgagccaaattaatacagttgttaacgaaaatttgtcattgccaaatgcttgaccgttcatttacctgtcatgtcaccttgtcaaatccttgccagttgtcaatgattatgtactcgttggtgacccaagaatattcttcagaatttctttttgttttgagcaatgaacatggcgtctgatgttggatgccactcgatctagcaagctgggtttgtttgttactcctttttcttaaacataaatgtgactatcagcatatatcatggcatacgtaagcttgctcttacctagtactcccattgattaaattacttacttgagatcaaaataatggagtatttaattactttagataaaaaaatggagtgttaaattgtctggtgcttacgatctacagacatggactgatagtgatggataaactgaatagaccaaacacagtgaatttatctatccctttttcggtcagtatttctagtgcggtggtaaaatttagtgaagaattacaatatctccggttgttaatactgtacctcaaatgataatgcagcttcctctaaatcacaacaaatggcagcttcacttaagattcttattaaacttcggcaatttattaatagagtaaattaatatattatataagtttgatgttaattcttttctaaggaaaaatgttcatacatacaactgctaattaaaagaacacgtgtagcaaatgctggtattaccatgctttattcagatagtagtgagtacgaagttagtatgtttgactagtgccattaattttcaggtctattgtactattattaaaaaacattgatgatgacataaatatatcatgcagacccatgtgttattaaattaactccgtcaggtttttttccccttctaaaaaagagaagcatgagctctgctagtcactaaaggtagaaagtagagtaaggtttgcagaacttagtgcccttatctctgtgaaaaagtgttgtatctgttgatttgtttgctaacagaaaggccatttctttatacccccaccctttctaaaaaaatattgctatctaatagtataatattttcggatgaagggagtaatttttacatggaaatttatgcacattgtttcacaaatttatcatgttcccgcagtgtggttctatccatttctttctctaaagctcgaaacccttaacaagttgacataaataataagagcaccgctacatgttctatttttttcttactaaatttttactaacaatcgtcttaaccgtttgatttagatagatgaaaattaaaaaattctagatgcaattattgcgtgacacattattgttagtaataagaatttagtaagtaaaagtttatatttatagcttttccccataaataatggtggattcttgaatcttgattccctgccgtgattaagaaattaatttggtttctcgattttcttagtgcgagcacccacaatcacacataatcagtggcacctaattaacggaactgaaagtctgagatattagatgattagtgtaagtcattgttatgacaaagcattgcatggcaaggggttgccttaatggactggatgaacttggggttccacgtcagtcgttttctgcagaacagtgtggctacttatgtccactaattggcgtgtggatctgaatttgtcatcggctgcatttacaattgatcaaccagtaggggatgagggatgaaatgagtagattacttttgattaagcaagtaactaagagtcattatcaccttttatctgtataatcacataaacatcttatgtatctttctttgctgctcctccttgattgaacaggcatagctgccattaatattttcgacagagagaaaagagtcattgtcattcagatatatctaatcacggaattagggagggaaatcttcgtagtgagactctcctagtgattggtcacatactgaattcttttctgaaaggtataacaagcgggtcaacatcaagagagaacctaatctagagcattattgttgtctactccgccaaatctggtgtgtcacaagtttttgcttgtgccaacaagaccgggccaatactggatttcttttttttctccatccctttgcaaaatacggtacaaacacaagcgtttatatctacgttcttttatgaataagcgcatataaagcttatccctataaacacgtttataagattgggttggtaatatcttaatattaacaaagttactattgatatctcatgatcacatcaaccattaaaaattaattaactgtaagctagtggatggttgatctcctccagaaacgcagcatcaatagtcactcggatgcctcttttgcgctcaggatcttgagacggcgaaccacattctcctcgactgcgtgtttgctcagcaggtctggctccgtgtactgtcgtcttctggatgggttgccctctctccctcgtggcagctggttctaggactggtggccgtcctccagggcctatttacctgagcatctccgcgctagcttcgactccctggtgctccttgtctcttggcagctgtggaatgaacggaactctaaggttttcgactttgcactattttcagtcaccgtggttctggagtccatccactcggagggtcatatgtggtctttagctggtgtagccgctttttgggacttgttaggagtgtagcgtggctcagcccttcccgctacttggagtttgtgtttagccgccgtagttttctagcttcagttttttatttcgctttttctcccttcccttggcataaactggtctggttaattgcgttgtgtaactataacttttttcttctaatatattaacgtgcaatcttttcgcacgttcgcgaaaaaaaaactgtaaatacgagcattgcatcggtatactctcgatatttgagaatcggtacctatttaaacatttcgaagacaatctaaaactgcacccttcgaggaagaaaaaggcatcaaagtaaaagaagaacattttattacttggcgaatggggatgtgtgctgaacaagtaaaatatctgcccaagaggccaaaatggccgttgagcgttttcctggcttgcgtgttgttcacaataaatcgcaataaatcaaataaaaataaaactgcacacgatgcatcatccgtcaccatcttcacacctcactaattcattacatgcgtttgtttttctctttttatcatcaatatagctaaccggtctccgtgcacacaatattttctctagaaatttctaggttccgtttcttgtaatctcacatccattaattccataaatccccaattgtccatatatactagcaacagaaagttcagacttttgtttcagaaaaggccataaagttactcattttaatttctccagggaaagaaaaagtaacaaagctctaacttcccgtgtcaaatatgtgcaccaatacccacagattatacaagacatgattagcaccggtaaaaagtgggcattgacacgtccaaatgcacgagaagtttgtactttttttgttgctgttttgtttcgtctatgcaaaaaccaaaaataaaaaggaatttgtacaactgaaatgatgatgaaccacaagaaaagaaaaacattggtgtggtccccacgtaattagcaaaaaaaaaagaaggaaaaaaaacaaaggctttgtggctatttaagccgcttcttctcctccatttctccatccatccatccatgtcgtgttgttagcttcgttttcttcttgtttcatcaatccaaggagtgtggaaggccacacgccaagattatatctatgctaatttgattagcagtaggattaattcagtggctagcgtagcttgattagttggtttaattagttggagagtaaagaagatgttgggagtgttcagcggcgacgtggtggaggtgccggcggagctggtggccgccggcagccggacgccgtcgccgaagacgcgggcgtcggagctggtcagccgcttcctcggcggcgccgagccggccgtgtccgtgcagctcggcgacctcggccacctcgcctactcccatgccaaccaagccctcctccgcccaaggtactaatcatcctgttcctctgaataatacagcttttgattaattgtagctgaatttgcttaagttctactgttcttcaccatggatttctcaagatctaaccaaggacagaatcagtgattgctttcatgtgttcttcctgagtcagagtcatttactatatgcttttactctttggttagtgaagtcttctttagctagtgatgatcaactgatcatgtcataatagctctcaatattttattttattttaaaggggactcccaaatcccaagatccgagtgtctgactaaatcagagaaaaaatagtttcttatcgtaacactttgctgattgtttcgaagggaaaaaaatcacggggttggtaaaacatatgcttagaatgagcgggtgtttgggatgtggtacccatctggggaaaaaaatgatttcatctcaagtaattcagtaacttaaacaggcttttaccacaaaaaaaaacacaaaatggtttttttttctgggtacggcacacatcttgagtcaataattgggcagtttttctcctcatataaaggcaggtttgctttcgtaagacaaactgaacaataaatacaactccataatccatttctgtaggttgaggggccaagctaccaaacctcatattcagttcatagattctcatccgaattatgggtcgcatgtctgagatgataattacatgattaactatggtatagatttgtttgtttcagaagtagaatgctaaacaaagaagaatatgcagagattttttgagaactaaatgcacaaaagtaactatcaaaaatagtagttttgccttggtgctacgatatctgaatctttcttgccatggcactccggtaactaggactctcttgccacgtgttacggtatcctggcatcaaatggttggtgccttggtataaaaaacgagagcagaagaagacatgaaagaaaaaatataatcaaaatgtctatgtcgatgtggacatcatcacatatcaatggaagaagtccacatcatgccaccttccacaaacaaggtgttaattgacctaacaacgaacaagaacttatattcttcactaggaatctaatggtatttcaatgtattagatatagtttaagaaaagggataggccaggatgatctatttccaagtctttcaaaagaaaaaggagacaagatagtgttggttgttggacaacttactaggttgcttatgaaaacctctcttgatttatgcatttacctggtattattgtgctgttcacatggcccagttcatagtagagggcactaactttgcaatcagttgctaataccagaagtctatccagttttgatacccacagatctgaaaggaaaaggctggactaggtgacccatatggtcaatcaatccaccactatgatttgtgggcctggttactctttgttcatatcttatctagtactagacagattcagtgaagaagtagcatccaaggaattccactccattgctccaatttttccagtacaagcatctttgtccttattgtaactagtagtagtacaatcttcaatgtagtacaattcaatgttaggtacatcttacccagatcaaatcattgatgttgcacctaattcttttcactctccaattattcttaaagagtagaaatgctgagcactaatcaagcatactaatgctgttcctgaatgccaatatatgttcttttctcctatgttactattaagatgcatgcatcataatacagtagttatgtccttttcctttctgtaaaaacctttattcctcttaatacaaagatacacaaatcttttgcctattcctgaaaaacagtagctggttgagtaacatatgcagctgtcttgatttgtgcaggtcatttgcagcaaaagatgacatcttctgcctgttcgagggagtcctggacaatcttggcaacctgaaccagcagtatggtctgtccaagggtgccaatgaggtgctccttgtgatcgaggcgtacaagacgctgagagacagagcaccttaccctgctagcttcatgctctcgcagctcgccggcagctacgcctttgtgctcttcgacaagtccacctccaccctccttgtggcctctgtaagttttgttcatcactgaatgctgttgctgcatcacttcacttgcattgtcagtgcctgaagatttggttgattttggttacagattatgacgtgttcttgtgctgtgatttgctttttcaggatccggagggaaaggtgtctctgtattgggggattactgctgatggatctgttgccttctctgacaacattgacctgcttaaaggatcgtgtggcaagtctcttgcacctttcccacaaggtaatgtttaaactttgaacagtaatgcagcgacgaaagatgaagcatttactataaaatttgatctctaactattgatttagttaggcacaattgaccttttctttgtttctgttcactaattcatttcggttgcaggctgcttctattccaatgctcttggagttggaggcttgaagtgctatgagaacccaaagcacaaggtgaccgcagttcctgccaaagaagaagaaatttgcggtgcaaccttcaaggtaaaaaaataataataataattgatggcaacctaaatacttaactgaatacattgtaaccgactgatgtcaaatggtgttttcaaccctttcttgggtcgatgtgcatctcttctttatcaatgaaatgaggcagagcttctgcctttgttcaaaaaaaaaaaacattgtaactgactattttctcctgcatttcgtctgaactcaatagacatttttgggtgcactgttaattaacacttttgatttgatatatgcaggtggaaggatctacaatcctcacagcgctgcattaggagatttttggatctccagctgttgttgggaaaggaaaactctgtagtctgtaaatggtggtgtaacatagtcgcaaggcatgcatctgatctgtatcatcatcttccgtaaagactagtgctgccagcatggttagcacttttcagtgtttgggtgtgtgtatgatctgtatcctatgctgttcaggcggaaatgaacttcaggcccagctgtgtcagttgaatgtagttgtgttgcaaataagtttttcttgtttgttatcactgtgattgtgtcttatgcagttatgcttgttgccggatactattcataccacaaccttaaccactcctattttaacaaaaatattttaaatgtttaaaaatgtattatattattgaaatatgttacatgctaaaaattttctttacataatgatatgatctagtagtaccacctaggaataatatgatcttaccatagccatgtaagtacaccaaaccagatttacttccatattgggcattcaaacaacaagtaatttatggtttccagattccggaaacatagctggtagaaataattatttgaccatcccctaagttgcaaacgatctattgtccatacccgattttgtagcgcaagccaactaaatatctgcattttgctagaacccacgccttccaaatcaactctgcggatggcgacgctatcattccgttgaattgaaactgataagcggattttgtgctatacttcccattggctgtccttttctaaaccatagagttctctactacatctgtcaattctaaagattcatgcgttcgagcccctcatacttgaaagaactctctgagttaaggttgtgacatatgtcatttacccaccttcttgttgcaagggctcctggattgtgtggtcttcctcttggtgcttctgtagaggtctggagctaagttttgaggctttgaacactaatccaatttgatttccaaagatcgcttttcactcatcactatccagtactttggtcgatgctgcaaacaaatttcgaaaaattataggtcaggttgacacgagaactgggccagctcttagtcggcacagaagctttttgggccgcagaaatattttcgtgggcctgattcgccgatcaaagcctagcagaaatttggttgggctggtatatatggaccgctacatccaaattcatgtgagccaacatggcccgcaccttccatcaggcccatactggaataaaacccaagtgaaacaatgggcttttctcaaccagccaaactcgggggaggaggctatgtgggctgtaaggtggccggacagtggacgaatcgggctttaatttgtcaaatgtcgttcatgcaaataggctacagcccttacatgcttccacaccaaaaagaaaaaagaaaaaaagagagagaaaatttagagggagagacattcctccaaacaatttttaacaagaaaaattgtaaacgtgttagagattgaatatgagacttcgatattgaaaccacacatctcttgtcaccaggctttactaaatcatttgggatggggttactaccacctcacgatttgatggttaccgtgctaaccgcgcaattactatgaaaaccgcacggttaacgcgatgtataccgtgattttaaaaactaaaaaggttaccgtacgtgacaaccacgataactatacggttttgtaaaccttacatgtcaccgtactatcatgcttccacgctttctgatgttcgaaaggagcaaaaattttcttcattttctaaacaaaggcagaacccatgcttcattttatattggtaaagaagaaatacacacgaacacagaaagcgttcacgccgaaaacacaccatcggaacttcggaagaagcagaaatttcacccctgaattggagtagtactcttattgatcaaacaaacagagaaaatcgaacgtgagaatggattaccggaaatactagcaaaagctgcgacgaaattttcggtgaatgaaagaaatgatgttcttgatcgacccagctgggctgaatgctcaagtagccgaagatcgtcagcgaaatgggtcgacaccattgtgcacttgcctgcaggttccaatgttcagtaggcctccaaaatatctagccttttgatattctgatctctgaataataccatccccgctttctgacgtctattcaccaccatcagaaatttcctttttgaaagatccagattagtataaatcctctccttgtcttgaaagatccggatcagaaaattctcttttcagttcattattccatacctgccgaatctcaaatctgtgcttagattcagcgtaaatttttttaccgtgtaaaatcggatatacggacacacatttaaagtattaaacatagtctaataaaaacaaattaccgattccaccgatagatatttactacgagatgaatttattaagcttaattaatccggcattagcaaatatttaatgtagcaccacattgttaaatcatggagcaattaggcttaaaaaattcatctcgcaaattagtcgtaatctgtgcaattagttattttcttaacgtatatttaatactccatgcaggtattcaaacgttcgatgttacaaggtgaaagtttttgcggtgggatctaaacagggtctaataccgaatgctctttttggttttgttatttcacttaagatagatttttttttactcctatcattttaattttcatatgtataatcttacatcaagattcgttttcatgtagattcaacttacaattagacttaattataaagcacttacactcaattacaatatatcgaaattagattttatgactgttttttctctgaatttacgatttttaacatgtttttttattcattcaaaacgaattttatctattaattaaaaattgaataagatttaaacccctgaatctatcagaagattaatagatagtcccacgttcttttcctttcgaccgagtttagttacaaaatttttcttcaaactttcaacttttccatcacatcgaaatatttctacacacacaaacttctaactttttcgtcatatcatcctaattttaaccaaatttttaatgcggtgacgagttacagcgcattattacaacgccgtaaaaactgacatgtaaaacgggcaattgtggaggttgaaggtactgtggggcagggcagcagcaaaatggcatgtgcgggggccacccgaggcagcagatgccatgtgacccctgtcgcctcctctcctccatcaagctcagccgttccagcagccaaaaatttccatgctttctcacgagctcatcagagagcagctctctctactgatcaagcaaccgattctgatgcacggtaaactcgtttctatccgacggtaatatttcggctgtcaaaatgcaaactgcagctcccatcgatcaatcttcttaagaaattcttcagtttaatttacgcgtaattttatcattcttaacacttagtaagtatatagaagtaatatacaattttctaatgtaaaatttggtatctttaacattaaaatttgaagtgtaaactttagctacctaaagatttcttaagaaattcttacgtttaatttataggtaattttatcatctttggtaagcatataaaggtaatatattatttagcgtaagatttggtatctcaagatactttattagtatcctcaagtatcaaaattctggtgtaaactttatctaccacaagatatgctccaaccgtaaaatttctcttactttacataccgatgatgtttgtgttctgcttctaaactattgtatgatcatatatggaaggagagctggtgaataataattaaaccagttactagctagctaaactgaagacaaaacaaaagggaaaagatcattgcgtgcaggaaggttcggattattctagcagagtgctctttttactctaaagcagcagtagtagttagttaaagacagccttttctttttctccttctagatcgtgagaatgtgatcagatatattcatatacgtagacatcactttgcaaagtgcagtagcttaaagtatgctaattaagcggcagcatggaggcataatttgctcgatcagtgataggctgatagcacgtgatcgatgctagtcgccatgatttctggtgagttgattactccacactaatactgctgctcaatagtggtttgttcaggctgattgtactgagtacgtactctctctgtttaaaacaaaatcaatctagataaaacgtaggaaaatgaattataaggttatctaaatttattgtgtattgttacatccaaacctactcatgtaggttaatttttttagatagagggaatagtctgttcatattgcttgtattagtagactatagtaagtactttcttttgtgtatagagtagggttctatgtcggctgtaagggttgggttttgagcaatcccggctgtacattctttcttgccctaacggtggccagtcacgcttagcgacggccggtccggtgctagccttctccagggtctgtgtgttggtgttgtcggtgcgtgggtggtggtataattttctttgttttcaggttacaactgaacgcgcaaagatgtagcctagaggggggagtgaataggctttcctgaaattcacaaacaaatcgcagcggtaaaattcagcaggaccaaaacttccgggtgtggaataccggaacttccagtctgctcagattgtccggaacttccgagcaaagaaaaacctgaagatctagcagagacttaaactaatttgcatgaattaaactacaggaagacagagcagatacacaatcacagcagcatgcacagaatcatcacagagaagacaaggggaattttttcccgaagttcggatctttcaattctactctccgttgagatgctccaaagagccgggtctcgattaaccccctgcctcacctgtgcaaagaacccagaagaagtccaaggccttaaacaaaacactcctaggtcattttctagaatttgaatgaccaccaagatccaactcacaaatacttctagaaaataccacaagtgcaagttgttctaccaaggagaacctctgaaatctttgcacaagaatctttactcacttacctcgtttccttgcggaggtgaggaaaaccttcaccaactttcccgggacatccacaagattttggaagctcgcgggcaacacctatccgtctaggagaagatcttcaagagtaataagcccaagtgacaacccacaagatatccaaagtactcaaccatacctagtcttcaaaccttctccaaatcactcctacactctcatctattctctcaatctcacaagaatggctttagatttgagtggaggaagcaaagggatcttgggagaggctagaacaacctaggggatgaaagaactgaagtggaatagccaaaaagtgagctgggtgcgatctggatatatataatggctaggtgacgtctagccgttactcacatttttgaactggaagaagtccggaagttcctgaccctcggaacttccggccaacacttaggcaagtttcattcaatgcaatgtcagggaccggaacttctggccagccttctctgtccggtctggacccatttgcaaaaatggctcccaaaaatattctatcactaagaatccactaagagcactttttatatctcagaaccacacttagaacccctcttaatagtacggttttttctaagactcaatttcaaaaattaaactatcctattgaccttcgagcttcaaatccgcataaaagaatgttgtagggggtctccaagcatctcttgatcacctaagatcaccttgggacactggtggagaaaccatctttacttccggttgggaacccccctttaatcccggttttccaaccgggagtaaggatccgggactaaagatgtccatctttagtcccggttgaaataaccgggactaaagatacatctttattccctaaagagagggatctttagtcccggttgatgttaccaaccaggactaaagagacaatagcggcagtgcagatggttcctttttctttttcttttttcatttttattttctcccgaatcaagtaggcaaatccctaaatcaatccccaaatctaactaacatcccaaattcacatcaccaaatccacatcacaatcataaagttacttatacacacaaatcaaatacatcacaatatcctaagaaattactcaaatacatcacacatccaaacaatgaatcacaaatttctaacttctcagtcaaatacatcacagtgaatcatcacaaattaaaaaaaaagaagctgctgccgccgccggtcgccacgaacgacgagcgcggccccgctgcccgccggccaccgcggccgcggccccgccacccgccacggccgccggcgcccgaagccccgccgcccgccgccgcgcgctgcgccgccgccctccgccgggcgccgccgcccgccgtagcgcgcggccccgccgccggccacccaccgcggtcgtcgccctccgccggacgcgaccccgacgggcgccgccccg

SEQ ID NO: 54204 - DNA, 1990 bp, Oryza sativa
ggttaaaaaagtcaacgacgttaaacatttagagaagaagggagtatatttttcaaagctagaaatacttcctccgtttcacaatgtaagttattatctagattcattagcatcaatataaatgtgaaaaatgctaaaatgatttacattgtgaaacggagggagtacgtgtcagtatttcggtaaaatagttgaaagcagctgtgcttgtttacaaccacgagaccacacggagtaataccgagcatcaagccacatcgcacaatgcagcatgcgcctcttctgtacatgccgctgctgctgctgctggctcccctgcctgcgcgcatgtgtcgcgtcaaataaccgcgagaaaagcaaagcagacagccactcacccagtgtcctgcatgaaactcggagcgtagcggacgacgaatcttgcgtcacagatcgccccccaacagcaacagccacaccgatcccccgccccgtactccactatacgtaggccacccatctcccaacccggcgtcgcgtgggcgtggctcgtctcggcgccggttgcacacacacggtggatggatgattggatgatgtgctgccgacgaggcggggagggcgtacgcgcgtaggaggatggtgtacgtacgcgtggggtgtgggtgggggtggcgggttgtcgagcgaggcaggcacatgggccggctgctggctgcggctggtggagttgaatggatggggattctgtccgcgacgcatatggcgagacgcgcgcaggcaggcaggcagaggcagggtttgtccttggctgagactgggatggatgggatgggatgaggaggggccagcattccgatgcgcggcctcgaccaaaactgaccgcctcctgtacggttctttagtgctcaactgcgcaacgtcaagcatatcgtaccagactactactcctcctcctacctatagaagcagcatttttcaaatcaaatcaagcgaaaaagtacttgaggaacgcagggcttgccgttactctaatggaccactagtattttcgtggagcatttgagaaagtttagaagtaaataccgctataatatggccctgtttagtttccacacaataaatttataccctatcacatcgaacatttaacacatgtatgaagtattaaatataggctaaaagaataactaattgcacagattatgatcaatttgcaagacgaatcttttaagcctaattgcttcatgatttgataatgtgttgctacagtaaacatttgctaatgactgattaattaggtttaataaattcttatcatcgtttactgacggattctgtgattagtttttttattagtgaccgaacatcccatacgacaccctatataatactcgatatgtcacgccaaaactttacgcccctgatctaaacacccctatcttcgtcgtaaaatatcttaatctagtaccgtgtctgttcagatttgtactgtatctaatatgttacgtctcatgctagattaatttattctgagacggacggagatagtagttgccattaccatctttttcctaaaaattagtttatttttcacacatctcacatatatcaatacaaaaccacattgattaaaatacctctactttatcaaattgcaataccataatttctcattttatctactctcaatataattatattctattttgcacaaactcctatgcaataattaatttgaaaataaaacttattttatgacaaatgaaggatgctacaaataaacttaatatgagactgcgcaagtagtgttgtcgtaatagctttttttactctccctctctctctttgtgaacttaatactccctccatctcaaaatgtttgacgccgttgacttttttaaaaatatttgaccgttcgccttattcaaaaaatttaagtaagtattaattattttcctatcatttgatttattattaaatatacttatatatatatatatatatttac

SEQ ID NO: 54205 - DNA, 4434 bp, Oryza sativa
  unsure (1)..(4434): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcggtcttttgcattctgtattgctcagtttcacgagtttgtagtaaatatctcaatcccattggtcagcttggggggattgttttgatgtttcctattcaacctttgagaaaattcttgatccctgtttggacacaaggttacctacatgtgtgtcagtagtcactatatctcaattgcacaaactagatagttttcactcacttctcttgaaatcatttccaaagcatagtgttctgtaccaagaaatatagttattgcatatcttcatctgtattattggaggcgcttagtgcagaagcataatgccataatatggtaatggtgagtgcaacatacagttcataagtcaaaatgtacaccaggaaagcaaaggaagcagcttatgttacttgagtgatgctatcttgagaatgtaaaccagaaaagcaaaggaagcacaacatgaaaatgtaacgatttgcttctgcagcagccttacaatatgcataacttattaatttgccactcaatcaaagacaagaaatatccatgaaatgtaacaaaatttacctcattgtcctgttcaagagtatctatatcttcatctgacgatacattctataatatttatactgaactataaatacttatatttttccgttctgtgatttgtctacatcacaagtacaacataagatactgtactaatcctgatctcaaggtctccctcctacatcaaagaggttaccttgggtgtttttacttatccagtcaacattccaccttatcttgcattatattatgcctacttgaatatgaaagacactacagtaagattttagttgccacaaaggcactaattgaaaagtttcaatattagatattcagtgcaggtatcctgtaataggtgcacattaatatcttccactagatctctctgtcttgcctacatggtcttttttgtttaaacagaaaaggggttacttgtttgtttttcgcatacaaagtcagggtcctaacaatgattgttttgcaaagttgcactatatgacacttcctactttgtagcatccattgttttatctgttcaacctctcactggtttttcatcaaataatccattttgcaaatgcaggtagcgagatatgctacttcaagaatgggatatgccagggcactgcttttgtggacattcctggagggcggtactacccagctgcgtcaatgtatacactgcctgaccaaccaaactgtcaagtcaggttcaactttggtcccaattttgagttcttcccagaagattttggaggtcgattgattcctcgaccaatgagtgacgtgccttatagaccatttgagctggcgaatggcgggcctgctgaaaatggtactgctgaaaaaaacatttaactgcagtgaaaattctgctttagttatgtagaatagagcataatcatgtaatccggttaaagagcgcgcaggctgattggttagtttgtctggttattaaatattttatcacctgaggttcttctggtttggccatttgaccttcgtgtagcaacgcatggcttcaatctttcccatcaacgcatggctttaatactgttaacacaagatttcgtcaataatgtttgacagaatctgatacgtcaaatatttatgacacgcgcggtccgctctgtgtgtgtatctgatacgtcaaatatttgtggcaatacaaggataacagcatttatgcttgacgatactcaatctgggcttctggggtagccaggtagtttggagaacctttgaagaaaaatatatcgaaatagcaatatcataaatgataacattttggacaccggtgcagtctccaagtaaagaaacacaatgtttgcaaagcaccggacccttaattttcaatgtttcatatcttaatcttaaataaacaaatacaacaaccagcttcatcattctgcgagataacagtgttgagcttgaagacaagtgattttcaaacataaatatggaatttgaaaagcctatgctgaagcacactcacaaattacaaagtaacaggtgactttttgcatagttttaaatgcatgtacataccaacatgagagaaataacttcaacttgagtgccatttgattttcagatggctacaggccagatcgtttttcactctgctcaatgccatatctcgatgctgcagcaatgaggtcatgctaggttcactccttttgcgtgccattttccgggagatgttcttccattttgattcaaattcacaggctgcacacaaataattcagtaaataggaattcttacgtagtagtgcaaacttgaaaagggaaacattcatttcatttcgatgcaaaagatgcagatggcacctgagtatctaaagcacatagacaatgttaatgtttctctgtgcagaaaaagaggtaacaataactaaatgtttctttatgccaaagagtcaatgaacatagaaaccttgatgaaacactaattatataatactaaacaaaacaagaaaagaagtgaccagtacagacagtcatgttgtcaaattgttttggtatggctaaataaacatagcttcctagggtaacatgtcagaaaagtaccaacctatgatacaaaataatttcagaaaaaatgaaatgactccctaaatcaagtgaaaactggaaaggaaaagttgcacttacaagctagagcactatatggctatacgcaattctagtaacatctcaaccaagtctgaagctgttggaaaatgatggttacaatcaataaccttcacttctgttgacaaatccttcaataaggcatgcgagattccatggccttccagcagaggaagctttggcaccaccttttaactcaccattatgttgtctcaggctagaaataataaaaatactttcatcaacacacgattaccatttcaacgtggtacgactaaagatgtactttctttgtttcataatgtaagactttctagcattgtccacattcgtatagatgttaatgaatctaggcatatatatgtgtctatattcattaacttctatatgaatatgggcaatgctagaaagtcttacaatctgaaatggagggagtataaatttacttctcatctttgtactttctaagttctaaccatgttaagtgctatgtattccaacaagaaccgatgatcaacacacaaaaaaaaaccccatatattgaagcatgtatacaagcctgcctgagcaagacaactacgagtagaatatttcaaggcaactacaattttatacacgaataaaaggacaagctttggtatgcccaacgagtaacacagttctgcttgtaaatcacagcgtcataaattgaagataggtagaaacaagagcaggcaacagcttattcagtagaaaatattatgcatgtttaacatacattgctaaaagtagaacaaattaaggtttaatccatgctcatttttttttgaaaggaatcaatccatgttcaattatcttcactaaagggactgaacaataacctgagcttcatttgttttcccaagtcctaaaaaagtactaaatatatgaaaatcgcaaggatttcagtccaattgtcatccgaatcatgtaactttcaggcctaatatcacatctcatagtgttaacaaaacaatagcgataaattgggggcagtatttcaatcactaactggcggagccaccataacccacagaatcttctgaaacagctctagaaacagtgaatcaaagggattcggggaatcaccggcgagggaaatcggtggtgacgccgacgtaggtgcgggagatccgggaggaggcgatgaggtagacgcaccagcccaacgccgccttccccttcgcggcctccgccgacggattcccgggcgcgcacgaggccgaggccaaggcggcggcggcgggctcgccggatttgggaggaagagcgcgagggatcttcgccgatcggaaggtagcggagagattcatctcccacctcgccggcggaggcgacgacgccgtggggaaattttcgaattgggctatttttagcacgtgagttttagagggccgtggggcgtgttggacatgggccgaatggacaaatgggccgtaccgaaatgtgagcctaattcgacacggccattttaagcctggaaaacgtggattttttcatttttaaatttat

SEQ ID NO: 54206 - DNA, 6970 bp, Oryza sativa
gtcagcttgccgcccaaatggagggcggcaaggtccatttttgtaaatctttccgctgatataatatttctgtaaatattaaaaaaataaatttaaaaatgaaaaaaaaaaatcaaaaacgtgcgtagaaaatgaattccggcatgcttcgcacgtgtgaaaatatgtgataaatcagaaatctacgtgatggaattcggatgattatattgcagaggttgcacgtgccaaattaccgtgcatatactagctgggaaatggcattctggtacgtgtagggagaagactcgtttgtgccaactctgaagctggggtttaggttgtcatgaagggcaaaagaattaggcactaggtgagtgttaatcagagggtggttaggcaaagcaaccctggaaagtttttccaaatgtggaatgcaaactcgcagcatgaaagataattgggcgctaattgcctctgcattacagtgtgagcattttgtggatgaaaccatacggatcgtatcctcgctgttcctcatccgagtctgacactaagatgttcagttaacaggttgatgtgaaatacttttttcgcgaacgtgcagaaggattgcacgtcaatatattagaagaaaacaattatagttacacaacacaatcagccagaccggcttatgccagaggaagggagaaaatgcaaaataaaaggctgaagcttagaaaactacggcggctaaacacaaactccaaacaacgagaatgggccgagccacgctacactcctgacaagttcccaaaagcagcaatactagctaaagccacatatgaccaagccacatatggttatgttccttccacagttgccaagagactaggagcaccagggagtcgaagccagcgcggagatgctcaggtaagcaggccctggaggatggctaccagtcctagaaccagttttttcattcgtgtccgaaaaccccttccgacatctggctaaatgtccgatgtgacacccaaaaattttttttttcgcgaactaaacacacccttaggtggcatgcacgaaatgaggggatatcccctcgagggatgaaatcacttttccattttaaaggatatgacttaacgcgtacattgtcagaaaattgggcattcgttgatgttttctcttttcatagtagaacaaagcaaattaccgattgttctgttataaaaatggacaaactacatattttcaccgttccagctccccattcttattcccttctgcaccggccaaaacgctgaacattacaactgtcgtttgttcatggcgctgtaattcctagtacaaatacatttttacacctctcgcaggataaactattagtggcttgcatcaggcgcgctgcttcttgccactaggtagatcatcatcataatgcccaccatcatcccctccatctttgtcacctttcttcctcgcaagtatcttgttaatcttgtgtaggtcattcgtgagcttctggtccttgttctgcttcctcgtcttcctgccatcctgcatcttcactccaaactggaatgcagctttcggcatcgcttccttctggtcgttgtatttggcccactcctcttccgtctcaaagtcccacctatgaagacgccccttagcctgcaaaggaatcatagtatcatacattagaatgaatttggcagagtcaatcaaggaccatatcatcctaagagatgcaaggcagctacaagcttataggagaaatttggacttttacatctatgtaatttggcagagtcagccccaaatttcttggagaaagttactgtcagctatcataacaatcagggcatagaacccacttggtttgcagcctatgcacacactttggaaatcaagaaacagcaggattttttaaagatggcaaactggtatttcagacataattcaacaaatcatcgatgctctagaactatggagtaaccgggccaatcccaacaccagagcaaaaatcaatctctggtctgagacaatcagatgaggttaatgtaattttagcttcttgtaattttttgtatattttcctccttctatctcctttcccttttttttctttttttcctgcttcacctttcttcaggcaactctgtaaccgttcatttctatcaatgaaatggctatgaggtagagctggctctaccttcttacataaaagaaaaatatattataacgaatttggaaatagatggtaaaatattttttaaaaagtacagtaaacatgagctcaagaattccgcaaaagcaagttatgtctgctattgtgaagggaaacaggaaaaaaaaagcattcagaatacagtactctcacttacccggccacccatgtccatcttcgacaaatcatcttcttcatcgctgcctgcaatctcatgattatactcctgataaccaggataacactcggagtaactatctgagataaaattaggatctttctcccgtgaatctttttccctcagctgcttaagcctttcatcatcacgtttgaaaacagaaccaagacctctatctttatctgcttgagtcatcaaccttggatcctgggctatatttggatcagctaatacatcatagtcctgagtgctttgttgcatgtactgttctggataaggcatctgttgttcaccatactgatagcctgaccactccccttgatatccagcagctaccatttgagcttgaatagcatcgtatccattctgaaatcataagaggcattaacttttaggaaatacaggtcaagaatagaacatactaataattaatggctatttcagtagaaggtacaactatgggcaaaaaaaaaatttagtttgtcttgaacattggacatgcatagctcaaattttactttaagcacaatggaaccggagttactaaacactagctggattaccgtttgtggccaagcttgagcagggtccgatggtgggatgggcccatagacaggtttctcttcagtgaaataggactgcttttgatggttatgtggggactcatccatatcttcagagacagggctatggctcatttccttgttaggaacagaatagtcaactccatctccaacaaaaatgtcatcttcatctgctctagcaacaggaatagactgttcctcattcttgcttaagttattatttcgagggggtggcggcggcggcatgtccttttgaaattgatgtttcagagaagaacctgtttggccaggtctggctacctcatcatagtcaccacttgctaaactgttattccctgcaatataacaagcataacaagaatcaggataatctaatttcatcgagcaaagcaagtgcagatatggatgagagagtacatacatgcaaatacattaagtgaactaattaatccgttcagaatctaaagtaaacgtgtaacatatggtcataacttaaatacccaaacttaaattattgacagaagactataaatcaattgtaacaagactcaaccattgtggcaaaaagtaccaaataatacttttctattttttcacaatgtaagtgctcagcttccaaacaaatcattttatattttcctgatgtcacttagtttttcagtcaacttccactgcacaaaatccatttcaattttcaagtaacataccttttgtgtccctctcctttttctttttcttcaagactttcccagatgatccaagtcgaaggtatgacatgattttagcaatcctatcaagtacagaaccatccacactgacagttaccatctcctgcagaagcaagaagaatactgaggaaaatgataagtttcgggaaacttcaatgtggtatatgatgtattgccataatacctctggaacagcgcaatcagctttgctcctgtgaagagttgttgggatatcattggtaagtccatcctcctggtttcattaatgaaattaattactcttccgctaaaacccatagttcaaatcaaagcaggaatgatggaaaaaattatttgcaaatagcatcaatcaatagtactggacatgctacgagatgatgagaataggtgatgaaacaccattactcttactctcagaaaatcatttggaagggtgaatccagcaaatgaaaccattagcatcaaaaatatgatctagtgatgaattcagacatgtaagttggattgtggtcataatgaaggttctgcatatagtaatcattgaagctgtgatgcatcacaatcacaatttaaatgtgcacaacataaaaatcattgcagatatgtaagcatgtaacagcaatactatatagtctattaatataatattggaagagtttttttcatccttcctctctttcttctcttgtttgcatattgcgaagttaattgagagcttgagcatgttgattactgtactccagatgatgagcagagaaacagacaataatatatcatgaaacataggcatgcatcacgcatattataaaagctgataaaatagtagaaattgacaaattagctgataacatagcatagagttgacaaattagaaattgaaataacaataacgtttttttacaaaatagtagcatcatgtttagtacggatgaattctgatgagtgatgaaaataaaataatatacatatcattttattaaggaaaatggtcaccaccaccacaaaaataaaagtaattaacatacagaaagcactaaaatggggaactttgaaggaggtaccatgttgtaaataaatgccatccgaccaggaagaaacatttcattctactttatgatgctttgtggctttatgatccatttatagacagactgcaatgaaccaataattgcttttagtgtccattacatggtcgataatagaagaagcaaacaccaattcttttataaattaaaaggaaatccacctttgcagttgcagtgcggaatgagactgcctgatcttcttttgttgacctgtacaacacaagttcacaggttaaatatcaaatatgtgtatcctagttaaatactaacttacgatgtgcatccagacaaggatgaaggacatgaggccaaacttcatagtgctacatcccaaatcatgaaatgcttataaacaattattgtattattccaatgacagtcctgatttttttaagataatacaaatccagatttaatactgtacaggaaatcatgtttaactgagaatgatccagcggccactataaagcatagcaaaattataaataattccaatgcacagaataattctgcccgacagtattcataaagaaaataggaaaccatccaccataaaaacacctactaaaattctaacaaaagaaaaatggatatctcttaacttcacctcacagttacaaggaggactaggcctaaaaaagcttgacaatttgttgtgtcatataataattattggaatcaactccccactttcttaaaaattatgcaagtgataatcactgtaatatattacagcatttgaaatgaagcatggatctgacagcttgtccttaatccatatgactactccctccgtcccacaaaaatttgattcctagggtcgatcatttgtcccacaataaatcgattcctatgccagagatcgagaaacactaattgcatctttatcattttccctgtgttgtgttgtccaccacccaccgggtgaattaaaaaaatgaaatcaacgcatcatctccagtgaagggaggctgaggaagtagttgggcacgaatttcgcaggaactttttttatgaaaagtgctaatcatggttgtacttgatgagggtgttttggtcttttgttgcttggactaaaactgcattgggcttctaggattcagttttacctgggatggagggagtacaaaactaccaggaaaaaggtatgatcaaatggtatgaaactaaaactgcagtattgtgggaaataccttgtctgtgtatccttcccatcctctgcatcaggcttcttttctatttcacttcgtactttgtgaagtagagcatagtccaaacctttgaccaaatgtgtatgttccaaatcacctttaagacacaaagtgaaattaaatatcaatcaacatgatagttcagaagaaagacaaaaaaaagttaaagaaaaagtgccagccatctaagtctccaaatctacaacaatatatcatagtcttaaaaaacatgtccaactgaactatccacctttagttttgagctatcgaacctcattccttgactgcatactactgactgactaggtcaaaataccaagtatatgatagctctatatatttcaaattaaaaaggaacctaaaaatcaagcagctatttgaaaccgcgacaagtttgtggacataaaacagttccaaagaaagattcaaattctcatttccacagatgtcataaccaaactatgttagaattttaaccgtttgtgcagatctatgagcatttgtctatacataaatgaagtgtttaaaaaaacaagtcacaacataaattgttcccaaaaggatgaaaagcattttcttacaaggaaagagtataacactgttgcactaccaacctccaagatatttgcttttctcaatagatatcttgtgtacatctgctagcctgtaatacgaaaaattgcagacgttgagttccagaagagcatataataaaccaagcaaagaaaatgtcagccaaatgagacctgtggtctgttaccttaaatctgctccgggaggtgccacagcatgaaatgaaccaagctctgtaggttcatagtcaaggttttgatcttcacggcactccttagcacgatctcgatacctaggtgtctctggttcttcctttttctcctctctgcatgggaaaataagggagaattaggttagccaaattgacttgctccctaaaaccctaaaatgccggaagtagttttagttgcatctgattta

SEQ ID NO: 54207 - DNA, 39139 bp, Oryza sativa
agggcagtcgggtaatttttttcagattggtaaagaaatcaccactgcacctaattattttctttttatagtatgcaaggcagtgtattgaaagtgaacgaaagatctagttaagtgggatggttcagtgagtcaggtcacttgcatgattctttagaccctaatcactgtctaacaaggtggctataagattaactgcaagaacaacgacttcagtcgtttgttttgattacaaaaattcatgacaccatactactacatagaatctggatctcaaaaactattttacaagcaaacagtaactataccatcaaatgttgcaacttcttctttttatttttttgacaatctacttttaataaatttctcctacagtcccaaaacatacagattttgtttctacctcgaatcagttacatctttctaagtgaaatgatacttacttccgccgcatcagcttctccttgtagtagttcttcttggacgacatcttgtccaataagccctaggaagccggcggtgcgcagggtcagcgacagggcaatgaaaccgacgtggttaggaggcggcagcgcgtagccgccggagacgaggcaagctcatgggcaagggggcttctcgctggcgctgaagtagacgagacgacgacgacgacgggggaaagcggtgcggcggcagagaagagaggtgggggagcgcagcgccgcggcggcttggaaggcgagtgcgtggaggagggagagggaaacgcgcgaggttggccgcggcggcgccggagtagcaaacggtagtggatgggagccgaggcgggtcggagggaggtggggaaggaagtccgtctgatttgcgcttgggccggccgcgagcctgtggatgagatgggctattgggccctttcatctccaaagaaatcggcccgctatccgaacgaacggaggattcgttcgcgcgtttgtttggaaaattgcctcctcctcctcccatctgccttcccttgtcgatcgcacatcacccccacgaaatcagctgtcatccgacgacgaggaggagatcaaccaccaccccacgcacgccacatctccacccaccaacgcggctgcctcctcctccgcctacaggcgcgctggattggacaatattccccgcctcgactcctcgagccatccagggcctgtgtgaggtgacggtggccggcgcgagagaagtcgagtgtgccgtgtgtctgcaggatttcgtggcggtggacaagctcaggatgatgccctgctgccacaccttccaccagcgctgcatcttcgactggctccggctggcggctgcgatgcatctgctctctctgccgccgccccctctgcccacacagcacaacaggaggatgataagattgggtgcccggagccaggggcggagccaggtgtggggcagcttgggcccgggccccacacctggcagaaaaaatatcaaggaatttactaatttttctattaaaattcgttcaagaagtttatactctagtgattaagccctacttttgatataatcctggctccgcccctgcccggagctaggagcgaccctgctgatgaaccggctgaagatcccccggggctccagctaacaaggcaaataacaaaacctgaacaaaactccctgccacagtttaccaacccaaggacactcgcagctagcacccaaaacagagaccaatccctactcttgctagacgaaggtcgttgatcgcttcacgaactccagggtcggaatttcttcagccttcagaagtggcttccactgcaacaacagacaaatcacgcgcaggggaattgctaatggagatgagacaagtttgcatctaaaaatcatatcatttctgaaagaccaaagcaaccaacacacagctgcaaccgcaagtaacatgcatctgattctagtttttttggagctatcattcccaatgactctggcgaagaaatcctcaaaactttgaggtaatctagcccaaccacaagcatctctacaaatacaagacagcaatagggcagctaaagcaaatatgcacagcatttccaatttcaccacacagttgacaaaactctgaacctgcccaccctctcttcttcagttgagcagctgattgaatcctatctctaatagccagccaaatgaagtgcttttgttttgagggagtgggggaactccacagggcaaagtgatcatattatacattgatttaggcgaataggcccctttttttgtctactgccggatcagtatatcaggttcatcggacactacaggactgttctctcaactagggaagataactccagccatttttctagatccccagagttgaaagaccttctgagagacagcacacccatcccctgggtaatcacctctcttagcagcaatgttttgttggtgccaaattataacttaggaaaggtagttttcgatggatagtttccaacccaggtatctctccagaaatagttgtgatcccccctccctgcaatccaagtagaacccatctcttgactctgatcaaaccttgccagaatttcagctctcattgttgttagttgtagccatgtcaattatgctaacaatccttgttctgttgaattgaataagtttatgctaaaagataactgaagtctaatttaacaagaaatgcgtgtagcagatgttgggtttcttttgtggtttaactgaatattgcagactgggggactgaataactggagtatagagaaattaggccaaatacttgaaggaaatatcccaggataagcaacaaaagaagaaatgtttgaggtttgatgaaaataattagggacctttttaactgacacaacagttttaagacagattgtataaaatgtgcacaagaaggtataaagaatttagcttatggggaaaccgacatgttaacaactcctcctgactctcaataacccctccttcctgttccggagtgtaaatcctatcctttcttcttctaccattagccttagcatggaaatactttatgttattatcaccatgataaatcttgcgttccactcgagacactcacgactatgattgatccgatctttcgatgagttgaagataactacgatttgagagaaacgttgacgacccaactacaaccatacgagatgttgttgtgttgcgccttagcgatcgatacacctttccgtgggttgttgatctagccagtgtagatcaaccttattcctgcaagcaaatcgagaaaacaagcaagaactagataaaaacaatctgaatagcaaaataggaattaaatacaaatgataaattagggttctgtaacgagcaaatcagcaatctaatcgaccacaggattacacggcaaagtagtgaagctaaactttaatctaaacaaaaaccaaaaaaccctgaagaggtacctagctatttaagggggtgggaggatgaccaaggggtccctatggtcgtgctccacctggatggggtgcaccccacatgggctccacttaggctgggatcccaaatgaagttacatgcttatagacccattatgagtgacgtaacactttgttcatatgattgcggccgactgagatggaatttggagatgaggttggatccatttgaaagaggactccgatagctttccattaagtactcacgggcccaaaacggagcacatatgcacacctggcggctgtttgaaatcagcactctagcaagtggccgaatcggattccagcacttggtggattttatcgtgatgtcttcttgttgattcacaatgtgagcaatgattgtatctatagtagtcatagtcacatcatcctcctcttcttcatggaaaaacgtcatcggttttttcatatggtgttcatcgcgtagtgcatgatcttgcccgtagaagtgtctacaagaaaacaaacgcaacaaaattttatcatgtaatatcattagttctttagcaaattgtattaatctcctatgaaacaaatgtacctaataattggaatgtactgcaaagtatgtaggaactacatagatataattctcttgcagctcatctcgctccccttcttcataaacaaagcattgacatgatactttttcagtggcacaaagtagcaacattgagcgatcttgtcgctccccttcttcaaaaccaacctgtttctttaaatcaaaacaagacaaactcgagataatatgattagcaataacatctccctagcgtccatgttttatccacatctacatgaggttctaaatccgaacagatgtaaactctatgcaccaaatatattcctttaccattatattcaccaaagatatgaaaaatagcattagtcggacatggcaaattagacttagcaaataatttctccttaaaattatcgagctcacaaaagtcatcaaaccgaacatagccctaagtatttaaagaagaaagcaattcacgttcctctacttcatgagaaatgtgaaaaacatgcttaaaatcagcacagaaagaactcacactagaaatagcacggttattcactagttgtggcattgatataagtgaagcattatcacacaattcttttttatcacaaggaacatcaaacaaatcaacttgtgacaaaagaatgtcaacaattggttccactaatagttgctctaccatagcatgaagagtggacatgtgcagctcatcttgagaatatccaccttcatttatctcagcaccatttaatttaccttgcaaacttttttcaaacattgtaggtgcttcatacttctccgctttcttatcaagaacattagtctcctccttttgttgattgttttgaactccctgcaaaacgttagtaacaggagacacaaaagattgctcctccaatgtttgcacatcatcattgcacaaggaaataggagattcagaaacaacagataaatcacattgttcatgctttctcgtatttgatatgaaatcttgtaaaattttactcttaacgctacgagcaagcatgaataagtgtctatgattatatgccacattagcaagcataacctgaacttcaaaattgagcccattgaaaaatctacgcattgtgttttcattgcactcttttagaccactatagatgatacaaacttgagtaaattttagtgtggtccatatatttttacccatgttgcagcttggatcatatcttagccaaggttttcactttgaaccacttaaacttaccatttgtttcactctagtccacctctcgtcttctccacgtccaatgggccatcagagatgcggcaacaccattgcttccccctctttctctctctgctatctgctgcatcgtgcccaactctggtggcttgatctgtagggagaaggagtagtgcaacagtgcccaactcttgttgcctattctagagggaggagctagcggagcgtggggtcgagcgcacagctcgcacaccagaggtgctagtgatgaacatgcatgggctgatggacctcgagcaaggggaagggcggacattggacagttttgagctccttagctcatccggcatccgcacaagcatattgccgatttctatgatcggcaatatattttatggggtgtgctagatcaaggagagatagtgatacaaataattatcctggttcatgccctcaaggtgaggtaataccctacgtccagtgtggttgattctctgtatcggtggaaaaatggtcccagaagaaatcttggagatgatccaacctccctctcctctcgagacccctgccccctcttatataggatgagaggggagggttacaaggaaagtatacggttgattgcaactcgatctccgtattctatctataaagatatgcatgatccccgagaattatatcttatcccggaaatctctttctttatttacaagtacgctgcatgggcctagggatcttggcccaccctatgtcgtacggcccaaaggcctctccttgggtacccaggtaccgtgtatcccacagtagcccccgagtatttagcttgacgaagactcagaggttggtgaagccatctggtgaagacaagactggctgagtactcatctcaatattgctaagtgaaaattgttgcagccgagtggttatctcatcaagtaagggttgcatccgctgagggagcacaaccctcagtcagtggcggtgaagcagccatggtgcatggggaggaagtcgctaggcatcgacgtagacgtccggctatcctccgcaaggagcggatcacttggcggcggtgtaggcggttggctcgaaggtgcaagcttccgatcggcaatgcagtagccgtcctgcgcggggaacggatcaccctgaggcggtgtatgcggtcggcccgaaggtgcaagcctccagtcgataacacagtagtcgtcctgcgcggggagcagatcacccggcggcggcgtatgcggtcggcttggaggtgcaagccttcgttcgaaaacgcagtagccgtcctgcgcgcggagcggatcacccgacagcggtgtatgcggtcggctcggtgcaagtcttcagtcagcgactaagtagccgtcctgcgcgaggagcttgtcacccggtgtcggcgagtagtacccaggcaatgaggggtgtcaagcccctgagcctgtggtgaagtcggcaaagagcacccggacgatgagtgaggcgaagcccccaagttcgtggcaaggtcggcgaagtgcacctgaacaacgaggtaggcgaagcccccgagtacgtggcaaagtccgcgtagagtgcccagacaacgagggaggcgaagcccccgagcccgtggcggagtcggtgcagagcgcccggacaacgagggggcgaagcccctgagtctgtggcgggtcggtgcagagcgcccggacaacgagggaggcgaagcccccaaacccgtggcagagtcggtgcagagctcctggacaacgagggaggcgaagccccctagcccgtagcgggtcagcgaagaacacccggacgacaagggaggcgaagtccctgagttcgtggtaaggtcggcgtagaacgcccgggtagaaaggaaggcggagcccccaagtccgtggcgggtcggcgtaaagcgcttagacaacgggggagacgaagcccctgagtccgtagcgaggtcagcgaagggcacccggatgacgagggaggcgaagcccctgagtccgtgatgaagtcggcatagggcacccggacgacgggagaggcgaagccctcgagtccatggtgggtcggcgtggagtgccaggacgacggaggatgcgaagcccccgagtccatagcgaagtcggtgtagagcgcccggacaacgagggaggttaagccccccgagtccgtggcgaggtcggcgaagggcacctggacgacggaggcgaagcccctggatccgtggtgagtcggcgaggagtgcacggacgataggggatgtgaagccccccgggtccgtggtgagtcggcgtggagtgcacggtcgatgggggatgcgaagcccccggatctgtggtgagtcgacgtggagtgcccggacaacgggagatgcaaagccctcgagtctgtggcgggtcggtgtagagcgcccagacaacgcaggtgtgccccgggcacagtcgagccgcgccagccgggtaatggatgaagttcccaatgtgcggcgtagtgccccgagcgtgcgtgcaaaacaaaaaggggaaacaactgcagcagcatcaatgaattaaatacatatgtatatacgtagatgcaaagtcaaagaaaagcatggagtatttgcttgctcccagataatcatcggtcacatgcatgtggcccatcgcatgcatgtactgcacagctgcacacaatcgagacggacggcctgatcatgcttaaccaagcgacgtcacgcgatgtcgtgcgctggcagctggcggctggcggccggtggtctcgcactcccgcgtgcggccgtgcgtgccctcggtgtggacagcttaagccggtacatactccgatcgtagaagccgtcggcgacatgcatgcaaaaaatcacagattaattcgggattagcaaccggcaagattagtctaaatggaacaaacagatgcatgtatatgcttgctgtatagatgcatgtgtgattgttgattaagccacgcatgcatgtgactggatcaacacgtcttgcttgtgtttccaggccgcctgcgattggcttcccatatatcagacacgatccggcgtggctgcatggacggcttgcgcggagacgtgcattgcccacggcttgcgcggttggcggcaaggccgcctcgcctcgcttcgcggtcgcggcgatttgcagtacggccaaaacctgttgatctcgtcctggcagcgaactgctttttccaacgtgcggcggatggccagatcgtcgggacatgaaagcaagaaatacccgcgcatcaatctatgattagaaattaatcaaaccataaaaacaaattgaaacgacaaacccggcgatcggtggttgaagctatctccttaaagaaacgatctagcacccccatacctggggcgtcaactgtcgatttctatgattggcaatatattttatggggcgcgctagattaaggagagatagtgaaacagatgattgtcctggttcaggccctcaaggtgaggtaataccctacgtccagtgtggttgattctctgtatcggtggaaaaatggtcaaaaaagaaatcttggagatgatccgacctccctctcctctcgagaccgttgccccctcttatataggatgaggagggagggttacaaggaaagtatgtagttgattgaaactagatctccgtattctatctataaagatatgcatgatcctcgagaattatatcttatcccggaaatatctctttcttttatttacaagtacgtcgcatgggcctagggctcttggcccaccctatgccgtacggcccaaaggcctctccttgggtacccgggtacttgtattccacacatagctacataagcggtggcgctgccgatcctgatgcattgctttgctttgttcttctcacagcagcttgactgcgccaaagccccagctacaggcacacgagcggcagaacaaggcacgtaagcatcaaaattggctgctatttgagtcaattgtctggccatgcgaatcgtcttgctagttgccactgacctctcaacacatagcacataggagccattggtttaatctaatccagcatgatatatgccgtttatccccttgtgcatagtgctcacctcatctttcaccctgggtgaaatagccatggtagcagctcaaggcagtaccccactacacctggtccaaactgctatgttttggcaaggttagatggtgatatatgaaaagtgttgatagacccttgcccattgtgcaactatggtaatgaaaaggggtccaatctgaaatttactctacaaactttaaattcatggatatactctctaacagttttatcaccttgtttcatatgttctaatttctccagaagtgtacatctgtaataagaactcacaaaatattttctcatcaaggttttgcattcatcccaagtttcaggtttgttactcacataactccaccaaaataaagcagaagaggtaaacttattactagcagccttaatcatttgagcatgaaaaaaatcatatttattaaattcattgtctactgctagctcccaatcaatataagcaacataatcatacttcccatcgtagaatgttaacttagattcaactcgtgcaaaattatagtcaagtacctcatatgaatcatgtggagaagtcgtcatatctcgtcgaaggtggagaagtcgacattgagcataaccatatcgtatcctgtcggtgacatgagaccgggggtatcgtgactagaggcttgggcagccgcggtcacccacgtggcctgaccccctcgggggggtcgggcccgagggtgacgtggccacccctccctctgtctccccgaggggtcaggccgctcccgtttcggccccgagggctggggcgccccgaccccctgtggtattggcgccacgtgtatgggttaggtgaacacagcggggctcacctaaccgcatttattgcgggttggacgagcacgacacgccgcatttaatgcagcgcagcgcacgcttatccggtccgtgaccggtcgcagtgtgtgaccggtcacggaccggtcagatcgcgggttaggtggcaacaggcggcctgtcacacgcctcgccccgtcccgtcggaatgatgagagcctccaggcactcgtccctagccggagccggcgtgctaactcctggagttggtatgtcagtcccggccagattcattccaggcttcatcgcaaccatggcaaggaagtcattgtatgaagaagggcagacgtgcggcatgctaaactgacgcgcggtggacaaaaatgaccggtttgtgactggtctgacgccggtcacgtcatcggcagacaaccgtgctcccacgttgcatctgcttccggcggagtggaggtaggtatgactcatcccatcggagggtcattcggacagcggccattgcaaatctccgcccattaatgaaggaatgacagggttatcccctgtgtcaggcgagtgacggcgctgggcctcactcaaggacaagctgtgatttagcttccaggcgaaggcgcgagccaggttttggtcaagatagggtgggtccccacccaaaagaagagtaggtagaagtggtgcatgtggtatccccttgagatataaaaggaggaccttgcccaccgaagaaagggggacgctcagacgactctgagaatacctgagctcgtagaggagagaaagaggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccccagatcgagggcgaagaacctcacttagcgcccccggccgaaccggcaaaggggggcctgcgcggtctcccggtgaggagccccacgctccgtcatatcccattgctcaattctgccatggttaatagcaaacaagaaacacacataagaatatgcatgctcctatcagctactaggtagtagaagctcagatatcacacacactcaagctttttaccaggttcttacaagtttttactaatgcaagctagatggtgacatacaccgactcaaccaagcaccctaatgaaggttgaatgtatcgatgccttggcaaacactagctgtacgactgcaatcaaatctgtggagccctgggtaggcttaaatatgtagcaaaggaatagcaaatgcttgtatcagagaatgcaaacttgaataattgttcaaagtcaagtattgtgcttgtcctaggctagaatgtagtagaaacacgagcctagacacaaacggtaccacaagatagcaccagaaacaactcaagcacacactgatatatgaaaacaaactcaaatatacaattgattttctcttttccttctttctttctttttttctttctttcttgggcacatatgcacacttggcagctgtttgaaatcagcactgtagcatgtggccaaattggattccagcacttggaggatttgatcatgatgcctttttgttgatccatgatgtgagcaatggttgtatcatagtagtcatcatcacatcacaccctccataatctccttttctttacttctttgaaaccacttaattctttgagagaatcccttatatgccactctaaattaaccggctcccttatatgccactttaaattggcttctcccttttgtgccaccggttcaaatttctcctcccttttaagccattgccgtcagtacaccgtcagttgaccgttaacttcattgtaaaaagacgcatttacccttgagaattagtatacaaccaataataggtattttagtactaatatagctactggatacaacatatgaaaattgattttttctgcatcacatgcaattttagccattaccatcacaaataaattttcaatgtaagcatgaaacatgcagttttccaacaatatttttaatataaagagcatttttcactggttctgacaaaattttgttcactcaaaaaggatttaaaataaattagttatgattttttgaagtttacatattttttagttgagagggcatattggtcatttacaaaaaaactaacctttgactaacagtcaactaacactatagtggtgggagtggcataaaagggtgaaaaaacttgaagtagtggcatataagggagaagccaattttgagtggcatataagggaactggtcaaattctagtggcatataagggattctctctaattctttcctcccttactgtgaatctcaattgttcctccaagatctttttttcctcttgtttgggcattcataccattactttcataccacttgtcaatcttatccaattgctctagaattttctttttctctttcttgtagacacttcccaatttaaattccaacccttaagtgctttcctcatgtgtttcatctttccttgccatctttcaatactacccctgagtcccatgttctgtccacaccttactaactacctcatctgtgtcttctctaagaaaccaactcagttcaaatttaaaaccagaatgagtaataggattttgccctgtgttagccgaccctctccaaacttctaacttctgccgttgggacacttacactccaaatcatttgaaactagaaccttatccaacttttcatacgtgatattactctggttcttacaataagtgaaattcatcccacccatgataatttctctcaaattatgttattcaataatagcattaaaaataaaactccatctattgtaattctccttacctataatattgaaatcccctaccagcagggggtgtttttgttgttaacaaatatgtacaagctcaattagaaatttttccttctgcttattccgaacagccccatacatattactgattccaaacaaaatcatccattttgtcttttaaaagaggtcacgctcttcttctttcattcaccccaactaaaataatcttgaaacttgtttggggagcttatagttgttgcagctttcccagaatcaaaaactcccctaaacaatcgagcttttgttctagattatgagaagctgtagttatagaatccagaaaatgaactaagttagaagccggaagatcctcagaaactggctacgaacctggctaccaaccagctacttattagaatcttagcttccgaaacagcccccttgatgaaaagagaatatgtttaattaagtcatccatacgcaaaataggattgagcaattgatcaagtaggaaatccaaaattagttgggcaggcaaggttaattagaacaattgtgacactcacctccttacaattgatcaagtaggaatccaaattggttgggtaggcaaggtttaattagaacaaattgtgagactcacttccctacaaaatcttcatctaatgagttaattgatcaatcacataactccatatagatgagtcaacgcgaaacatgaaaccgggcctaaattattcagtaaaaacatatgtaatctcacttatgagatcaggagcaccatcactgctgaaaattccctgagcttttcttgcttgtagaaaaactctatcttaaagaacaagaggagaagtctttcctatatgtgtgtccatgactcataacagcgcaaccaactaaatacaaatcatgggaacaatcatacccatatgtgctgaatacggcatcctggtggttggccacgtcatcggctccattaactgaaacagagtactctccaatggaatgtgtcccagcatcaacaccactaaaaccactgcaatgtcgtcgtgctcgtcacgacatcaccatgtccgggctcccctccatgccgccgccaccttgaggtcctcgaccatgacccctcccaatagcgtctacctcgagtgtttccccgtataccataaccggttttgtcggcgctgctctcccgataatcccacaaaccatggcctctctacctgagctgaccaacaagcaatctacgggcattgtagcacttggacactggacacctccaccgtcggcggctcgcagcgagcggcacccgtcttctgcggcgtgccaatgttggtctcctttcaggacgctgctgcggcactccaactggtcgccatcgcgcacagcgccgcccttcgagtagtagccgcctctgccggaaccaatccttgagcaatccacgtcgaagttagcacctctattggaggcgcccaacaagtggcccatgttcactacagcgcaaagatgctgcaggtctcctttcagggcactatcgccgtgctctaattggtagccatcccacgcagtgcctctcccagcgccgccctccgagtagtcaccataacccccgttcactgcagaacaaagacgacgctagtctccattcccggcaccgccctccaaacggcccatatcgtctacaatgcctccaccccgacctccaccaccttcagccagtattaccttggtcttcactggatcgcgccaccgggggctttaggtagtgcgtagatggccttgcggatgacgctggtggtgcactctatggccggtgtcgatagaggtaggtgaataggtggaatgcaacttggaggggaggaagaggatggcagaggcagtggagttggatagggagggaaggggaggcctgaggaagaaacagtttgaactacaagtttctcctgggcaaatgtttttcaggaaaaggcaacgtgataatcgatcatttttggtaaaccttgatgcaccagtaaagctaacagaactaacttaatcaggacaagtcgatcacccgtcgagaggaaatttggtttccagcccacgaacttcttggcaaacggtctaacaaaggctgaacatcctgctttgttagctgtcggagggagagcaggaggccgaggtaggtgatcgggaactgatcgagctgacaacacgggatggactggacgagcgcggatgctcctgtgagcatctgatcgtggtgatagtgctcttggtgaagttcactttgagacctgtcgcagccctaaacaggtccaaaatcgctttgattgcctatgtgtcttgttccgttggttggaggaagatcaccgcatcatcggcatacaacgaaatggccgacgactgcaaagcagtaccagtccctcttaacgtccctgaagccattgctgtggttaccatggcttgcaagacgtccatgacgagcacaaagagcaaaggcgaaagcggatcaccctggcgtagtcccctcatcaacttaattgattcacattcctctccattcagccccaccgtggtgtgcaccgtcaggagaagcgagcacacccacctcctccaccgcaccccgaaacccttgtactgtagcaacctcagcaaaaacggccaggataccgagtcgaacgccctggagatgtcaagcttgagcaacaccatcggtttgtgccccctgtgacagagcaacgccatgcccttcacaaacatgaaattctcgtgaattgaacgtcctcttatgaaggcggactgagtgtaaggaatgagctctcccatttagcctgccagtctagtcaccataacctttgtagccaacttggagaagctgtgaattagactgatcgggtggtagtccttcaaaagggccgggcgcctccttcttagaaagaagaataatcattgtcgaattaagcatgtccaaattttgaaagtttccttggaaaaacttgtccaaagccctcatcaagtcttgtttgattataccccatcaggtttgaaagaagagaccagtgtaaccatcgggtgcaagagctcaatcccccggcaactcttttattgttcgccacatttcctcttcccccacatcaccttccaagcccgacaagtctacttgttttagcccaatcgcctgcaggtcgatggtagcgaggggacaaaccaaggagagcacaaggatggggaacccaattttgtggttcatggtggtactggcaacgggaggggcagaatcaaaactcaggcagaggcgctaatggtggcgtcgtggtcgtcgactcgagtacagtgaaggtgatgatcagaattttgcccattgttttatgcgattgatatgagaatttttctacttttagatttagacgctaggcatggacgagagtgggccgaaatatcaagcagaattgtactaggattacgtaaaaaccaataatctagatcgtctatcaatccacgtgggcatgaaatcagcgaccccaagtgggactcctgcattcacatgttcctacgtcaccctttccattccacctgcagactcgatgagcggcgggcaacagggcaaggcatcgccgccaccaggctcaacgagctgctagctcggtggcggagaatcgccagtagaggcgtggggttcgaccgcttgcgcatgcccggccatccatcttgatctcaggcagccagtccgagtgccccctaggcactgcatccttatactcaggcgcctgatgagagaaaaatatcgggcgcccgcacgtctcattccttgtcactcgggctccccgtgcctctctcactcatgtcgcctcctctcccccatcggcgccacctcctctcccacgagctcccttgcccacgctacctcctctcccccacgacctcgcctacgtcgccttctccgtcggatccgccgccgctttttgtcttcctcaacgtcgacggtggctttgtccccgtggtggcggccgacgcggaggacaacgcacgcccgacgaggtggtggtggcggcggcggcagtggtggtggaggaggctcgccggctccccctctctcccaggagcactccctcctcatctccgctgccctccccctctcctgccttctccagatccagtgatgggggtggtggagaagaccgatgcgagcaaccctgtgttcatcggagagtaggaagatgcagtttagactaggttttgtgttttttgtgtgtttccgctagtgtggagattatgggtactacatacccacatggcatagatatctgactggttataagggatactttatgcggttagaatatgtgtagtaaaggactcggttgtaatgttaacttgtgtatcaaggaaacatccgatagttctagtcggttatgattgtaatttatctctaaaggcctagtccataaagaacatggattgtatgttgtaatctcggctcctcctcctatataaggaggggtccgagtgctcttatgagcgtaacttttctcccagatcatacgatcaataatacactcggcagatcaatccccagacaggagtagggtattacttctcatcgagaagacctgaacctgtataaaccttgtgtctcataacccatccacttttctagcttaattgccaccccttttagtattgccgaaatcttgtttcgacaactagtgtactcgtgatgttctttatgtttggatcaaatgttccaatggatatttcgatagtattccatatttctatttttgcctcaccagctttgttgatgtttcaatggttcaaaagcaatgtttcaactaatatgctcgtgatgtttctttgtgtgtgaatcaaatgttacggtggattttagatagtgtttaattatttcacttgatatatacggggtttgttttgatgtacacggattttatgtgtttcaatgacttaaatcgttttgttgtgtaagttaaaccaaattgtttcatctagtaatcttaccgtgtttttttttaaagaacattctttcgctaagtgctaaaacagcgcccggtgccccctcatttgtatgcgcctccatcataccaggatccgagtcggaggtttggcagcctcctcttccttccgccgactcgtttcatcatctccgtcgtcgatcgcgtcgccgccgtcgtgctcctggccggagagatgaatatccatacagaagtatactatcgcaatggcccccctcttcgatgagcaggggaatcttatctatagccacctggttattggcgaccggaggcttcccctgagggtggaacaaaatccgccgccgccgccggaagcttacgtatcatcatccgaagacgtgtattcatcaatgtcatctggcaacgaggaggagatcaatcaccccacgccacagatctccgacgaggcggctgcgtcctacaggcgagctgagcaaggccatccaaggcctgcgtgaggtgacggcggccggcgcgagggaggaggagtgcgccgtttgcttgcaggatttcgtggcggaggagaagctgaggatgatgccgtgctcccacaccttccaccagcgctgcatcttcgactggctccggctcagctgcatctgccctctctgccgccgcgctctacccacacagcactacagcaggaggatgacgacaagcttgggtgcccggagctaggagcaaccagctgatgaaccggccaaaaggctgtattttgttcctctgttcacctaaatatcctctgcattaggcagattggtgatttgtctgttccaagagttgtgttgtacagactgagacgatgttttatcgtcccatcaatgtaaagctaaagctagaagcatgtttctctatcgatctattccaagatcgagtagtacttttcaattggaagcatgttatgtatctcctctaccgaatatcaaactacaagtacaatggcatgttcattccaactctctttgttgttagcttagctgcaactatgccgattatgctaatgatccttgttctgtccaattgaagaagtgcatgctaaaagataactggagtctcttctaacgagaaaatgcttgtcgcacatgctgggattcttttgtggtttaactgaagattgcagattgggggactgaagaactggagtatagagagattagaccacgtccttgaaggaaaaatcccaggataagccgcaaaaaataattgtttggggtttgatcaaataattaaggaccttatagctgatacagcagaataagtcagattgtataaattgtgcacacgcgggtataaagaatttagtttctggggaaagttaccatcatgtaaacctcttatatatttttcacttaagacaatactgtatttgtttcagtacaactgttgatctcataagcatagaaaaatacccattttaaggtataatcgtctggataaatgaggttgcatatttcctcgacagtggcaaagtagcagtagtagtttagtcaatgtaccaaacctatatggcctatgcaggaatttactaggagaaacctgaataatttgaagacaggaagcaccctcaatgaacattcagtctttcgcatccattattccacctgatgttacctggaaaacgtgttattggtcaagggaagcaactattttacaccacaccattaataatctgttatgcaaagcttttggacttccagtcaccgaaaacagcatctgcaattaactaaatcacaagagtttgaggagcaagtctgaacaaagaaagaaaaaccaatcaatattttagcaacctactgaaccgaagttaccaattgcacaagaagttttggtaaacatgtatatgtataatacaaaaggatatagcttctccctcaggcaggttaggggcatcaaagatcttgcagacacgctgctctcctttgcctttcctcagcatcaaccggatggtagctgcatgcgccagcacgtggcctcccgctggttttttcaggtcagttatgaacattccaccacctgggtcggcaatcactgaaacaaggaggacacttgtaatttgaaatcccttatggtgttactctttcttgggatatacaggatagtcctgaaagctcaccttggttggtgatgtacactgcaacattgaactcctcagctattttagtaaggcgggagagcatctgtgccaatttttgctgcaagttcagagtaattagtacataactttaggccttcaactactttatgatttttttttgtttctaccaacacaaatattgacaatacctggcgctctgcaagttcacccctgccactgaaatcgacacggaatagtgcgatcacagaatccacaatctactcaggtaaaacaaccacataagtaactgagatacacaaatttatcaatgttcttttatgttatggagccatgcctaccagaagcctgaaaggctcttcagccatcttagcggcaaggccaaggagaaggttgtactggtgctcataggtgtatgcacgagcatatatgatctaaacaagaaataaatggaaatataacatacagcttcatctgttaggcctgaaatggtaaagacaaattaagagccatacattatcaagaacagcattggcatccatcccaaatctctcagcaatcggcacaattcgttcaggccggctgaaaattccattaaggaaacaagttggggcgatatggaaatgcaaataaatccattgagtgaatcagctgagttattactcagtaaattcaaaagatacaatgttccctcagtatcaatgtaagcaaccttcccgttccccccatgcatgtggattggaagctgcagttcacaaacaaaaaataaataaaattattcattggatctatggtagtaaggtgttgatgacaaaaatgtgtcggaaatgaacctgagcggagacgcatagagtgtgagccaactgggtcttccctgatctgaggaccaaaaataaagatgacagattacaaattacaaagctaagaagctggaaccaaattgacgaatgatgaacgttaaatcaaagtacatcaagggtcaaagtttggctggttcacattaaatagtaagatgttttatttatgtgctacacaaagccaaattgttccaagctgcaattcaaggaatcattctataatacatcaactttgtcgcaaaacaagattatctcagctaaatttaatgtttagtagaaccaatttagtattaacatcaaagaaaacagtttcagacaatattgatgtgtatatgcctgaagtttacacatgaggagtattaagttctcagtgttagcagaatacaaacatatttaggaatttactgtatatactggcatgaataaatgataaaaatgggagcacaacagccttagcaaattaacttcaaccagaatactaaacatattgctaagctagattttcaccatatctattagacagatatggccacattccattggtacaaccaatctgcagttgtaatccaggaaaaagaatcaaaaggaacaagaacgtctacgcaccgaaattctccaaatgcctctgtgatgcaaagtgtttcaatccctccttgaaaatttgaagaatgaaaatagattagaacaacataatgcaacaactgatcataacataatcagaggactatatatgctaccgccaagcagcttgtcaagcgcctggctcccagtggtgattcgaacaacagatttccgcttcaaaagaagaaaaagaataaaccaaacagcccagggaagtgcacagctggagtaactaaaagctctagagcatccatgaagcaaggaatagtttccacttagtttgctataacaccatatcctgtacactagtatgctgtatgcagattagctcctatttccttaccttaataaggagatcacttcctgttatgaagccctgactctgagaaaaacaaatatagcaatttcagaagaatgtatcacacagaattgacagtgaagctttcagactttaataatgaaaagagaaccacaccagaagtttttcggctgcttcgcagatcttgtctacctttgcttcagataatcccttgattcctgtcaggctctacaagatgaatccatatattgaaacaatatcagataagcatactgtaagaaagaaatagaacaaacgaaagaagatgggtgtcataaaccagaaatggaacaagcaggagatggcatgaaggtttgggatcccgagttcacaaccttctttgtatgcatcatgaggccattgcaagtgtagataccagcatcctgcagcttcttcacatctccagagtttatcccttgcgagattactgtagacaagtgcaccagagatgaacagtaatgcaggaactatgctcattagtttgaattcacggcaatgaataatttgcaggaagaaccaaatgaagcatgaaacacaggcaaatgtcaggatcacaccaaacaacttactaaaattgaactcgctagagttagggagccaccagaaaacgtaaagtgcaagaggaactcaagcttaatccctaaacctccaagtgcacccatacacaactggttcaactaaatgcactccaagtgcaccaaaacacacaactgattcaactaatatgcagaaaatgcaaatgtttaaactagccggtggagaattccgacgagttccagcgatcattttgacgggttaatgcaaaacgcgtgtaaatttgactaaaaatggggataaattctaatcgatcctctcatagcaagcgatgtggcgatccacacaccgatcagcaggaaatagcccaaaaacagagatcaattgtggagcggcgaaaattccagaacaaattcgtcacgagacgaggctaatttatgtccagaacgcacgaaattggggggaaaactagaagcaacccaacacgcacatcacaaagcatccagacgctgctcgcaagcagaatcgaaaccaacaaaaaaaaagtggaaacgtactaatgctaaatctcgtttacttcaccgcgaatcaagcatcgaactacaagtcgaacagcgactaattgaaaggcgaggcagaacgagcactgccactcgcacgcgcgaacacacgcgaacacacacgaacgcacacgagcaggcgcgccaagcaatgcagtgcgggatacgagacagggggaggaagggatggagatgaggcggagggcgtacgcttgtcgatggactcgaagcactcctcctcctcctcgatcctctcggcgtccatgagctggagctgcccgccttcgctgtactgcttggacggcgccatctgcccacctgcgtcgaaatgtgcgatcaggggagaacccaaccagaatcacccaaaaacccaagcgagaacggcgagcggaggcgtccgccgcggcggagaaaaacctcctcacctgtaggcggaggcggcgaggtcgtcggagcggagcgggggcttggaggagaaggaagcagcagaggaagacgacgaagtggttgtgttgcgccgttgcgtgtgtgaacagtgcggttgctccggctgcgacggtgggctacttgggccttctggaaactgcttgggcttgtctttctattgggccttctgcgggagggagcagtattgggccgtttcatccagcctagcagagctggatgaatatattttagaagtatgtttgttttgtatcgaaaatacttctatattttctacaaactagatcgctaacaacacgtatataccaagttttattcataaattactttttgtttatatgccattttggctccgatggtgttgaagcatacccacaaggttgatcaaaagaaggccggaaaagaggcgaagagcggcagcaaatgcaagagcaaggggaaggaaggcaggaagcggctacctcccaagggcaggaagagcattcaataacatattggagacactttgtcaacttgatccccattatatgcagatgatgtttgacgaagaacaacatgcaaacacaccaagcatttctcagctcaacgacgacagcgtagctagtagtgcaagctgcagcccagacagggccctgccgtgtggtgcaaccaggaccagcagccacggtactctgctgatcaattgatgacgatcacacagccagcctacacggagaatctccattaccagcaagccgagaatattaatagcagcgttgcatgcatttggagatgatctagactaacgtcatatactgtccatcctgactatatcttgccacatggaaatattgagggttatgctcatcagtatcaaacagacaatatgctacaaaatggaaacatggaggatcatccttcgtataagtggtacgatcaagataatttttttttagaaacgcggtacaaatatagacgctcataatacacgcacacttatccctatgaatatacatgcacattctatctctataaacacctttggaatagtggaccggtatatcttgatattgatattgatgaagttatcacaaacatctcgctgtcaatgggttggattaagataatggtggtgcatttgttcggaggattggaggacggattaatagactatatattgattaatttatggcaaccccggccgtcttggaagatcaagagataggttgtgatgagcttatacaagaatgcatgggaagtgatgatggtgatgagacatattaatgacgaattgccgttctttgatgacacatagtaagatgggctccaacagaataagagagcacaacgccaacgggtgtgcagtgtcctgagagcaagtataatagagggctataagaaggctgaatgctgatgtggatgagagaggagaggagagagatgagaagcgagctataagtttacagccggcttaggcacaagaaccaataaaatctgtgagacagataggtagaccatatatttatagtgaagagttaaccattatatgagtgagatgatagataggctataagtaagcagctggctgtattattattcttgctctgaagagtgctaatggtcactagagtcttttaagcgatcggtacgtggttttatgaggttcagtcttatctaatctgttttcttgatgggttaattttcacatggaaacactattgtttgttaagggaagtaagatgatggggagggagaatttcgtttttacagtagtagagaaactagaaaatcaggcgcgccgccctgtcaaaagtatatcctgtctaataagaaaatgaaacccaacatctcaattctgacctccccagataacacaaacacgacataaacatgatatgataataccagcgaagcgctctccgtctcgttgcagcaggtggatgcgacctcagattgagatgcaggaaatggaggagagggaagcggaggggaggtagtacctcattacatggcctcaaagaggcggagggagcttgtatccggcgccgtacgtcagcaagcttcgaccaggtctccagatgcagtcaatttggataagatgaaaacgatgaaagctgggtttggggtgtttgtgatttgtgaaggttgaaatggaagtgcaaaggtttcagctaaagccgtactgggtgcttgtgtagagaggactcagttgcatgggaaactgaaacgctcctttcttagcccttccaaattttttcttcaaacttccaattttttccatcacatcgaaactttcctacacacacaaacttctaacttttccgtcacatcgttccaatttcaactaaaatttcaattttaacgtgaactaaacatgcccttattcagtattaattgagtattaatatattggattgttccccttcccaagggctccacaaatttctggattattccattttttatttaattttttacatgcatgttgactgaactaatacagtactactttccacatatctagagccttaaataacatatatgcaatccaacagtgaataatttgccacagttatcatccaacggttcgtttttatctaatgacgtcaagggaagtaagatgatagggagggagaatttcgtttttacagtagtagagaaatggccgtctcgtttatcttctaactttaaatttttgtatgaactttgttgttatttgtgagaagggatcatcctgtttatcttctacttttgttttgttttttgttttttgtttttttttcccgtgaacaactatctaaatctagtactgaatctaagtagcgtcttcccctaaccaaactgattagcaatgatatttgtttactaatttattttagtcttgttgtgtccatgaaagggcacctgtataaggtatttcatcttaaactaaccataatttgaattgacatataaaatcgggaggtgaataatgttaatttattattgcagacatgtttagttcttgagaggggaataaaaggtaccattgcattttaaactaacaataatttcagtgacctgtacaattggaaagtgaatatattttttaaaaaaaaatatggcagaaagaataacagaccactatcagtttaaagctttggtataacagtctatgaaacaccacgtctgcgcaggaggatgcgtgatggttagctccacgctaaccaataaacagctgtcgattatttgctttcatgcgaaatgtgccttcatccagagaaacctgctctaatataacagctgtgcaagtatattgcctgacaaaatgcctcggtctcacagaaggatcaagacatgtaatataagagggaaacaattccatagtttctattgatatgatagtcaggtgaaattcaatagatccattccatatgaatattgcttggcaagtggttggcagaatgcctcacagcaggattaagagggaaagttttaccttatattcctatgatagtcaggtgaaattcaatggattcatatatatgacatttaacatgtctacatcttttttcatttcatcttacagatgtacataaaacaggctattcttttacctgatcatcctattagatgattatcaagcattcgtggacatatccaacagagttcattcacagttgccttcactataccaagccagtcatttgtagtttgttgctagaacttttactccgattgtcactcgggtagttacagcttaggttttatctgttctgcttggcgcagttgtgcatacatatctgcgatttcttttgcaaagtatgccttagcttgcggtcttttgacctgcaaaagtcattgagatagagaattagtacctggtgtagaaatctcctccaacttgtattaacgggcctaccttgaaagttggggtgaggagaccattttctaatgtgaaaggttcagcaacaagggtaacagctttggcaaattcaaaacctcttagctggtgcagcaaggaaagagagattaataagggaatcatacacatgattcataacttattaagagcatgcaaggttatgagaagtgagaagtaaacctgtgcttcctttccaatagagtccatctcagccaggacagcagatcttgctttcggatcagcacaaagctgtcttaaatcctcgtgctacaggttagaaaggacataacataagtagccaacgaagatgtaaggagttttatttgtgggtgttctgtttttatttatttatttttttttgacaaagagagacataatttgtgtagtgaactggcaaagaggtgcaagaagaatataatgttccgctagtttggagaaaccagttgtgcagttgcagaatatctactctctaaggtcagcatatttacctggattccctcagatgcagcccaagccttcaacacatctggttcaactgctactacggcaaccaaagaagagtttaaactatcacctgcatccgaatcaacagcttagaacatatatggcaaattattggtagttataaccagtataaggacatgaatattaccatatataaaggactgcgcaataaacttgcacttagcatagacattctcaatcttctcgggagctatgtattctccttgagctaacttgaaaatgttctttttccttgagaccattaaaacacaatcaattaataatttatttaataagaaaactaatcagatcaaatacagttccaggggcttaaattacctaagaaaatgtgtggaaagaggataataagtaattagagacaaaagtatttcacaatagggttgtggtcatttctcaaaaacatccatgtgttacaaccttcctagttgaaggctaccatgtgctgtctgctacaataacagtgggtaagatagttttggtttgctctttgatcaatagctaagaaggtttaacatcttgctttcactttagtcttttagcacagtagttttgaacttaccaagttgttattagatatccctaccatcttagtaatatggtatgtattcaaaattacaaatgacagcaaattctacaagttagaccaaatagcattgaactttcacatattagagttttatcaccaaccatgcaaatctcagctaacaaacaatacactgagaagaaaatagtacaagctaacttaagatttcaagtatgcatcttaacaatttaatttagcaactgactaatttaggtatcattacgaaactgcagcgaaggtaaaagtgtagattgatcagatatacattttttctctatataatgaaacaaaggcacaaggccatctcaattcaaaaggaaattcttaaacatgaaacactagatcattcagttttacctatctataatttttagacgccctccaggcatccacaaacctatgtctccagtgtgtaaccaaccatcctcgtcaacagcctctctactgcaggttttcaaatttaattgctgaaactcatcaaatatttatgaatttaaatagtagaagatagaaatatatagcaaattacgtttggatttcgtctttatagtaaccacagaatatcgtaggtcccctaacacagatttctccacgaggatatggttcatcctcagaggtgtaattcatttctgggacatccactagtttaatctctgaaaaatagaaacagaatttgcgttatggaagagtgtgagaagtgataatgtacaaaaacaataacagtgaggaattactgtgaacaaaaggacaagttatttatccaaccaagtctagttaaacccaaacacagatcttaccacaagatggatttggagatccgacatgaccaattaacctatcaccaatattcattgcagagatgatacatgatgtctctgtcattccatatccttcgagtacttcaccaccaaaacatctgttaaaaaattaaaacagtagtatattagttaatccaagttctaaataataatcgtgctaccccaagggcatatatgaagacagcttacattcttaggaattccattacatcagctgacaatggagaagcgcctgaagtcataagcctcacacgtccaccaagcctagcttttattttgttaaataccaacctgtcccacattggggacggatttctccctaataacccaaaatgtagaattaacatttcatacatgtagatgtagtggataaaaaagtggcatggttccaattttcccaaaaaaatgggatatgacataagtcacagaaagcatgtaggaactgtttttaaatgagaagtcattgcaaaactaagacacttaatatcaatgagctgttcttaccattaataatcgcttgcctcttagcattgtatgcagcatgaaacaatctttctttcaaccctccagactccttgacagcatttgtaattctacaaaatgataaacaactaaccacttagctgtactgaaaaggggaaaaaatgctaacctcaaaaaggatatgactagaaatagtttttcccaacatgaaagtatctaagttacgggtgtagttggattacgcagcataaattctattatatagccgaggcacactaggaaatactgttggtctcaatgcagccagatcatccatcagcttcaaattatcctagaaacaacaacaatatacacatcagatatatggcaaagaatccattgaatgtaaacgattattatggcaaagaatccatgtagtaagtaagatggatatttgatctaaatgcatatttgtcaagtgttgaacaaagttattgctactggcaaacacataagatataaccctatatggatctaattgcttgctgtgtgcaaggaaatccagcaataggtttacaatatgatggtacgatggtgaggaaaggatgatgatgagcaacatagagctgaagtgaactagcatgagccaacataatgcatccattaagatgatgaggccataacaaatagtacaatgggattatcagaatattatcttgtagccttgtaggtgaaaggtccagcataaaatgcatctgttgtgttcaattaacctctgaatgattgtcatataacagtttgaaatattgcactaggtgattcaattctgctcctatatctaggggtaacttgtggcagaactaacattagaaattacttttccgagtggtttaattcatttgtccccggttattcatatttacctttgctaggtcagaactcagaaaccccattattctactggttttattatttacacaaacagcaaatgcaaataactacaaaattaacaacctaaatggttttggatctgcataccccttggtagaaaccaatggcaacaccatagtgaaccactgagacctggttaactctctcatagatgtgagctaaaggtagatatgagatatacctgcaaagacataccaacatgattataattcaaaacattaccagatgggataaatttattaagctatggcagaaagaaacaaatctagatttaatgtaaactcacacatcagatgggtaaaacttaatgactaggcttgatcctgctacatttgcaattaaattcccatgagaaagaacaactccctgaaataaatatgacatcgtcacagattggaaggttgaattagaagagctctttgaatgaaactaaaaataatcagaaagatgagttatttaccttcggtgtgccagtagtgccactagtgtaacaaatagtggcaatatcttcaggttttggagggcgaaaagattgagaactcatctttccctgagttgaagattgaaagatcagaagaacagtgagcaaaatgtgctagcatcctttaatctaacagcaaagataatgtatatggctggaaatagatacacacatactttttatttcgcaggccgttgatgcaaaactaaaactaaggcaatatatatccaccatgcacatactatgtgtgtccataagaaaagaattgagcaagtgtgcacaccgcacactgctatagcacatagacaaaactatgatttgtgttagagtttgtgtcgaatatgtatacgtagtcggttacagtttaggacttggagttgtaataggtattaggactagagtatgagtcggactctatcctaggatctctcataaatagagggcgtgcctgttgtaaccgcatggcgacttagcatagcgagagggagcggctgccggcggctaccggccgtgagtcgttgtaactctgatacgctgtatatgctagatcggggaggagcacccgtaatcagtgccccggagatgtaggcctcggctgaactccgttatcaaatatcatgcctcggtgtcatcatcgtgtttggatctcctatggcgttttcttccgcggattggtttccgatgtgatttcggggccggttttataacaatttgaaaggaaaaaaagatgtttactccatgtggtagccctacaatttgttattatgtaatgtttactccatgtggtagccctacaatttgttattatgtaagattgtcatttagctttcaagtttactatacatgaaaatatgaaatggaattagagagctaacgtatgcatacgtgcattacagctgtcaactggatatccaatattcatgttcccagttttcaccccaaaatatcaacgtgtctcatacatacataaatataattgcataacaaacgtgttttctaatggaagtggaaacaagatgtcacatcaactttgtttgccatggataaatcttttggaaacagtactaaattaatcagtgcaagagtgcagccaagtaattcgtatcccaagagatttcatataaatattgaaccatatgcccatacaactttggaactagatatgtggttctcaaggactacaggtatgcatgtaaagtgtttttttaacaagtttaaatgccagttggttgactgacattagataacagatactttttttttatgaaaaagagaacaaataccataagcaagaagtagtgttagtaaacttaagggccatttagcaaactcacctggctaagtagtctggagtaagttataatttccactccagtagctgttggggtagatggcatatttgcattgtctccaccaattacctatattaaacaagttttttttaaaaaaaaagaaaaagagagaatcttaaacaatcatggccgttcattgaatatactaactataaatggtttgaacttaccactataaggcgaacacacggcatttgagttataaagcttagtagctgcaataaatagttacacataagcagaacataagtacacttcgttccatagaatataccatgataaaattcaagattaaatgctaggcagtgttaccaaaattgatgtagtgtttgaaataagaaaatggaaataggatcagaatccacatagaatgtatttcatgatcaggccccagcccagcactcagcccattggttgtgtgcatgtggatatggtcccaaaaaaacagtatttgatgtgcatgcagtttctgcaggatgagatcagcacctgaaagcacagatctgtttcctggaaataactagctagttcccagcatcactaagttaaggaccagtatgagcagtgacatgaaaactgcgacttttaatgattgtatagactagtaactatacaaggttgagataagggttaaagctcacagtgcttagtgtttgaggcacacagaaaatagcttgtactgtcgcatggttaacaatgaactgaactgcatctggacctgtataaacaatacataaaacttgttgctagataaatgaaaaggagatagatgatcattatgtgatgagtgcatacctagagtatcataaagtggcacggatacatatgaatatgccgcacaggcatgatcaactatggtccactcaggtctgtttataaaatacaaaccaatgcgcgcaccctggttcagttttagaaaattatttaatgcaagtttaaaaaaaggaatctgtaagtgtaaccacaaatgctatatcattatggcaatgtgtgacaagatctgcctgttagtagttaaaatcagaaggacggtgcttgttgagatcataatgactcacttcaggtattccatggtaaataagaccagaacctatcgcagtccggcttgtactagcttctccatatgtcatccatttgtagctgcaacaattcatatatatcatttaaaagattttaacaaagctacaaaaggcaataatgacatatatatccaggaaccaattcttactccccaactgttccatcaacacagactcttgtgcccaggtatctacagtccctaaaggtttcaactgcatacctgcacaattttgggtatattgcctgagaacttatcacagaacttaaatttgaacactaatagttctcttgtaaaacatgtagcctgcaacaggcatttaagtttaccagttttcataaaaacatcagataaaaacctttgcattcaagtcgttgcatacaaacattttccaactccaaggtttcaataaaataacagactcacttgcgaataattctttttcctaattagattagattttcctaaaaatcttcctgatacaattcagaaacaaaaaatatgggagattcctaaggaaaacataactagcatttattttgcttgatggtatgtaattacactcaaaggtttgctgacaattcaagacaagaatttgataaatcgtagcataacattggtaaataactgagatttgtcgaagttgagattaacattcagaaatagaagtttgatgctcaagtcagactatgaggattcttacacaaagttatcatgaagcgttccaatgtctgggttatcagggaatctatttattaacttaagaggtgactttgcggatctgcaagatggaaacagaaattttgagccatgacataagcaaatgcagtataacatatactactaaataacctacctgtacacattccactttccagtttgcaacttctcagggagtacagcactgtagccctgcactggagaagctatgcacattgagttgtaaactttaaaaaaaaaaagcattgctatgtcaagaaagataacttaaaacatgcagagtgcagttgagaaaccgcaactagcatgcgtcggcgtactaaaaaataggaaaagaagcatcccagtcagttaaaagctaacgagctcggagctaagcaattattttagacggttaccgagctcagcaatggaattatggcatagatgcccagtctaagcacaaattcagaaagaggaagctatctctacagcttaagaattgggaatttgggagtggttgcacttgttattctccactttatccactttacgctcgagcggtgcgcgcgcccagtaggccccacgcaatccaaccccaagatccaaatcgcggcatcaatcatgcacgggatggataaaatcacaaatgcataccacatcactagtaagtagcaagtagtagtgcagacgaatagacgatcgatcgatcgatcgtacgtaccgtgcgcgtactcgccggcggtggggttggcggcgaggtcaacgccgccggactccgtcggcggctggaggtggccggagacggcgcgcagccgccgctgggccgcgcccattggggccctctcctcctcccgctgctgctgctgccgcgccatgcccttggctcgcactagtcgtctactactcgtctcctgtttctccggcgaggcgttgcgtgggaagaaggcgaagaaatttgtggcgcgtgggaagcagaggacgaagcgtgggggactccgactcctcgtctttttttcactagtggaagtgtactactagcgtttaagtaaagtttttttttaaagaaaaggaaatggtgggtttgaatttggagaggatttgggaggataaataagttaccgggaagggtaggaactaggaatcgtagctttctagacgaatcccatagaaatctcctgtgctttttgtagttttttttttgtttgcctgtttggtggcacgcatagtatatttatctgttttatcttatccgtttttctttttgagggcaatttttatcttatccgttcgtgctgcttgcgtcgtgtgcgccggccctcacgtctcgtcgtgtcgtgcggtgcggctgcggccggcggtgtttgcttttgttgcgttggtatgtggattggatgctttcttttttttttaacgcaccgacataagaccgggccaatttcattatatgaagtagaagtaaaagtatttacaagggattggatgctttttgttgaattttttttcccctcgtgacattgccatggcatcatcacaggaaaacggagtacaacagaatggtgctttggttgtgtccaactccaatgggatattgtatcgtttctgctaatgggaacaggagaggatctcctctcttgctaaaaaaaagaaaatactactaagaaacttgtgatgccaactttgcctggtcgtcttctgttgataggaaggtgaaaattttatcttaagcttaacatgcatagatgccacatcatcatccactaattaacaagatgtcacattattatccactaacaatcatcacatttaaacatcatgcaaacatgttatatctttatattttttataatttaagagcttttgaaatacaaacatgttaaattatcatccaacataattcacataatgtttcaatgtatatcttcatgcaaagatgctacatcatcatccactaattaacaagataccacatcatcatccactaacaatcatcacatttaaacatcatgcaaacatgctatatctttatagtttttataatttaagagcttttcaaacacaaacatattaaattatcatccaacataattcacataatgtttcaatgtatatcacataataattcacataattcacaaacatactaaattcccgcagcaatacgcgggctttcacctacttataaaaattagagcactgctacacgtactaaatttcttttacaaaacttttacaaacaataagctcaaccatttgtaagtagatagaaataataaaaaatcgagatgtactcacagtgtaacacatggtgttagtaataaaagtttaagtaagacaagctacgtatagactttcctaaaaattatctagaacactggccatgagcagccatgaggcccatgaatgggaagcaaacctggactttgctgtttctggtaattgggctttgctgtttaggcccaattgctaatatcagcccacgggtatccggtgccacgtatccgcatattcctcaccactactctgcgtgcgcatcgcttctctcgaacacgattccccaatcaatcgccccaccatattttagccctagaaacaccacgacgcgcaatccatccaccccgcaattctactccctctcaaatcctccatcgccgcagcacttcgagcttcgaggccgaggagggggagcgcgacaagcccgcgggaagggagtccaccatggcggatctgctgaggagggaggaggagttctacgcctccttgttcgactcccccaaaggtgactctccttttaccttcgaaattgccccccgaggtgtctcctaatgcaagtgagtttttttttcttttttcttttttttttcacactgggcgccctttggtttgtgaacttaggcggcgatgccgtcaagtcgcgtgggcagatgattgagaggaagattgaagttcttgaggacatggccaccaaggtgagacggctcatcctgctagaataaaaaaaactgttagcttgttcctttgcagctaaatgaaggtgggttgttagcttatgattaaatgaaattatggtttcatccctgttgcaaagaaatggatagtgatctacggaatagcagctaaaaataatctgttatatttgatacagtatgttgttatatttgacattaggaatatgcaggttgatggtttacagattgtaatgttacacaggttagtaaccggagatctcgtaggtggttgaatgatcgcttgctcattgaacttgtcccccgtcttcatgttgaagaaatcaaaggcctttttgctcctccaccatggggtaagctccagtgctgctcacattttctaactccatattgcaggtcttacagtctggccattgaatgttcagatttgtgtagggagtagtaagttctctagaagatgtgagccatgttatgcatactctttacgatgtgttcacattgagaatgagaaacaatattattttccttactgcatgtgcatgttaactgtgtgtcattaattaaaaatatatagatttacaggaaggatgtatgctatccagtttccctgattgtcacactttttttccttccaagtgcttatgttcagttgtgcactttaattgtgctgactgtttactgcagggaaattagtattttcgatgtattattacagagatgttccacatcttttttgtatgttatacttatctatattctacatgtaggtgaggaactgcccgtttctgcattttgtaggacaagtgatggtgaatgggatgccttcaggagtattgacatggacgttgaggtatgctagtgcgtcagtaatctgtgttgtccaccttgagttgacaataatatatcaaaccgaccgtgtaattagaaaaaagggcctatcatctagataccatgtgaactttttagggatccattttgcttactgtgctttttatctgtaggcacgattgatgcaacagatgaaacaatcttctacaaaacagaagaatcatgtggacagcgatgaattgattgctctcaatgcttggcatcgtatagatcgccaaacaagagaagccataaagagaaatttcctcccagatctgcttgacatatatgaggtatgcctttctttctctttgattgtactctttaaaccaattgccatactttttgtatttctgtttgccacaatggttactagatttgtttagttgggagttgttttactacttgatgcatctttctgattttgtagttttaaaagatcaaacaccttttttatgagcaagttcgaacaaacaattaggtgcaatttagggatccttacagtgtttttggttgtagcgtggaattgcattacacacctatcttattacaccattaaccattttggcttaaaagatttttctgtagaactcatggtaaggaccatataaacatacatctaacatctagaatattcctttacaacatgatttaaacttttgagggtcttagatcagcacctatcttattacacaattaaccattttggcttaattttttttctatagaactcctggtaaggtaaaggaccatctaaacatgcatctataatattcctttacaacatgatttacacttttgagggtctgagatcatcacctatcttattacaccattaaccattttggtttaaaagatttttctgtacaactcctggtaaggtaaggaccacctaaacatgcatctataatattcctttacaacatgatttacacttttgagg

SEQ ID NO: 54208 - DNA, 11073 bp, Oryza sativa
ctggtaaggtaaggaccacctaaacatgcatctataatattcctttacaacatgatttacacttttgacggtctgagatcatcacctatcttattacaccattaaccattttggtttaaaagatttttctgtacaactcatggtaaggtaaggaccatctaaacatacatctagaaatattcctttacaacatgatttacacttttgagggtctgagaaaatctctcctggcattgctagccctaatagctggcttacaagtaacagtgcgggtacctaagctttttagatgatgttctgttcgctcttgcatctgtctctgcaatttggaatggtactgtatagttatcttcttaatgaaaaggaagcagtcctgttgctcaggcttcaggcttaaacatggtgacctgattgtctgttattgctactgtgaaatgtgttattattctcagaaatgagatggttgagtgcttattttgccaacatttatcagtcttgtgaaacttttgatgtatacactcacgtgcgacgtgaatgcaagtgcaagttaacaattacaatatgattgtgtttgagtttctttacataaagtacttaagaagccttagttatttgatattggtgaatctgcttttcacatttgcaggaccgaattagggccttcattgaagatgctagtggtaaagatgtgcttgtactgaatgtccaggatccgtttcagaggttgcttctgcatggtgtatgtgaggtaaatattttctcaacaattcttgagaacttaaatcttcatccaaacattttaagttccagtcacaacttgtctgtatgcagttctataacgtatcatctacaaccacgactaccatgagagatggaaagctgtggaagacgacaacaattaagaggagaccgggaaccggtgctccctccaggctcacattagttagctttctgaggatgaagaagaacggatcccagtaacatgtggttgcttcaggaccagaagcaagaatttatcagatgcttactgctgtgccatgtattggcacaggcgatcctaaatcggctaaacgtgccgatttaggttctatttaggatgtacacatgtaaattatcatctatgttttcatttgatcatttgataacatttttaacatgtttgaatgcaagagattgggtcactggttgtgacttccaaatcctggtggtgttaatttgcattagagttggattaatagcaagccgtggtgcgttgctgagctgcatagatagggctgccggaccaagaatgacacgccgttgccgtcggatgaagaatatttagggctcagatctctggcttccaaagacactagggccatgtttgggggaggttgtcccaactgcagcttttcccaaaagctgcttctgctagaagctgccccaaacaattcacagcttcttaaaagctgccccaaatagtccacagcttctgagaatctatagttatagattctgaaaaatgaactaagaagtcagaagctgtgaatctgtagttacagattctgaaaaatgaactaagaagtcagaagctgtagaagctaggtttcatctgtagttacagattctgaaaaatgaactaagaagtcagaagctgtagaagctaggtttcatctgtagttacagattctgaaaaatgaactaagaagtcagaagctgtagaagctgggtttcatctgtagtaaaaatgaactaagaagtcagaagctgggtttcatctgtagttacagattctgaaaaatgaactaagaagtcagaagctatagaagctgggtttcagagtttttccaaaatatcagaagttagctaccaaacagctggttttcagagtttttccagaatatcagaagctggctaccaaacagctgcttctcagaatctaaagctcccaaaataggccctagagcatggcgacaatcttgtgaaatcaagcgcagtatatgtaacattaactagacaaaagtcatcgtgaattcgtcatatgacttcataacttgagaaacaaggcctctcgacgttaaacaggtttgccagataagatatggagaataattcagcatagaatgaatcggaatcctctgaattgaactgaacgtcaacgcttgacagatcatccggatgacaccaatacggcataggtaccggggatgaacaattaattttaaattttgttgatgcaggttcagtcaaatcataattttgaatcaaatatatattttgttgtgtttaataggacagttgctgaacttggccatgatccacctcacgtgcttgattggaagactgatggagatagctgtgtttggtctaacaggcatggcattgctatcaagttcaatgtttgtctaaataaatttgtggataacattacattgtgggcaaattattgaatggaagatgatcattatgatagaggaccattatcactgcagaagcatattgaatacaatacccccctcttaaaaaaaaattgaacctagctaggccagctaactcaccatcttatggagctaaccaaaagacccctaagcatttttcattgttttcgccaacaaaaacaatcatattcccctcacaacaatcatattaactaacacaaagccaattttccattctaacacaattaaccatagaaacttgcatggttctctctcaaatatctcattattagcatattaatcatgaaaatttacagtatgtacattcttaagtgagaacatcaactttcaatccgattgaaaggaacacgtacgcgaattgtagaacaaccaccaaatgaattagatacatacaatacgtttctcacacacaagctatggccgcatcgacctttcaacaatcaacaatgctatccaatgttttgatcaagctaggacgacgatcgatatggaggatgtggccagccacactcgtgatacacacacccatgtatgcccaaatatatatgggatatatatgccctggagatggagaccactactccagccagctccacattctcccagcagctagctagctacaatcctgcacctcttctctgtctactgtctagcgatagcaaaggcccacacaacatattaacattataacacacatacaatcgatctctgaagtctgaagctagctaagttcagctattgctgagacatggcttaccctcctagctctgggtacccaattacaggcagtagcctgcaggtgacgccgtgcggggcgctggtggagcagtacaacgagctcaacttccgcaacctctacttgcaccatctctacctggggcccaacccgacgcagtcggtgatgctcgccgccgacgccgccacggggctcggcgccaccaccgtcaacaactggcccatctacgacggcctcggctccctcgtcgcccgcgcgcggggactccacgtctacgccggtgactggcacaactccttcaccatcgtcttcgaggaccaaaggtacccgtgcttcaattccctccgtgttttctttacttgtcgttttgggcattgaaaccgtctcgcagtacatgtattatatcaccatctttttttttactacttcctcgaaattctatatatgtctagatttattaacatatacataaatatagacaatgctagaaagtcttatgatataaaacggagggaatacatgtttataaaagctagaaagatatgataaccatatgaatgtactttttataacaaatacaccgatatcgttttctcatatcaaatcataatatttttatattaattaattatttaagacttcaaggtttgactatatatacgttttagggcaatatctatttaagaaaagaggcagtataactttattgtaagacacgtttcaatttaaacaaatataaaaataaaatcggatttgctataaatatgtcatcagttttttatgaaaattagtcgattttttggccataggatgtactttgatatctgtgctagtgcgtagtagcagaaaaaatgtacaaagcacggtggcagggatcgaaaccctggtcttctaatcttctaagttgtagtgatagcaccaaaccaattgagcatggcaccattttttcttcccttgccaaaactaaagttatatccattatgcaataattacataacactttagttagtacttacgtagtagttacaccctatttacattgtatttacatatcagttatattcgtcacattgttaaagtacttcctctattccaaattaaatttacttttagccccttccatttgtcttaaaataagtttgtttttgagtaatcattgaaacatagtttatgaaagtatgatataattatattgagagtagatggagtgagaaatagttgcattgagatttgataaagtagaggtattctagttttttttgtggtttatattggtatgtgcaggatgtatgaaaataaatttatttcgggacgaagatagcacttgagcaccgaagaacgatacgcctagaataatatatagctgaaagggcatgttttaattaaaaaattgacatgtttatttgtgttgtacttaggtttaggggatccacgcttttggtgatgggagtgttgttatggttatggataccacatacctaatagtagttgactaaatctcggcaggacccaccacataccatgtcctatacggaaaccgacttcagatatggagggagtttcggataaggaaagagaaccagagttctacatggaaatgacaaggactactcggattgtatccatattggtttccctagttctacttggacaaggaaacacctatgggtataaatacaagcccccctaggaggacagggggacacccacaaggagacaatcaacaggatcaacacccaacacaatcgacatagaagccacaacatagaagcctacatacgccaagacacgccgccggatatcgacttcagggataggcatggctattctcctacggtgcctccggatactgtcaggagatacgaaagcgctatctctgatctcgccgggcacgaattcgaggaggaagactaccctgttgtcgactacgagtcagaccttcagaccgacatgtcgacaacagttagataggctacccacatattgtactggtatgattatggtgaataagagcaataccggcttcggccaacaggatgtagggttattacctgactactcaggggcccgaacctgtataaaaatccctgtctccatctcttttacctcagtctcgcatatatcctagcaccaacgatccccatactgtctaaataccgtagtcgagacatcaaacgtcgacaagtgtctgtcgaaaacggtgaatggggaattgttggtgggaccggtcagttcgccatggcaggaggtgtgatccagaagagggtgcaccaacggagaaacgatggcaacatcatagagattacaatccatggattctgccctgtgcctagaggctctcagactctgccaatgggaccatcccagcagtaccccatgcccacgtacaatgtgagttgaacaaaaattttgaccaagtttttcctctgtttcattagtttttaatccctccctttcagattataatcagattataagacgttttgactttgatcaaagttaaactatttcaaatttaactaagtttatagataaatatatagtaatatttataatactaaattagtttcatcaaataaataattgaatatatttacatagtaaatttgtcttgggttgaaaatgttactgcttttttctacaaacttagttaaacttaaagcaattttgactttaaaacatcttataacctgaaacagagggagtaagtattaatggaagtttacccgttatctgaaagaatgctattctccgtgtggtttgtttggccttagaactctgattgctaccatctactcattctgatgtagtcacaaataatgctcataattttggacaatgttttttgtcatacttctataagttttaagcatcgatatccttcaaatggtattttggaaaatcatgtactagatttggcttaaagagcaatttaacacaaacttgtaaattgttaagcattacatgtattttgcaattagttcagtcaccaacatttctttttcaagagctgtccgagtatttatgaccataggagtaagagaaatatcttcttttagacataccgtgcaaaaaaagtatatttcatttgcatcatgaataggtaaagcaaaagtaactctttcaatccatttcagcaaagccatcccactaaggttggaccatggggtggaactggaggcactcctcacgacatccctattgcaccccagcgtttagaaagcataacaatccgtcacggctggacaattgactccatgtccttttcttacactgaccaaactggtcagtagcgctctgttggcccatggggcagtagcagtggaggcgatacaaccacggtgagtatatgaattttttttaacatggaaatataacataattaagaatgcccttttgaattatatgtcaattttccgtgcataaagcattctacttcatatttttctataatatttttttctagaaataccttaacactattttttctacaatatgcatcaattatattggtattgaaaatactccctaattccttatacttctccccagaggaagcaacagtggttcatgtagagtttgaatatcattaattgcacacccaaggtgaaatattaattcgggttccactgtggtttatatatatactagattttgaacatgatgcatccatgtccaacaaaataatgttcgtgccgttcacaattgtgtcgatcgtgtactgtgacgacgatgcagatccagctggggctatcggagtacgtgatggaagtgtccgggacgtacggcgcgtacaacagcaacgtggtggtgatgtcgctgagggtggccaccaacctgagggcgtacggcccgttcggccgcgcggagggcacgtcgttcaccgccagcggccgcgtcgtcggcttcttcggccgctctggagaattgctcgattccatcggcgtctacacggcctaattgaagccccctctcgatccaggaaattgtgataccattatattgctcgctatcttgtgtatgcatgtttttagtactatgagtgctctggctgttcagtgcagtgtgatatgttctgtttgtgagaaaatagtattaatttcctgatatatttttacagggatataaatattcactcttgttcttgagtatattcagactagcaaaagtgcctgtgcgttgcaccgggtgattacggagtgtgtacattgaaaaaaaaatgttgcttagggatctaaatcagactttctcccggactggctggtcggcccacggcctcttatgtacacatgcgggagctccccacctccctgggccgcaacctgggcctgggctggggaagcctccccgcgcgcgcctctacttgggccgaattcggttcggccagtgccggccgtctgatcttagggttttgatcggacgaccggtgccgacgttgaagggacaaaaccccatccctcccggcgccggtgaaaaccctagcctcctcgccccctcgcccgaaaagagaaaagcagcggcactggcgcatgcctcctccccggtgtgcgcacttgcccgagggtgagtgcgccgccatcaagcggccttgccccggcgcccctccctgtcgtcttccgcgcagtgcccctccccatcgtcttccgcgcggcgccctcccctccgctgcggcccagcggcggtggcaccctcccctccgccgaatctagtgggaggggaggcggcggcggcccggcggcctagacccggcatcccggatctagcaggaggggaggggacgtgaggcgataacggcccagcctcccctcaatcggatccagcaggaggggagccgcggcgaaccagcgtcccttcgacggcggcggcggttcggcggcgacagcggcaccctctccttccggtatcgtttttcttcttgtgtccttgtcttcgattcatacgcttcagttttatttgtatgatggaattccgactggtttttttttgttggggaggagggcgagcgaaaatcaccgcacggacgaggtgacgaaagaaaaaatacgaatctcttaattagttaagatatgcaacatatgcttatattttagaacaaaaattgtatatgagaaatttggacatgtatgtaccatccgattttgtaatttcgtatgcaccataattcaggatagaaattggatggcaatagttaatacccgttaagggcttctttggaatatgggattcagaaaaacaagaatagtaaaaatgcgggaataatgcctcgttgaatcctaaaggaattttaaccacagacatttgcaacaaataccgtttggcaacactactggaaaaccatacaaacttcaagacttaaagagaaaacatgaggctagagctgatgttggttttcttccaaaattactacaaaatagcctactacaactacagatgcagccccgcgagccattccacggtgcacacgaacacgcgatcgtacgtgtttgagaggcacgcaagccacgcgacccagctagctgctgggtgcaggagcgcccatgacgggcattgacgtacagtactgtactactactactactactagctgtattggcagcagcggcgagcacaacctgtgtagtacagtactcctatatacggacatggtacgcggcgtgcaaacgcaagttgcagtcacacagtcacaggagttaggggctgtttggttcttaactaacattgatataaatcactttagacaatgttagacaaatgtgacttatcacgtttttttttcctacaaattgtaagccacacgtgtggcaaagttaggcaaagaattgagtttatgacatgtggggtaggacggtgagaaagtgtggcttgctataactatgacaataaaccaaacacaagcctaaggagttgtgtcaaattgaagcattgaatcaaatagccccaatcgttaactactgacaccgacacgcgagtcacgggatgttgccgcggttgcacgacgcgcgtgccacaccccatccattgactgcccagggcgcaggaacaacaacaacaaaggccggccggcgtgcgtgcgtgcgtgcgtgcgtgcgtgcgtgcgtgatcctagtgtacaggctagctagtacggagtacatactaacccacacgcctttgtgaatccgcgtggatttcctgccccgatcgaggagcatttgccgccggcagcatcccgcggtggccgcgttgcttgcgatccggaccgagcgctgagtcgttgttgttatgtgaagttaaacgggaaccagccaaactgccaaggcatgcatgatgcatatttaggcctctcacattgtaagacatggggcccgtaccttagagcacccgtaatgttaaagtaaggtgctctctgtaaaacatgtacatcttagcaatagactagattaatagtaaaccacctcaatagtatgtctatatgggtatctatagctctctaatgcattgtctcgtttttctctataaactatctccacgttagtagatagctttgctctctctcttcatttaatctcttccaagtaggaaaatatgctgacatggatatcttgtaaagagcctatagataaccattgcgggtgcccttagctcaaaaggttagtccaaagacatccaccacatagtgtaagcacccatatatgtgtggcttaattggatggagacactgatgaaggaaacgaagcccacagtgggcgtgaacccaggcttttggacacggtaacggagcaaaatttattcctcacctacccctctctccaacccagcacgcaggcggacacctcgaccgcttcgctctatccaaccccttgcggcggcggggtgcgtccccaacggcggtgactggcgcggtggcggcgggacgcatccccggcggcagcggtcggcttcggggggcggcggcacggtctcacccgtctctcgcccttccgtctgtggctacagcgcgggatgtggctacggcgcctccttcccttcccttctctgtcccgatgggaagatgacgcgacgacgacgggaagccggcttcgaggtggtcagcatcctcctctgtgtccccgcctacgacgccgtgctgatgccgctcgcccgccgcgtcaccggagtccgccgctcgcccgccgtgctgatgccgcctcgcagctgcagtggctcggcgtcggcggagccgccggcgcccacagaggagccgcgcaggcgcagcaccagccaccgccgccaggagaaggagcgggtgggccgggccagcggcggtggcgcggaggaggtgcgggtgtaggtgcggcggcggcttgtcctgcgcctgctccttcttgtcgttaggcaaaatttcttggagaaggagaaatgtccgctgcttttcttagctttcatctttgtgtgcatatactagttcagattgtttctcggagaaggagaaatttctcgtcttggtgagttgggatttgatcttgggattgaatgaacttggtatcttgtttgggattttgttttgatttgattgagttgtggccaatgacgacgacgacgccgtcggcagcagcaagaacgtcggcgcagactggatttttggagggcgaatttgggatttctccgagcggctgcggcgcaaggacacgctgcgtcaaagaacggacgcgcgtggactcgtcaaagcgtggtaccgtgtcgctatgtttggggacgaggggccaagcttagtcgcgattcctagctccacctaagcgaaaatcctccatggcgcaggtaaggcacgagccagctcaccgcactgtgagaagccttaggatgtgtttatgtcacgctaaaattgaaagtttggttgaaattggaatgatgtgatggaaaagttagaagtttatgtgtgtt

SEQ ID NO: 54209 - DNA, 10494 bp, Oryza sativa
acattgtgtcgacgctgatcggccgctctcaccagtgccctgtttagttcacaccaaacttccctcaaacttccaactttccatcacatcacatccaaaactttcctacacacataaactcccaactttttttctaaactaccaagttgtgtttagttcagcgcaaagtttagattttggttgatattggagataatatgactgaaaagttgtgtgtgtatgacagattgatgcgatggaaaaggactgaagtttggatccaaactttggatctaaacacagcccaactttctccaaacttctcctcaattttagaaactaaacatagcccacgtacacaaccctgcagtggtacactactaacagtagtacacactagctaagggtgtgtttgaggagaaggggattgaggagattgggaagatacataaaacgaggtgagctattagctcatgattaattgagtattaactattttaaatttcaaaaatagattaatatgattttttaaagcaacttttctatagaaaatttttacaaaaaaacacaccgtttagtagattgggaaacatgcgcgcggaaaacaaaacaaaacagacaaactcactctctcacagtttctgtccagactcagagtcaagacagctcgtggtctcgatgatctggacgttattgtcacgtgcaattctcttttttttttcacaattatactaccttcgtcccatattacttgtcttgattttcttcgtcccatattacttgtcttgattttttatttgtcaatgtttgatcattcgtcttattcaaaaaaatttagaattattatttattttgtttatcatttgctttattatcaaaagtactttatcattcgtcttatttaaaaaattttgaaattattatttattttgtttatcatttgctttattatcaaaagtactttacatatgactttttttttatatttgcactgatttttcaaataaaacaaatggtcaaacgttgcaaataaaaagtcaaaaacgtcatctactatagaacggagggaatactaattaaacgcgtgtacgtacaggtttggggctgattgttcttccatttgtagcctcaaataaatcaggcggacgtattaaccgtggttttctgtgctgctaccattctgaatagactaattttactgttcttgagaaaatatcaaaaggtatcaatttttttattataaaatttagtacctacaaacagttttaatgtacattgagatactaacagttttaatgtagatatctcaagttattttttaagtactactataaaatttctcatcttaacaaaccattgatcagttaatttcgtacctataaaacatgatcaccatcatcatcatgatcacatcaattggttttggttggtgcccttagttaattagtaccgaatcacacactgttcccagctgtgctcacactgcaatagtgcaaatacaggtgtgatcgatattgtacacacgaacgtactgctgtttgctgaggcccacacacgtacgtacgtacgtatataaatacactcggaatcaggaaacataatttgatgtcccgccgcgtatgtatcgatcgtattattgtacgtacatacgccgatacgcgtggtccctgaggcccatgacgacaagaccagaaggcgctcatcagctgtacgtacgactgtggcccaaacgagcgaggaggccgaggccacgggccttggtgagcgcccaaagccggccgatcgactgggcagcctagcagctggtccaggccagggccccctgctagatgcccatgaacaatcatccgcttccattattacacttcaaatcaaatcattccgaatcggcaagaggaaaatcgtccgtcgcctccttcggcaggttggaaatttagagaatcttttggggatgagctgaactactaagtacagtcgtagatattcgtgctcaacgtttgactgtccgtcttattaaaaaaatttatgaaaaatttaaaaatatttagtcacttataaagtattattcatgttttatcatctaatagcaataaaaatactaattataaaaaaaatttaaataagacgaacggtcaaacgttgaatgtgaatagtgcaaaactacacttattttagaacggagggaatagttctttggtcaatattttgtagtagtgaaattttagcgccttttaaaggaagcttgtaaaagagagcgataaacccaataaccgaatcacatcatcaaagagcatctccaactatgaaaaaaaagggttcgaaatggtcgaaaaacagtctcaggatgtgctatttagtctactttcccaactttgatcatctcccttgtttttcgcgtgtgcgctttccaattaaacaatgtgttttatatatatatatatatatatatatatatatatatatatatatatatatgtgtgtgtgtgtgtgtgtgtgtgtgtgtgtgtgtgtgtgttgctttaaaaatcatattaatcaattttttatttttcttttctattacttgattaatcatatgtaaaaccgtcacttgttttgtgtataatgggggaagggttcccaactcgagccggagaacacagcatcaatcatatatttcctccgatatggaatcaaaaacagtataagagacaaaactatatggaggaaacatttctacatcaatccgaaactagtaatgtatgttgaaaatgttagacgactacaaaatcacatattttactcaacataactacataatataataaataagacacagagacaattgtggacgatggtaacaatgactttaggtgcgggcgggtaacgccatagatcccggggcagggctactcatgttgtgggtggccggtgggcagagtacatggatgtggtggaaagcctcatggaggagctagctctagttgatcggcaccagggccacatcagggattgcaaggcggtactagagaatgagggtagggacgggatcatgggctccaaaaacgccccaaaactagcaagggtgaggggttttcggggctctgtaaaacccgggagtggtttggagcagtcatttaaggtgggttaggcacttaaaatcctcaaattgcacggtagggaacatatacggcttctatgggagaggctctaaattaaatcaaatcttttctataaaaacaaatctatggtaaagtgccatctaagcagtataaacgttgtacttgcaaatgttgatgtgcataattatgacggctaagtctgtagaaatctcgtcatttacatgatgggtcatttagcaagcattcactaccgcgaaataaccagggattagtggcggacgcagctctaaactatagatggggcggagaacagataagttcactcgataaaagcaatcgaacacaatacatatcgtattaatagttcattcttataactgtcttaatttgttatgtgtttataccttgttatacctaattttgatagtccatgactactataagggggtgttaagagtgtggggtgacacgagtcgtagctgaatcggtctacccaccctgcctgatgggtagatccctgccggggattctctattgtcgaatcacgtgctgggttcaagataagcatcatggcctttaattttgctttagcaatgcttacaaggtactaccaccggtccttaatcctgattgatgaaagtcattcattaatcaaggagtatatagatgtgttgcgaacgtattgtgtggatttaattatatgataactctcggtatgttgttaattttaacgtcaaagcaagtaatttcaacattaatattattacgcgcaagaatttatcacgtcttttgcaaaagggacctggtagagggtaataatatggttcattatatcatactattgagcagtaggtaatcatgttttgcacagtattttttatgtcgatcaattgatcgatgtcgtccttggattggatataatgtcaagtctgcttcccatgcatgctgaatctagagttctagacaacttatacatcgcaggtttacatcagatgggcacacaaaagtagccaaaacaccgatggctagctagcttgaaagaattaatgatctcaaacgccatcgatcgctacaaatggatgaaaccagctaggcaacaataatcaaagctttaatttcctactttcataatcaatcaacatggcctctcatgaaccagacgtgccgacatgcatatccaatgtactactactaataatatttgcatttaatccaaataattgtaaaaatattaaacaagatcgattaaaatgtgataaatcactccaaaaatatacaaggtcaaattcaacttatataagatgtaacgaaagaaaacaaatttgattgtgaatatacgttagtcatagtttaatttggttttttcaacttgtcttgttgaatatacgttaactatcttattgaattttctaatatttttataaccatttaaataatatgcaagtaaggaatctcttagagttttagaatccactccgctattatatatgctgtaaacatttgcatgccatttgccaagcttatataggacaatgcaagtaacctctttgcttcaattccgtagtgtacgtgatcagagtccaacttaggagtagccccgattgttttcttgtgagttcagttgctgtcacttggaaagtgcaactgtgcaaggccagcctccatcataccatatatacctttgctttccctacctgtccgaattagccaagtcatgatcgactgatcatattcagtccagctagttcaatcgcagagttcaggatatatgccggttgcaaaactgcagtgatttacttagactatgtttagattcaaactttggatccaaacttctaactttttttcattgtatcaacctgtcatacacacacaacttttcagtcacatcgtaccaatttcaactcaaattttcaattttggaaggaactaaacacaaccttataagtttgccatgcaatatggcacccacattaattaggacaagcatgatccatcaaaatcatgtcacaccgaccgactgattcatgcatggcggtgggtggcccggcaaacaccaccaaaatgcatgcgatgcaacgtgttcctcctcaagtcgatctcaacaaaaaaatcggtcacattctggcctcttgtgtgcccctttttctactgtaccaactaatccatccggcccatgcatgcttctccacgaaaacttctcctgcaaaagtcgatcactagtgacatctctacaaggtagcaaacgtttgctaggccgcacaaggtggcccacgagttggcgccgtccgtccagccccagctcgacttattagaaaataagaattttatatatgtgtgtttttagttatttaaaaactaattaaaaataccttaaaatcaactttaaaataaaatttgataattcaaattttagcttcgactttactccctccgtcccattttaagtgcagttatggtttttcgcgcccaattttgatcgtccgtcttatttgaaaaaaaacaaaaacataaatcacgagttaagtactattatgttttatcatctcataacaacaaaaaaaatactaactataaaaaaatcaaataagacgaatgatcaaaattgagcgcgaaaactcatggttacacttaaaatgggacggatggagtagcttgtaagagtaaccaatgaggctctaacttattactactatcttctgaatttaaatgattgatatgttaacgatccacgcgttagagaacagcatgtcagaggaacttgttcccagcacaatagccatcgatccctttcatggtttcaccaaaagaaaacttcgaagtgccatcttcatcttcccaaacatcttcttcactcacaaggcacgcaagaacgaacctgtgcctggtgtggtatcttttttttctgtttggctgttggaattttatgaagataagttaacgcgaccacagctgcaaaatacgtcaagccaatttattgcgagtgtgtcaatgactagatgatcaaaaagcctcttgttttcatatgggagatagaacaaatactagtagtggagagtcacacggatgcggtactcctgcaaggtgtgattgtacagtaagcctgaatgcgagagatgaacaattactactacatgtgagtacaaattcaagtacgtgtatatatgtcgactacctccttgtcctcttgcagtagcaaacataggcacatagcaatcaaagtagacatggcattaagacactgcatgcaaagatagcaaatgcatacaaagaaattcatcagatacatgcatccatatacgcgagtttccaatgtatacaggtcactgcatcgatcccatggatgacagcaaatttcgcgagaaactgaagttcaaaattggctacctgacatcaatctagcttgatccagcacactagcagcatgcatgcaaggctggtgcggtgcctctcttcgtcaaaaagatgagagtgcatatacgaacaaatctgtaacctcgatttgcgatttgctcgcgacgatgacgatgttgcaatcatatcttcagctcaactgcacatatcttggtttaattgttcgcttgaaatgtaaaatacggagtacagtatatatctccaaatatttaacaaatttatgtttgtgtcaatccctctgaattaaccgaactgtttccagggtaattgagcacgtagtagatgataatggatcgaacgctggatggtgctgtgttttacgagtgaacagtgaagtgcacccgatcgcaacagtggcatggcatgcaggagcaggagctgcgacagcgacacgcaaactgtcacccatcgccctccctgctgccttcctcatccgtcagcgacgtcaaaccacgatgatctgctacaacaacaacaaaaaactgcaatactaccctgcaattctgcgcatgagccgtgaaccgtccatccatccgtcacaccgcgcgaggtcagcgtgaccaagactttaccatcccttcccttccgttttttttttttgtgaccagcccttttacgtttttttttctcctcttcctttttggagagacgagtgcgtatagaaacaaaaagaaaaaaaaagagagagggagtagtagtaaaagacagtaacggaagggaaagagtggacaaaaaaatcaggggaggtgaaacgcatgcaggtgcagtgcagagagaggcaaaggccaagttaagagggcgtcatcaataagagcctgagtagttattgtgctcacctccctcctctgacacacagacatggggatatgcatgcatggagagcgctcgcctcgcgctgccgctgccgctcgcgcgtcgcgccacgccaacgccaacgctagctagcgcgagcgcgaggatggcgtgaccgcgcgcgcgcgcctcgcgtacgttgttgttgccgtcgtctcgcgcggcttggctcgcggcggtttgcagtggacgacgtacgtaccgcgcaccgcgcggcgcgcgcagcccacgccgcacacgcacacggctcgctcgccacggcagcacggcgcgggcgccgcgcagccaggggagatagacagatagatagatagagagagagatagagatgagatggcgtggccgcggcgcgtctacggaccacatcgccttgccctgcctgcacagcgtgacgatgcccaaagctacgcgcgttacacgattgaccgggcgcgtgatcagcacagcacagggaaccccttctcatctccttttgttttgcatattagccccttcataagagagtaattctggttgaggttacttcgccggtaaaaaccctctagtagttgtatttttcttattttgcactaccttagtgcctattttatctttacgttgaattgatagggtgatagaccggagaaaacgtgatatgcctatttcttctgttctcgacaaaaacagatttgttgagtctgagaagctgactagccgttgtcgtatgtaaccgaaaatatagcttgtaaggtcaagcatgtaatgtctacatcgttaaataatgtgatatgctacaaaacggaaatgtatatcttgttgtacgagtgttgcaataaacgtcggagaatcataaccgctacccgttttgaagcgttgcaagtagttaaagcttccttatttgtcgatatacggacgttctaatgctctcgtcacacaaactacaatggattggagtacatggaatacgttatggccaagactactcgtttacaattgaatcattaaaagcttctttatatgtcggttgtacggacgtcgtattgctcttgtcatataaactgtaaatgtaatgcatggaatacatgacgaccgaataggacaagcgctcgtgcatggatggtttggttgcatgttttttcacgtaaaatcttaatttttgcatgaaacatattttcatgcgtcggtgtcatcctacgtacaatttgctaaatttttcaccaagtcttttgagaaacattcaaaaatatttttttttaagaaccccgaagaccaaaatgctgcagagtcagtcttaactgcaagttacagaggctagaagggctaatatgaaatttgcagaaaaacaagattttctggacactttttcaaaaaagcaagaaaaaaccgacattgcgagctcggcgtaaacatctgatgagtacctcacatgttgaacatctccctgtacttactgacaagtgacaaagtgggtatttaattctctcttctcttcaagtcttttgcaagagccccaggcttcccttccttcacaatctgtggagggtgcaaagagaaaggccttcttccaggcaaggctgcagtgccgaaggcgaaagcaaatacaaaagggtaagaggagatggtgctgcctgtgtttatattaagctctcttcttcttcctcctctcccttcttctctggaccaccggcttaatagtagccccatccttcttggttttctgcaaacacgcaaactctaataagcctatatgtttctctctctctccatagcactaactcttggtgtgagtgtgtgaagggagagatattatattggaggccattaacttatcttcagaaagaaggcatttttcttgtctgttttgctcatcataccttctccctttcttcagagagggcaatgtttactggttgctgctgccttgttgttgttgttgttgttctgtccctgatttgaggactctttgtaccagatctgtgaggaggcctcctcttgtgcttgtgttggtggggggcgccgcacttgaggtggtcagggatgagtaaggaggaagtcctcaagattcaggtcagttttttcttttttgcttcttctcaactcaaaaccatgatacagacattctgtttttctccttgtttttgctgccattttcatcagaaggtaagacagggcagctagcttttctttttcattcacctggtgtgttcctctcctgctatgttttcttcgaaaacgcctctgtttttgctgttttggtaaacctgtgttttctctgttcctcccaaattcccagacttgtgtgctgaaagtgaacatccactgtgatgggtgccagaagaaggtcaagaagatcctccacaagatcgaaggtaacagaaaaaagagagattattttttatgagcaaattgcttttagttatatggtggtttgaaattttctgggtgaaacgctcgttggatttatgtctgcaggtgtgtaccagactagcattgacgctgagcaggggaaggtgacggtgtctggcctggtggatccggccaccattatcaagaagctcaacaaggccggcaagccggcggagctatggggttccaaggtcggggtggcggcggtgaacaaccagtttcagaagctccaccttgacggcggcggcggcggcaagggccagcccaaggatggcggcggcaaggggcatcccaaggacgccggcggcaagggccagaagggcggcggcggtggcggcggcaacggtggaggcggcagcaaagacgtgaagatgatgatgccgccgcagatgccgcagccgacgccgcagcagcttcagcagctgcagcagcagctgcagatgaaggggctgaagctgccgcagttcatggacgccgccaagatggcgccgttcgcggcggccgcgccgatcaaggaccccaagtccgtcaagttcaaccttccccccgaggatgacttcggcgacgatggcagcgagtttgatgacgagttcgatgagtttgacgatgaggacgatttcgacgacgacggcctcgacgaggactacttcgacgatcccaagatgatgaagcagatggccatgccgccaccaaacgccggcggcggcggcgacaagaaaggtggcggcaagaagggcggcggtggcaacgagatccccgtgca

SEQ ID NO: 54210 - DNA, 2062 bp, Oryza sativa
cggtgtcggtggtccgatgggcggcatgccggcgcagcagcaggccatgatgatgaggccgaacatgatggggggcggtgccggtttccccggaatgggccagatgggcggcgggcccatgaccatgccgatggcccaccacccccacatggggagcgcccagggcggcggcgccggcgccgtgcagggcatgccaacggcggcgttctaccagggcggcggcggcggcggtggcggcggcatgccgtccggcccagagatgctgcaggccgcggcggcggccggcaaccccatggcccagcagcagtacatggccatgatgcagcagcagcagcagcagatgatgatgaacggccacggccaccacggccatggccaccaccacggtcaccatggccacggcggcggcgctgctccggcggggtacccggcgatggggtacgggtacggccggccgccgatgccgtacccgatgcactacccgatgcagccccacccgcatgccgatccctacaactacttcagcgacgagaacccaaacagctgctcggtgatgtgaggtctccagtgtccggtttgctttcttcctcctcctgctgctgcttctggtcattctgttgttcaacaaagtgaaccaaccaggagtcaaggaggaagaagctcatcaggtcacaggtgatcgtcatcatcatggttgagatgagagatgctcaggatcagtcaaccagtatacaccatgggaaatgagtcccatctagatcgctcttctttttttctttttctttttttctttttacttagctcgttttcacctttcttttaaaggagaactcaacttccttgaaggcgaaggtaggtatagtaattatctatagtttttcataagagatgatggtggtgctttataattcgagaaggaaggtggtggtggtggtttccttcttgctccatataaggttgtggcgatgcatggtagacgaacaatgtgcaaagcaaaatgtgttgccaaatggtttgtttgtgcctctgtgactgtgacagtggatgtgtgccctagctatagtgctctttttacatgccactagtagtggaatgttgtcaactcaatgccatgcttttctttcttccttggtgtgagagaagaaagattataatactccatcccaaggtgaggaaggtgataacaatgataattgtgggagcaatgcaatggaggagaggggatggatgatcatgatgatggctgtggtggtggtggtggtccatgtgttatgtgaggaggaagagggaagtcatagaggagaggagctgctgcagttttggccatggttgcaaccttttcctgcaccctgcacttacattattgatggggtaagatagcgctgtcccgtagcagcagcagctgctgcattcaggttggcttaggggttcccaaacaaaatttttcaggttgtcatatctaatatttgtatatatgcataatgtattaaatataaaaaaatcaattatacagtttgccaggaaattatgagatgaatcttttaagcctaatcgctctatgattttgtcatatctaatatttgtatatatgcatagtgtattaaatataaaaaaaactaattatacagttcgctagaaaattacgagacgaatcttttaagcctagtcgctccatgatttaacaatatgatgctacaataaacattgctaatgatgaattaagatggattaattagtcttaataaatttgtctgtaaacattactaatgatggattaattaggcttaataaatttgtctgttagttttttggtggaatatgtaatttgtttttgttattagatcatgcttaatattttaaatgtgacaggggggcaaattttttcgccaactaatgaccacaggcccttacaccagaattgcacatttcaatcctatgaccacagtaagcaccactgcttctgcctgccctgatcatagaactgcttggtccctctccctcacaacgattgattccacccccaactaccgcggtaaaaggtgagaaaaatatcgcagtatat

SEQ ID NO: 54211 - DNA, 1187 bp, Oryza sativa
cttggaaacgagcaagccagccagcttcaattcctcttcttttgttaatatgaacttgtttcagttgcgttgtgtttgtccaagtaggcaaaagcagctttctccaaagcgatccatggagtaggaggaaggatcttatagtggggcaagcgatggagccggatggaagggaatgctactcgctctctatgcatgtagggcaggcggggtatgtacttctatgtatgtatggctcaattgttgtgtttataggagcttcttaaacccatccaacaatctaaattgtcactaaaattatttttcacgaatgcgaaaaagaaattgcacgtcaatatattggaagaagcagaattttagttacacaacgcaatcggccagaaagaccctttgccatgggaaagtaaaaaagaggagaaaatggccgctaagggaagctaaatgttgctcctatattatggagggtggcggcggagcctcactacactcctaacagagctcaaaagtcacgacgtccgcagtagatcacatttgggcttcctggagaatgtgctctaggaccaccagaaccgactaaagtgtgaagtgaaacaccctgaagttccgttcatttcacaactgataggagatcaggaggactaagtagtcgaaacccttacgaagatgctcaggctgtcatgccctagaaataaattatgaaaatctacagttataaaatctaaaagtaaattattcattatcaaaatgaagttactaaaatcgtgtcaaattgaaggtaggaaatataaatctctcacataaatcatcggatgactattcaacagctgcttgtcagcgaaacgtgtcgcgcatacacacacagctgagaaaaggtaggcgtatgctaggtcaaaaaaaaataggctgcgatttccgggccatgttttggggggtgcaactgcactgaatcattgcagggggcttgggttgctgttgttgtttgcttcaaagtgatcgtcgtagagttaggatagctgtccacatagctggtttgaagtggtagctttattgtggcagcaggaggaggccgcaataatggcggctttaagcgtagggcctctgctcctctcctcttctctctgatgagtgtgtgttctcctcttctcttctctctcatgcacggtagggtaataatcctgccgtgccataac

SEQ ID NO: 54212 - DNA, 713 bp, Oryza sativa
ttcatctttgaaggatccgataatgccttatccgctctaggcgtccccagccgaagttcccttaggttcctcagaggccttatcaagacggcgtaaagggacattaggataggtttcaacgctaggtgtcttttgtggtaagggatctctgggtaaaacacttggcattattgtgtacctgatatcaactttgttgaagtagaggtaatgggagaatcgctacacctctggtcaagaaccaggtagtagtcgtaactcaaccactagaagtaaatgtacgagagatcgctacaattgactggttgagaaccagtgagtaggtgtctctcgatcatttgaagtcgtggtacgaggaccgctgtattattgctgtagtcgtacctcgactatctgaggttgcggtgcgagagattgctacgttctggttcgagaaccagcgagcgagtagaataatctctcgaacacccatggaggttgcggtgtgagagattgctacgtactggttcgagaaccagcgagcaagtagaatcatctctcgaacaccaatggaagtttgcgatgcgggagattgctacgtactggttcgagaaccagcgagcgagtagaatcatctctcgaacaacaatggagattgtggtacgggagattgctatgtactggttcgagaaccagcgagcgagtagaatcatctctcgaacaccaatggaggttgc

SEQ ID NO: 54213 - DNA, 801 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatcc

SEQ ID NO: 54214 - DNA, 57040 bp, Oryza sativa
  unsure (1)..(57040): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtggaaacagcttttgttaatcatcatagtacgaaacaaccatcccaagctaagaaaaggaacatgcaactatatattattaaccagaagaacagaagcaggttaatccggtcttgagaaatttattatcctaacaaggcacggagaaatcccataattacactgctccacgtcccagtcgtttcccgggtctagcattcggggtattgactacacgctgaatttagtgagcaggtcatcccgtcaagagagccttgcggatgacaaatagcaaaagaacatagattatttcatccataatggtgccccagcagacatcatagctgattcagtgatagagcttgcccagatcatctttgaatttggtctttatctgctccctcttcagtttaagtgcagctgtcaccagcccagactctggagtccatggttcaggcagcaacacaatctttgctggtatttcaaacttctcaagcctcgctgcttttgcagcctgcaccgttaaaacacattgcgttagatatcatggagaatgatggtatgtaattaacatgagtataaaaatcatactagtattatcatttgcaggttaagatcgccttagattacaagtacattaatcagcaatctgaatgacatcaaagacgatggattgcttataggaatcatctgtcatctccatcgcgatgcttttttaagtactttgtcatgcaaacataaactgtattgcactcatgtgatagcaaaatcctctgaaatccacagtaggtcggtctccttacattagtcacaggtcatctaatcgccaggttagtaaagacatacccatttcgtgtcataaatctgtgatgagctttggctataatcaggataacacagcagaaagatcaatgtgctactagttgttttcagttatgaagatactacaggctccaaataatttgaagaatacaatatgttcttcagcataattatatcctagtagttctataaacaagtctactgcatccatcttatctgttgttgtactcactgatgagcttgtaaaatccatcagcttttgcacttcacctatgttctttcataatttatatctttcaaatgtaatccagaaaatggcattgtctaatccatgaaatgaacccatttcaaattaaagatgataaaagaatttttaagtgctcctttggatattgggaaatattcctgcttcttctgggaaatgaactactacaataaaattcctgcattttaaaggagccttgaaattttaaattactttaaaaatagaaatgaaaacagtggggatttattgaatttctatgacatataaaacggacgattgattagagttctagtgcaagagttactgataatttgaatttcattttgatttctgaaataaagatggacactcagtttcaatagatgctcagataatgaaaacaaaagaacgttaaattctagcaatagacagctgatagatcaagcagacaactctccaggagaaatgcaagatcatactgatgtaatggtacatagaagtgatcaactcaagtctaacctttgatagagattgctggacctccttaatggcttgatcattgtggcacagctcatcaaagtttttgtagttaatcccagaattttgagcccactgctctaaggcctggtgcgccggcactaccaacgccacacaataattatgaaatggatcagcataaaccattatgctgtccacataattgctagtagttagagctgattcaacctgtaaaggccagagagaacgagagagagagggggtttaatataattataatacaaaaagaatacccataatggttgaggcactattgtaaccaaaccttgccaagagacacatattctccatgctgaagttttactatatccttttttctatcaatgatctcgaggcacccatcaggatggaactggccaatatctccagtgtaaaaccagcgcattcccctctcatctacctggagtaatcagaaacaaaaattgaagtgaaaaatattgtatttgaccaccaaggatgattggcaaagatcctttaccttgtagacctcatttgtttttgcttcattgttgaaataaccttttgttatgctgtatccaccaactacaacctctcctcggggcattggagaatcagaaattttatagccaccttcttcccatgaaacgagctgaattcatttgatcagaaaaaagagaattagagatacatatacaacatgataagagaacagaaatatctcacaacagaatgaaatgcttgctaataaaccaaccaaaactattgtggtattgtaaaataattttacagactttctgtgtgccactttaagttttagaatggggatgttggtcattcttaaggtaacaaatttattgttgtctataggccatttttcctaacatcaagatgaacatacagcaactcacataatctttatttgggttgaaacaaaataattactataacttgaataaaagtgagagaaggggaaggggaagacttatgtattgtttgataaagaaagagagtctaatcatccaaaatagtgtagcttctgaacaataggatcaaatagtaagagcatctctagcagaagccctcattttaaagcccctaaaaaccaaatgagggctgcccccaattctctaggaccctacaaatgccttcaactccagcaacagcccccatttcttagaccatatttattattctctattatattaatatagactataggtttatgtctaatttaacatctcaataattaaaagataaatattttacaagatcatatcgatgtaaaagttaattatcaggtgcattatgcccgaacagcataaactatagagtatatatttaaccaaactactgaaatattatcctatatgatgtgtcaaagaaaaaaatgaatatataccactgtctctttccccaatcctgtatatctcgacccaatggaaaaataataatctttccactagaatcctctatgcctcagtaaaaaaaatgcaaagaaaaatctactccctgcattctgcgtgcagggacattgcaggggaaagcagacaggcagaagagggacaggcggggatgggctagtgggcaagcgctggccctccgggtggcagcgccgccagcgcgagcaggaggtggcgcgggttggcaggcaaaagagctaaaatcagtgcggtgattcgcagacgtgcgagcggatggcggacctttctggggtggtcttgccggaggtgaggggtcaacgacggtagccggaggagatacaaatgcatcgcagggtgttgtgggacagggaatgtgagatgagcgcgcgaagggaaaataacgtctgcaccagaaaaaacgtcgataggggccatcctgttgagcccccaggactgggggtttcgagggaggattcaggggcctcctcactttggggtctatagtagggtctctgctggacttgattttttcatgttaactctcataatttagttaggggctgggtttagggtccctgctggagatgctctaaggaagacgtattatcatggcaggccagctcatgcagatagcaataggtgtataatattatgtagtatgtcaaaactgataaaaaaactatatatgtatgaacggtatatcagaagagagaatccataggtgtatggaactatttccacattgttatttacagttacttttgactggttattaataattaagttgttgtctgttgttatatcctcatggaaatccccagggtgataaagccttgtgggagacatgggctggtagccttggtcggagaggtgtggggccgtgagacagtaatttctctctaggcatagtataaacagatttttaccattttatgtatcttaacgctattatgttcatttaattataaatttgcatacataaatatcacttatatctgttaattatatgcatatacatcagataagttgactgtccctagtaagtataagcaaataaatcagataagctgactctccctagtaaggcacagaccttgacatagcaacaaggaaggggtggaccaacacggcccacacttgtgtcatcccattcagaaaaggctgctccagcacaagtctctgtcaatccatagccttgacctactggtacactgcagcacaggtaattcaaaactgcataagaaccaaaaacaaatgcagcgacatacaataaaaggaagctcatcacattatagcatagtgcatgtactctagaaaggtcctctgtttaatatttcaactttcagcatttgattcactaaacgtgcaaatacaaatttcactataaagtgatttttgacaaactgtttgaattaaaaaaacatataagtagcacgcccaaattttatgagcttatccaacaaatgttttgttttctgtaaataaataaatccaaaggtttgatgagcgcactacctgcaaacgtacactctaacaatgtctaggacttgagtatggcattgaacttgaattttccatgaggtaagttcattaaaatcagtattttttttagtaacgtcttaaacaaacttaagatgtacaataagacaaaaaaaaaagttgactccttgtatgtttttggaattcatgtaattctagcctcatttttcgaagaaaaaaaagataattcaagtatccgagaaatgacactatgctctacgactggcacacaatcttcaacaaataaactcagtggaaatttttggaagaatacttcttcagttgacatctcactgattgcaaatggttaaatttaagataatccaaataggacaaaagaaattacccaagacatatattcataaatctttgtgtgtcactcgatagaggtgcaccaccacaaagaacaaatctaatgcgcccaccaagcatggaacgtattggtttaaaaatgaggttatcccatatcatcctctctggtgcccaggatccaaaccaacttccttcaatagctccaagatttcgtttataggcaatgtcaaacagctttttggtcagaccacccttctcaccaacctggaaacataatttaaatattaagttttgagatgagaagtatgtttaaaccatattttggtgcatgatcataaaatttgaccgttcaattctgcctgcatgatacatgccatttgatgcaatgcatttaaaatattaagtctacagaaactcattgtttcaaacatgtttccagccttcggtttcatcatctgcttgttggcttatcagccacaaccaatttgaatttgaaacttaattttagagttgaatttggggttttctcatcatagtctattctccagccttgtacctcccatttttaatatatgatgccgttaactttttgataaacgtttgatcattcgtcctattcaaaattttagagcgaatataaaaaaatttaagccatgcttaaagaacatttgacaataaatcaaatcataataaaataaatgataattacatattttttaataagaagaatggtcaaatgtatctcaaaatgtcaacagcgccatatgttaaaaaacggagggagtataacagtttaacccaaaaattattttcggttgcttcattttctatggcttatcagcctcagccgaagctcagacttgtatgctagacaagacatgaagcgtgctacggtatggtaggcattataatggctagggttgggaaataagagatgcagaccagagcagtgcaccaaaactgaaggttgtagtgttgtatgataccaaaaacatgcatgttatactatgctagaaatggctggggcctgcacttgactttgcccattgagctagccagaacatcaatttttttttttaagatatgcctggtgtaaggtacagaaaaatctacaagttgctaggctgctagatgtgcaaacgacaaccaaacagtgcatctatatcctaatcttaattccttaaaaatactgaattgggggtgatagtgtgctcttctataccccaccaagttgtgtggtcaggtataagtggtgacatataaactgtttgcagtatttaggttttagctgatcccatatggcatgtacatccattgaaatacgtgggcacattgctagcagtagcactcctttaaaaataaggttgtggtggttgtgaatccaccactcaccaactctgcactgcaatttttatgaattgctgccttcatttccttacattacaatacctcaatatcccatatgttgtttgttcttatttggccttctaaaaattagaagttgacatgaaaatgtccaagatggaccaatgtatatgtggcatgtgcgaatacagtcaaacattactaaaacgaaaaggaaattaagtacatggccatacagataacgcttaacataaaacaatattaggacctgtatggttcaaaacttttttctttagtttattcacaggcagatatttaaacatataaatgattaatgcatcaaaggcactctaaagacatgttgcagctgaatgcaaatggcatataaaagattgcagaactagtcaaagatggaaagataatggtgtaaactactgagatagatggtatgagaggagaatcttgaacctttttaaacacggcatctctgatgcggtctaaaattgcagggactgaaatcataagagtaggcttcagtgcagaaacatctccttttgtccccttctttattttatttgatgtatctgtcatagtcagagctgagccatatccaatggcagcaccagaagctaacatgacagtctggccaaacaaaacaacaatatgtcatagaaatattcacagttcttaataatggcatctctctcaattgcaaaagatgtcacctctgctgctagttcaaagacatgagccagcggaaggtatgccagataaacatcccctgtgccaagttttggtatgattgtcatgacagctgcagttgtggccaccatatttccatgtgtaatcattacaccctatgtcaaaggaaaccataaaactggattaaaagaggacacaagaactgcaaactcaaaagtggttgacattgtgataaatgaaagtacatagctgtggatccacaatggattgtaattcaagtttgcacaaaaaaatatgcattatgctgatcattttgtcaaaaagacgaacgttgtcacactcatgaacagttaattcatatattttatctatacctgtttttcctaatccgaggaattttgagttgtttgtgcaaaatgatgttctcgttatgaatttcaaatttgagcctttttcgcgtatcaaaatgcatatggtttctgaatttatttttttttttctctgaatactagagtcaacctagagatccagtggttatagagggtcttaattgtacattggaacagtccatggatctctacatgatggtgaggagtggatgaagcagtgatggatcagtttggttcatcctgttcccatccttgttatccttccacaataagcaaagtgggtaattgcacttgcaaaaataccaaggaaaaaccaactttcctttggggaagagaggaaaagagagtatatatcaggaaagtgaatttaatttgtagaaaggatttaatgtcctgctttatttctcatttgtaaattaaatgggcataactgcatattatcataactctcaatgttgcccttaattatggagagcatcagttcaaaaggaagttatgtgagtacgttgagaataggcccaagagattatcataatatctgtcaagctaatgggctaataggatcgtaattctctatatcatacatcacttaagctcttgttcagtgaaagtaacaggatggtaggctcatcatgtgtgtacaccttcagatgaagcaaaaagaaaaggaggaacaagaaagaatgacccctgcttttgtccttatttattttcatgaataaaaatagataacagcatatgacagaaaaaatcagaatatctttgagcacaagtgtaccttgggaagacccgtacttccacttgtatacataataactgcagtatcagtgcttgaaggtaatcttgcatctgtatgtgatgttttacccaattcttcaacttcaccaaaagaaaatgttgtccagtgcttcatttgattgagtacctcagcctcaacaggttcatcctcaatatagataacatgcttaacactctgcaacttggaactgattgcaggtagcttcttaagttgctttgaatcacatatcagagttgaaacctgtgtctgaaatttataacacacaaaaaaaatgagtttcccatctactaatggttgctgtcatttaactcttctaaagtgtaaccatctactaacggcaattcagcatggacatgtgtcaaaattcaagaagttgaactctgcctttataactctcttaccaaaacaggtggatgcttgtagagttaaagattttcgctccataagcctcattcacagttttgcgatgttggtttcaaagatcttggcaaaccgtcttgctccgctgcttcctagtatggtttctattaatcaaagtgcttttatcaaagggagaagtatccatgataatttcttccttgtgcagcaaatggccaagtgtttgcatgcaagaaaagaatcacatgttctgttgaagctggatatatctaaggcttttgactcagtttcttggccttctcttttggaggttctacaacagttggattttggtcgtttttggtgcaacctactttgtttgctgctgtctacctcttctactcgggttctaatcaatggggagcctgaggaggtgattctgcaccgccgcggccttcggcaaggtgatccattgtccccgatgctttttattctagtcatggatgttctcagctcactagttgattgggtggcccaagaaggatggttgcaacctcttgcttttcggcaaacgcagcagcgatgctccttttttgctgataatgtggtcttgttctctaggccaacagctgacgatctctcagttatcacacaggttcttgatatttttggtcatgcttcaggacttgtgactaacatgcagaaaagctcgataactcccattaggtgcaatgaggatgagttgaaagtgatttctaacatgctgccatgtgaggtcaaggattttccttgttcatatttgggcttgccgctgaacattaagaagccttctaaagccaagttgcaagctcctgttgataaggtagcagattacctcccaatgtggaaggcctccctcatgaacaaggccggtcgactcatcttggtgcgggtggtcctctccgcctgagttgggcactacgtatccgttggttatggctccagaagacagatagtgaccgtgcgtggcaaggcctacccatccaggttcctcgcatgtctcataatctcttcagtgtggctgttgaatcacgagttgggaatgggcagtctactttgttttggactgataggtggttactaggaaggaatatcttaaaaatggcccctaatctgtgtatgttggtcgctaagagggtggttaaacgttgtacagtggctcacgctctcaataacgggaaatggatcacggacataaaagggcccttgactgtgcaagtgattaatgagtatctccagatatgggactcagtttttggtatagggctgcaagaaggcgtcccggatcagcatgtttggaaactaacagactcagggtcctacacttccaagtctgcctacagggccttctttgttgggactgtccgttttgctccttggaaaaggatttggaatagttgggctcctcttaagtgtaagttttttgtgtggttggccatttacaacagatgttggacggcggatcgacttgcaaagcgaggcttgcctcaccgggacgcttgtccgctttatgatcaggccgacgagacgatacagcacatcttggtttcctgtgtgttcagtcgacaagtttggtccttggtcctgcaaaggcttggtttctcctccacacttccgaatcaggatacacgtaagttttcgagttggtggtcaaggacagtgaaaggcttacagaagaatgagaagaaggggctcaattcgctagtcatcttagccatctgggaaatttggaaacatataaatgattgtgttttcaatagagctacgcatagtgtgcctgtggcaatccaagccatagctaatgagggtgcactttggtgttttgtgggagcatcaaaactccaagagctatttgcgaaagcaatagctcctgtaccataggaggtcgaagcgcgtgcttgatgttttgtgtgtttttgtgaggtgttattgttttgtataaccttggtaggtgggtgctgaggtttgctaaatccttcaccgcttgcctctttattcttgcttaatgaaatgatacgcagatcccatgcgtattcggaaaaaaaaaatcttctcatagagttttttaagccttgggaaacaatttgcatggttattgcttgaatgttcatactggtaaagatttctctcaagaacaaccaactaatgaagatagtttaggcaagacaggtaataaactgattaaacaatgtaaaccaaacagacaaaaatagtatcatatcaacaacatgaactaccatacaagcttcggtattacatttcatccaccaaacagttcgcccaaaatcttaaaagttgctgacatataaggatgacccatacttcaataaaatgtgtaaaattacccatatataaagaaaaaaaagaaacggtaggaatgtactagtttcccaagtggataattataagaatgaacataaatactgcacaaaaaagccacatatgggttgtacctcattcagtgaatgcaccagtgcatcctcgccaagagatgcatagatagttacaactgttagattttgtcgaaagcatccctgacaaaataaaacaattattgtcatacaggttcataggttctcacaaatgtatacagaaagccacactatttattataatcacctgagcagcaatgatccactcagttcttgtatcagcaaatattgcagcacgactatctcgttggtgacccaacttgatgagaccagaagaaaaattacatgcacgactaaatgcttctgcgtaggtatcccattcatattcacctaaatgcaatttctcgaacttcctgccatcaggtgactccacaaattctctattgattagcttccttgtgccaagacacctgtgtcgagggtattttttgctagccatctcaaataaagctgccattgtggtggcaccctcccatggaacttcaactaacatggaaaatctactgtttcgcatggcaagtcctgcctcaccacccacatcagcttgtactgctcttttctttccctttttgttgaatatggaagaaagcatgataggaataactacagcaagtagaatggcaccaataattccaggcagaccatactctttcaccagtggaacatcacttgtggcaattctttgaagaattgacatgtttggattatcgccagtattttctcccatgattttaagatttcatcaactgaaagatttcacaaatttcgctacaagaaagtataaagtgttaataaccgtcatgttagtatgttgcaaataagtaataactaatttcttctcaattttataaataattgccttgaacagaagaaatgagtataactagattagtgcagcatggagaatgctttcgcactacagtagcattctatttaacattatgaatcatggaaaaatgaaaaatactagcaatgaacaatatttagaagcactggtactcttcttccaactaacaaaattaaaaatgatcgtatggtataaacagattcagcagctattagacagccttgttatgcagagcaaaaaactgtaaagtgcagtaaaacagtaaatacttggtagttttaatctctttgagtaaataacatatccgcatctccagtgaatgttaaatggtattgctcagagcaccgcacaaattattttatgatgacaacaaaattcccaaaggtcaacttaagttgctaaaaagtacaataatgaaattgcttgtgaatcctgcagttgcctacttctacagtgagaacgactcaacattacaagctgactcgtggaagcaacagcactatcacaacaggttagcagtcaagatgatatgtaagattcagcacgaagcaacgaagttgacagaaatattttgtaagtggagtaagtagattagcaggaatcttatgacaagttgaagacttgtagagaagataattcaataaaatatagcatccatctctggtttgctcaaagggccaatatcttatggcaaggtccttcgaagttgcaagcaattacaaagggacacggatttacatttgaagaaaaaaaaaagataacatgatctcacctaagaaacaaggagtaaagtaaacaaccactttgtgcaaattagcagcggtaggagaggaataattgaggcttgaggaagaaccattgaatagggacattaattaaacggttaaagttataattattccttactctgtacagcagcatagtctgtgcgtgggatcaaaggaaatcaggggcggatcaaacttgggacatgggggctcaaacttttgggggagcaaacaaattaagaaagatctagaatagaagctagggttaacgcgagcaaattccaggcaaaagtactcccggtgggagagagagatgaatcagaaagaggatgtggatgctcaccccgatcccctcccctcccctcccctgctctgctcgccagatggagatcggcgcacctcccctccgttgctctgctcgccagatggagatcggcgtccggcgtcccctcccctgttcacccgcgactcgtcttggcgcaaggagcggagacgacgagacgagagatttctgtttcttttacgccaagggaaggaagtggaagatgctcgagtgctccaccttttgtataaaaagctttcaggccgcgttcggcagttagctttcccatcttataatacgcatttcaaattgctagatggggttgtttttataattttatataaaaatattgttttaaaaaataatattaatatatttcttgagttagttttttaatacttaattaatcatacgctaatgagctgctccgtttttccaaagagaaaggtttccaactcagggcaccgaacgcaggctgcgaacatggaaaacggtattgcccatgagtgtttgattaattaagtattagcttaaaatatttaaataatagattaatatgatttttctaaagcaacttttctataaaaattttttttcaaaaaaacacatnncgtttagcagtttcagggagcaccacgntngtgaaaaacgagaggtanaagttggaaaangaacacnagcctgttgggcacccacccttgctagcatttggtgcggataagtccactttgactccctcaactatagctctactatgattcatatccctgaatcgtaataccaggtatctcaccccccctcaactataaaaactggtgcaatttaacttcctcgttttagtgggtgttttcgctgacgttgcactttgacttgttccaatccgctgagtcacctagtgggacccgtatgtcagtgccacatactctcttctcttccttccctttccctcctcactttcctctctcatggaaataacaacatacgatggtgattaggggaggtcatcgttgtgtcgccaacccctctttccccttcctctcgtctccgtcggggaggacgaagcacgagcgagaatgacagcggcagtgagaggggaggctgtcgtcgtgccgccgtctctcccgtcaccatctccgcctcccctctgctgccctttccactcgccgtcgtcgaggagcggaaagcacgagcgaggatgacaacgatggtgagaggggaggtcatcattgcatcgttgtccctcctgccaccgcctccgctgctccctttcgttcaccgccatcggggaggaggaagcacgagcgaggatggtggcggtggtgagaggggaggtcatcatcacgtcgccgtccctcccacccataaccttgcatggggaaagccgccgcacttactctgccaacaacgcgtcatcatcgctctgacggccaccacgctctgtctcatctagccgattccgctgagggaagagaagaccggagtggcacgacacgccgtcgtcacctcgatggccaccccggtatgtctcgtcctacaccgctcatcccttccgccaccgcctcttcctcacctttgttgtcgccaacatgtctgatttcgccgagagaagagaagactggagtggtgtggcgcctctgccctgccttcctgccagcaatgatgagagggaaaagataaacgtcattgataggtgggtcccacaaggtgacatagcaggttagaccaaatcaaagtgccacatcagcaaaacagtccttcaaaaccgtctgagggagttaatagtcgagatatccgatattgcagttcatggatatgaattagatttaaccactaaggagtcaaagtggacttattcccattggtgctcgactcactaaggcctgcgtgactgcacaattaagaatgtagcccagttactcctcccccactgctccatccatttcaaattacttaggtcccgttcgtgtccactagaaatagttgataaaattttgaatatttgtggcacgcttttcaaacggctaaacggtatgtttcgtgcggaaactttttctatatgaaagttgctctaaatatcaaattaatctatttttcaagtttgtaataattaaaactcaattaatcatacgttaatatcaccttgttttacgtaaaacacttaatcttaatcttaatcttaatctttatctttaggaaaaaagaattattctaatcaaacattttaatctttaaccgttaatttctatatataaaaattttaacatcataagaattacacttttgacactatgagaaatatttttataattaacaattcatatgtggttaaactgaacataattctaaaaactaatgttaaacatagggatgtttcacttaggacaaagcctataactttaagtaatttgaaattgggaaagtagttattagtagtatcaatagtaaaccaacatgcatattagcgatcaccagacccgttccttttacacccgcaacagtagaggcgtgagaagatataaaacacatgtgtccttccttttacaaaaacatagacaatgtacttcctccgtcccaatatataacaacttaggatgggattagaccaatcctagaactacggatctcactactacaaaagtgatttttctgtacgagagcccatgaattttgcaaacggaccattactagtggcgtctgcaaaaatcgagggtcattgtcccatacggctccttaagtggcccgtatggaaaaatcgattttcccctacgggcctcttaagatggccgtatgcaaaaatgagtttatttttgcatgtggctgtttgacgaccaaatttggtaaattatgaaccacgttcgacattgagatcgaggcggattcaacaaagaggttgattcgaagaacagagtatgcatcggctagaatctgcattggctgagatggatcggacagaggacagccgatacagccgatagaggtgatgcagccgatttcgatgatgacagtttcgaagatgtttctagaatcaatcaaggtgcttcatgaagattgctgtgatggagatagggctcttggataggcaattgtatctattaattaggatattttatgtaatttctttagagatatgtttgggcaaaagtctgctgcaaagacttatggtatcttaaagtttattagaggtaaatgtcgtgtccggcaaggacatatcttgtatctcgggtataaatagaacccgaacccatgtaatcaattaacaattgttcaatataatctcggcgcattgccattgtcagggttacgggttaggtataccctttacccttcgatatacgtcgcatatcggtatggcatacccacgcgcatacagataccctccgcatgcattaaggaaatccttcacggagtttacggatggaaagagtcctactcgaaccagactgggtcgtcaacgtatcgtgtgaggtttgatgtctctgagttctacttggaaaccgcctgacctgcgatataaaagggaccccccggggaggacctaaggcatcgaatctcagagccaacacaacccccacagcctacgaagtcggagcctgcaggagccaaatcgctggggatctagtcgaaccaacttgactacgatctcgccagatccatcgagttccattgttccctttgtaacctgtgttttccatcatataatcccacatcaactggattagggctattacctatcaaggggcctgaaccagtataatcttcgtcttttgtctgcttgatgtcgtactacatagacccttgtaccaacgtaccccaataccttctatatccggtctacgggtatcacccgtcgacagtggcgcgccaggcaggaggacttggtgctcaaggttctactactatgtcatccagcttcgtcgacaacagcgtcaacaccaactcaaccaagtatttcctgcttcaacaatgctggtgtggactcaagtcggcgaaatcgtcttcccggtttacaccacgatgccgatctcagccggtccatcaatgaccagaaacgagaacgcagtggctacaaaccaagacgactccatgtcaaaagatcctcccgccgaggcggagaacggaacctcgacgacatccgagctcgagaaggattctaatgcggccaaaccttgtcattccgacaagaaccacgagccgacgaggatgacttctgaagcgacaaggtcctggtgtcctatccacaaaaccaggaaacacactttgcaagcctgctgggtttttctcaacgtccgcgctgaaattcgcgcctgcaaagagcgtggaattcagcgtatttctccaactcgtgatgtctattgtcctattcacaagacaaagaatcatgacctctcaagctgcaaggtctttctcagcgccatgaaggcgccatctcctaaggtccaacagtcacacgtccccatcagggataaagacaaggaacgaggagcgacgccaacttcagatcaatttgttggggtaatcgacatcgatccccacgaaccgtcagtcttgcacctcctcgaagactatggatcatcgacaacgagcgcgccgcgggaggtattggctatcgatgatgtcggcacgtcagcgcgcaccaatgcagaagcagagaatcaaatcgccactccggcccagcacatcagagccgtcaacgctatactgagggaaaccccctacgatcccgttctgaacgacgatctcacgcattggacagaacgactatgggaataagtgaccaaccatagtaacgcgttcgaagaggccgctgccgcagcgcacccggagcagccaccaactagcgatgccaatggtgaaaaccctgaacagagggaatcgcctcatcgagccacccctccacctcgcggcactggcgatctccgagatcacctcaacggccgccgagaggcacgacgcacacgagacaacgagaaccgttcccggcgtcatgtctcttcacggcgccatgataacgaagatcgaggagaccgttcaaacgaagaccaagaccgtgataaccgccacgatcacaacgatcgcgaacggcgggtgccaagcgatactggtcgaggacgttgccataatgacgacgatgatggagaccggcgccgagacaacagcgggagacgacgacaggattctcgagagccaggccaacatcctcgtaatcatacgccggaaccaagcgacccatcgtcatcgtcatcatcctcgtcttcctcatcatcagatagacatccacgaaggacacacgatcgccgacaacccagcgctgggtgtagagctttcagtcgttccctgcgtgatgtccgatggcctgagagattccgacccggagcaatagaaaagtacgatgggagcaccgacccagaagagttccttcaagtctactccacagtactctacgctgccggagcagacgacaacgcattggcgaattatttgccaactgcgttaaaaggctctgcacgttcatggctgatgcatctcctgccttactcaatctcttcggggccagacctgtggcagcagttcgtcgccaacttccaaggaacctacaagcgccacgcgatcgaagacgacctacacgcgttaacacagaactcgggtgaatccttgagggaatatgttcggcgcttcaacgagtgcagaaatacaatccccgaaatcactgatgcttctgtaattcgcgccttcaagtccggtgtcagagatcgctatactacccaggagttggcaacaagaagcatcacaactactcggagattgttcgagattgttgagcgatgcgcccacgcagatgatgcgctaagacgcaagaatgataagccgaagaccgggggagagaagaaaccagccacggacgcacctgagtcaagcaagaagaaaaatcgcaaaaatgggaaaaggaaagctcaagcggaagtcctcgcaatagaatacgcgaaccctcccaaacgcccagacccacaaagtagcgacacaaagaaagcatggtgcctcatacacaagacggacagacattctttggaagattgccttgttttgaaaaaatcgctcgagaaacacattgcatttgaaaaaggcaagcgagtacgcgtggtcgaaaaggatgtggaggcggctccccaagaatcggattcagcatatccagtctctgacctccacgtttcacacatcttcagaggttccacaacgtactcctcaaagcgagaatacaagaaagtggaacgcgaaatctgttcgacatggcagggggctgcacccaagatgaagtggtctgaacagaagatagaattctcggaagaagaccaccccaagaccgccgtcatcccaggacgatatccgatcgtggtcgaaccctctattcggaacatcaaggtcgcacgggttctcatcgatggtggcagctcaatcaaccttcttttcgccagcactttggacgcaatgggaattccgcaaagcgagttgacaccaaccgatcaaccctttcatggaattactccccaatcctcgtccaggccattggacaagattacgttgcctgtgactttcggccaagctaacaacttccgaacagagcatatcacctttgatgtcgttgaattcgatatagcttacaacgccatcaacgggagaactgcacttgcgaagtttatggctgcatctcactacgcgtatcaagtgctcaagatgctgggaccgaagggaacaattactattcaagggaacgcaaagctggcgatgcaatgcgacaaacggagtttcgacatggtcgagcaaacacccagcccacctgccacgactgagccacccaagaaagtgagcaagacaaacaagaagccgaaaccggacggcgcaatcaagatcgttccactctccagtgccaaccccgacaagaccgtcaagatcggggcgacactaagcgagaaataggaactcgcgctcatcaccttcctccgtgacaatgctgacgtgttcgcttggcagccgtccgacatgccgggggtccccagggaggtgattgagcacaaactcatggtgcgacccgatgccaagccagtaaagcaaagactgcggagatttgcaccagaccgaaaataagtcatacgagaagagcttgacaaacttctcaaagctggcttcatcagagaagtacttcatccagagtggctagccaatccagtcatggtgcggaaggccaacggaaaatggagaatgtgcgtcgacttcaccgacctcaacaacgcgtgtcccaagaatcacttccctcttcctcgaatagatcaactggtggactcaacagccggctgtgagctgttgagctttctcgacgcttactctggctaccaccaaatcagcatggcaaaagaggacgaagagaagacagcattcatcacgccgttcggggtattttgctatgttaagatgccgtcggactgataaccgcagggaatactttccagcgtacggtccagggcgcacttagcgaccagctcggcaacaatgtcgaggcatacgtcgacgacatcgttgtcaggacaaagacaggcgactcattgattgacgatctgcgggaaaccttcgacaacctccgacgatatcgcctcatgctcaatccagagaagtgcacgttcggagtaccgtcgggcaagctgttcggtttccttgtctctagcagaggaatagaagcaaatcccgagaagatcaaggcaatcgagaacatgaagtcgcccacaagactcaaggaagtacaaaagctaaccggatgcatggcaacactgagcaggttcgtcgctaggatgggagaacgagggcaacctttcttcgctctgctgaagaaacaagacaaatttgtatggacacaggaagccgaagaggcattcgttgcactcaagcgctacctatcaaacccccctgtacttgttgctccccaacctaatgaagaattattcctctatattgccgccacgccatattccattagcaccgtcattgttgtcgagagagagaaagtacaacgaccagtctattacgtcagcgaagctctccacgacgcaaagacaagatatccacagatccaaaagctgctttacgcggtcatcatgacatcaaggaagctacgccactactttcaagcccacagagtcacagttgtctcctctttccccctcggtgaagttgtgagaaacaaagacgttgttggccgcattgcaaaatgggtagtcgagctgagccagtttgatgtccactttgtgccacgaacagccatcatgtcccaggtactcgccgacttcgtagccgattggactatgcctgataacaaatcagacaaccaagtcgacaacgaaacatggacaatggcgttcgatggtgcactcaacagccaaggagcaggggcaggatttatcttgacgtctccttccagagatcaattcaagcacgcaatccatctcaacttcagggcgaccaataacacagctgaatacgagggattactcgccgggataagagccacagccgcacttggggtcaagcgactaatcgtgaaaggggactccgagctagtcgcgaaccaggtgcacaaagattataaatgctctaaccccgagttatccaagtatatcgcagaagtcaggaagctagagaaaaggttcgatgggatcgaggtccgacacgtctaccgcaaggacaacatcgagccaaatgacctagcacgacgcgcgtccagacaagaaccgctcgagcccggcacttttctggacatcctgacgaagccattagtaaaagaggttagcggcgaagttagcccggccgcccccgacattagctcggaggccacaaaggcagaacgcgccgttgccgatattgagaccacagatgactggcgcatcccactaatcaaattcatcaacagcgaggatttgcccaaggacgatacagaggccgagaaaataacccgtaaagcaaaaatctactgtatggtcggcagcgatctatacaagaaagcgccaaacggggtacttctcaaatgcgtctcgtccgacgacggcagacacctcctccttgatatacatgaaggcatctgtgggtcacacgccgccggtcggacattggtcgggaaagcttttcgacaagggtttttctggccaaccgccctcaaagacgcatgcgacatggtccagtgatgtgaagcctatcaattccacagtaaacacacaaagctacctgcgcaagcgctccagactatccctcttacttggccgttctcgtgctggggctagatatactcgagccattcccatgaggacagggcggctacaggttcctattcgtggcgatcgacaaattcactaagtggatcgaagcagtacctacgggggaaatcaaggccaacaacgccatcaaattcatcaaggagatattttgcagatacgtactaccgcaccgcatcataaccgacaacggctcccagttcatcagcgccgatttccaggattactgcatcgggctgggagtcaagatatgcttcgcctcggtctctcaccctcaaagcaacggacaagtcgagaaggcaaacggcatagtactacaagggatcaaaacccgcatctacgacaggctcatgtcacatgacaaaaaatgggccgtacacaccacaccgacaacgtctaacaaggaaacacccttcttcctcgtgtacagctccggggccatgctcccagcaagctacgacatcagagtacacgagtacagaagcattccgacgaggaccaggaggagcagcgaaacgtcgacgtgaatctactcaaggaacatcgcgaacgagttgtcgtccgagcaggcagctatcaacaggccctccgccattaccacgagaagcgcatccgagcacgcatactttcgatcggtgactacgtcctccgacgggttcaaagccaagcagggcgaaacaagctctcacccaaatgggaaggaccttacacgatcacacaagtcttgcggccaggcgcattcaaaattgcaaatggtgatggtcgcgagttggcaaattcttggaacattgaccaactacgtaaattctatgtatgagtcaatatcatccataccagtaagacaccttacagtatcaataaagcctattcttaggcccatattataatcaaagtgttcctgcccgatgatcccttatcctgatgacacctagcgttgaaacctatcctcatgtccctttacgccgtcttgacaaggcctccgaggaacctaagggatcttcggctagggacgcctagagccgataaagacgaaagaccatgtaagatctggtcgtgtaagagttctcgtcgtgcgtattaaccaagccgcgaaatcggaaattaactttccaacttcacggctgggggcttaggactgagcttattcaaccaaggcaagtcaaagtccaagagccttatcctccgagaaaattcctccgacgacaaggctaggggctagggagagtgtacgactcaaacgacggactaaagtcgtgaactgagaacacactcttacacacgacatccggagtaagaaagatttgttaagatagatttcttttctatttcacaaaatactccttacaattttttacacaagtctaaaactatattacacttcttcctaagatatctatcacagggtacgaagactaccaagaaggccaacgccagtccatagactggaagaccttctccgccaacggcgccatcgacttcgccaggtggtctatctccgtctgagtcctccgagaacgagaaaaaccttcacggagaaaatcgaggtccaggcgcgggcgatgatctcgtaggcaagccaacacgtgccctccagcatattagctcgatcgacgacactcctgcttcaaggcctcgtcgatgcgtttgccgacgccatcgaactgagcacaggccccgttcagccacgagatgtatccggccgccgactccttgggatccccacggggtactcggagctctctacaaaccttggccatggatgtgcagcaactcttcaagtacgagttgaaccacacctcacgacctcggagcgtttccacagcctgctctttcttcactgcaagcatggttctctcgagttccactacttcaaactttgtcttccaatattggatacgacgatcttgaccagcaagagcaatctcgagatctgttcaatgtgggaacaactaagtcaagctgtactcctctttcgagaacatagctgatctagtcggaggagcaaaaagggatgaatggaccactaacctaaggaagtcgtcgccatccccgtccccgtagctaggatctggtctacattgtctggcgacgcatgtggttcaaacgcgagagccagaatgatcgccggtgactcaggttgcccacgctgctggacattctcgtcatcaacatctctacaagggacaaaaagtactcaaaatcaacatgcaagagtaagctaggataataactgcacgcacaaaggcggttgagatccatcaaagttttacacaacatgtctaaggagtacaagagatcctactcttcaaaaagagggagaacagattcccccagatcgccgacttcttccagcacccccttacgcgtgtcgctagccgccccctgatccaagatctcgcgcagatcgagttcaggatgcgccagcctcacacatgcaaggacgtggcacgccccggtgtagatcccgttggacgtctcctccccgatcctagccgcatgcttggaggggatctcctccatcgccgccgccagctccgcaaaagaagatgtcagcgagaactcatcgggattcgccgggatggtggaattaatgccgcactccccggcgagctggtgcagaccagtataggtgacccgcaacgagccacggatttccgacagattgttcccgagcttcgacatgcggtgctcgagcccctgtcgttgtcgctcgttgccggccaccaactccctcatcttcttgaggtcttcacgagcctccgccaactcgtgtgccagccggtcagcgcgctcggtcgccgatgccgccgccaaccttgcctcagcaatcttgcaaccaatgccgcgagcaccagcttcgaggagacgccccatctcgacctggagctcctcccaggtgaggacagcagccgatggaccacgaccagccgcgagatcgctggctgggccacttggtgtcgcctcgcggctcccggggcaagcacgacatccgtcgaggtcacagcgggagatgcgccgaaagtccctccggactcatcttgcaccgccttcgcccgcgccgccctatgagatagccatggttcagacaacgctcgaacaaaagcacgaacacttagattcatccacttacttctcgccatgtgtcacaagttgttgtcgtcgtggaggcgggggagacgcgtccgaggcctggagaacggttgatgcgaagtaaggcgaaattgttctggctgtaagatcagacaacaggatagcttactgagggggtagatgccttgcgacgatgtccgcttacagaggagaacttcctcccctttgtcggaacattgccaccacttgtagtagcagcagtagcagcagcagcatcggatgcctccttggcgactttctctttcaatgacgccgccacctgatggtccacgagcggcccgacgatgtcagtcagaggaagagcctacgcttcataaagtcacaaagtgatctcagaagaaaaacgcagaatgtctattgagtacacttacattgatggcagcgtcgtgttcggccgcccccttctcacaaaggggaacggggatgttactcgccgttgtcgggccactgatcatcacctggccgacacgacgtcccacggtttcattgttcagacctgtaaatcgagaaccaaatttcgataaatcaggaggaacgtgcacacgagcatgtcaagataaatgcaagaaagataccccgaggagaaacccgggtcgcgtcctccggtccggaatagtcaaaggctagatggactcgagcctggagcggctggatccgtctaccaacgaagtcagcagcgatttcatacctcgacaaacctcgtactcggagatcgtcgacaatatcgatgaacgattgaagagaaggggtcaaagggggctttgcggtccaagacaaaatcttgtccggttgttccttaggaacgatgaagacaggatccaaatcttcgatctgaagatagaaccacctcgtctaccatttgctgcaagaggaagggcactggaaggggatataacgcgacttcaggccatcccgaagtcggaacccgacgcatccagataccctgttggactccatccaacgcagctcatagtagaagcgaaagagatcaagaaagggctctaccccaatgtaggcctcacaaagatgtgaaaaaatactaaggaaggcgatagaattggggttcagatagagcaaagaaagaccatagaagttcaaaaccaagagaagaaattcggaaggcggagggagaaaaccgcagagaatgtagtcctcgatcgcaaccatgcgacctaagacgggctggggttcagtacctcctgcttccctttccatggttccacgactgggaagggcgccgtcctcctgaagcttctttagcgacgcgttggtggaggatgatttgccaagatccatcgccgatcggagatcgccggagaaagggctaaggtcgacgagctagggtttcttgtgggagcggagaagacgaagaacgcttgcaggcgggatgttttcttcacagtaggcggacttcaaaatggatccccaaaattcctttaaatagacgcactactgacggtgcgaattccaaggaaaggagagagatggccgccggaaatttctgggtccgttacgcgtggtagtttcttggacttcagtttaaattcactcgtgaccgttgggcttcacatggtgttctcgactacgtcctatctctacggtcctcacaccgggaacaacaacaatctcgacacaagaagtcgcaaatggttacacgagttcatttaagcagaagtcgggggctactatcagggttacgagttaggtataccctttaccctttgatatacgtcgcatatcggtatggcatacccacgcgcatacggataccctccgcatgcattaaggaaatccttcacggaatttacggatggaaagagtcctactcggaccagactgggtcgtcaacgtatcatgtgaggtttgatgtctccgagttctacttggaaaccgcctgacctgcgatataaaagggaccccccaaggaggacctaaggcatcgaatctcagagccaacacaacccccacagcctacaaagtcggagcctgcaggagccaaatcgccggggatttagtcgaaccaactcgactacgatctcgccagatccatcgagttccattgttccctttgtaacctgtgttttccatcatataatcccacatcaactggattagggctattacctatcaaggggcctgaaccagtataatcttcgtcttttgtctgcttgatgtcgtactacgtagacccttgtaccaacgtaccccaataccctctatatccggtctacgggtatcacccgtcgacagccacccttttactttcgtttatttctacgagttcttgctttcgggttgagctgcatcgattcgatcttcaactagaagtaaaacttgttatggcggcttgcgttatcgaggttaatgcttccatctctatgatactttaaccctgtttatgtaatccatcgagttatcatatacatgttgcaatctatgctagtggcgctatataacttgttatcggctggttcttatcgttaggaaacaatcggtagagttatgttttattattaatttagattgtatcatatatctaccatctcttgtagattttcatcatcctgcttagatctcatacttgtctttatgtttaatgctgcatcggttgagttcgatctattaagtagaattcataattgtgatatctagcttgttttatgatcatcgagagagatagtatcggggtttcagccgatcttacctgacttagctttatgttttatatgcttaactaatatgctaagtctgccctttatattaagattttatcgcaataaagtatatcagacttctgtttgatatattctatctgttttaatatcttaacgtagagtagtatcggagtactagccgatacatgctagatctatctgatcggctatgctataagcgtttataatcttcatgttaatgtgtattttgatctaagtgatttatactatctcggcatggcgaccgatctatcccaatcacttgatttaaatatacatcgacagaaagattatgtagcgttaatatctatagccgattgagtagatttagtcttactttgcttatttacaattgccgattgattcacatgtgacacatcggctcgagaataaataatatgtcggcggcggctggccaatcagctatcatttatggattcaaccacggtttttcttgtctctctttctggttgattgcaggatcaaatcaactggcacgctcacgatcctaaaggcaagattttggacctgcactgaagttaagcaaatcttctaggccaatgtatgtttttcgcatcaacagcggctcacttaagcgcccgtaggccacttaaggagccgtatgcgaaaaaaaatttgaaaaaattgaaactagtttatctcactcatatgaaatccaaattagatggttttttttcctaaatgtttctaaaatcatgctctatcatgttattgtgttcttacttctattatttgggtcatttttcttgtgactttatttaattatcaattaaaaatttgaatttcaaaacttcaaataatattttgaagcagtaaatgatttatgatgaaaaagtcatcaacaacaaagttgtctccctcatcaacatctatataacttctatcttggtcattttttcatccgacaaagtgatggtaacattttcacaaaatttatatatatatctctctatagtttataaaactatataagatatgtacattttgtgaacaatgttacaaataactttgtcgaatgaagaaatgaccaaaatagaagttatatatcttgatgagttatacaactttgttgttgatgactttttcagtttaaatcatttagtatttgaaattgttatattttgaaaaatcaaattcaaattgttcaaataaagtcatatagaacaatgaccaaaacaaaaagttgtagatcttgatgagttatacaactttgtttttaacacctttttcatatgagttcatctagtgctataaaaatcgatttgaaatttaaaaagccacgtataaaaaatcaatttttacatgcggacgcttaagtagcccgtatgaaaaaatggtccctcttccgcagttcaaaaaatttcacacttaaccctatcttatcctctcctctcactttatcctctttgctccatgtttccaacccctctccctcgtattccgtgggcacgcttttcaaactgctaaacggtgcattttttgtaaaaaaaaattcaaattaatccatttttggaaaaaaaattgttaatacttaattaatcacacgctaatggaccgctccgtttttcgtgcggaggagatgggttccaaaccagggcatgcgaacacagcctcagtcttctctctcactctatctcttctctctctcagaccgagagtggcgcagggcgtggcggcggcactggccaagtgcagagggagcggccgcgggctctggtgccaagggcggcggaggcatggatccggcggtggcggcgcaacctcgcgtcgatccggcgtcggcggcccgtctcggcgtggatccgatggcggcgcgacgacggcgtcgatctggcgtcggcggcccgtccccgcgcggatccgccgcctctacctccctctgttgtcgccgtcgatttccccgccctcctctgcggcgcgacgacggcttcgatccgccggcggcggcgcgacctcgtgtcgatccggcgtctgcggcccgtccctgcgcggatccggcgctgacgacgatggacgacggtgggagcggcggattggccgacgacggcgacgaatccggcggcgcggaggccggctggattgggcagcagtgggctagggttcagcttttttctttttttttatttcgctgaattcattttcgcatgcggctagtataggggaccgcatgcaaaaattggatttttacatgcggttgctctagccgtatgcaaagatgacgatctttgcaggcctagccgtatgcgaaaatcgttgccatccgtatgcaaagacgtattctgtagtagtgtctggacatagatttgtacagattaaaacacacagttgtacatattaattacatccagttagactgaaggacctttcaagaagccatataagtttgtacagattaaaacacacagttgtacatgtacggatgtacccctctcgatcaaaccggggttattaggtaacagcttattgctagattaattacggatcaccgcccatacatggaacatgctagatatgaaggtgacacgcacaacacaatatactatgattattccattgcagatttgatcatgtcactgtaattggatgttaggttgagcaagatctcaggattaggacagtttagcacttttgtgcctttcgtcgtaatgtcgtggttccatgtctctggtgacactatagtaattaacaagtacattcccatgcaatgcaaaaggccaggcaaagataagaactatagctatctagcttggtaaagtgcttacctcgagaaatctcgtgttaggtacttgcatgctaggagttaggcctaggttagttggttttcctacccacccattttttaactggcatatgtgcatcaaaacgtactaaggctgtgtttgttggtggggttaggaaccatctctcacgtacagaaaaccaagcggtccattagcacgtgattaattaagtattacttttttaaaaaaaaataaatcaatatgattttttaagcaacttatgtattgaaactttttaaaaaaacataccgtttagtaatttgaaaagcgtacgcgcgaaaaacgagagggggagttgggaataggctatagatatttatatataaccatcgtacgaataggctatagattgcctataaatgatttgaattagtagttggctatactattaaacttgctctaatggagtagcattaatctctggaagattaattacatgaccaataattaggaagattatgtgattgctacaattaacttcagaatgaggttattcctaacccaatgactagaatgatatccatagcattaaataagctgccatctaagataaaaaaatgatatgacaagtaaataaatgaggaaagagaaggaaaccatgtcttgcatgggatttggtttctacacaacatccaagtcatcatgtgaaataagaaatagtggtatttacattggaagagtagtatatagtactagtttcttgattatgagaagtttatgaaaattatatatagtgttttaggttgggaatggcttgagggaggctgtggtgttgttggtctcggcgtatttttttctcccataataattaaaagagaatggagggatattcgacatagaaatcacaataatggccacctgctgtatagttccacgaaatacggcgaattgtgtattgtacaccactcaaattgaattaactaattaccggaccgcacgggtccagcaacctacagcacggtgcacgtaccattcaatttgcagcacgttcgcgcacacaccgttatctccatgtgatgtgcgacgacgaaccagaggagttgccgtacgtacgtgtcacggcgccacacacccctcgtcctccctgcaacctaaaccgttccacgcacatccgcctcggtcgatgctgcctcctcctgcttgcgttcggccctcgtattccggctcgacgaaccaggaccaatataaaaagctatggcctcaagaaaaagtaaatgtcaattaggataaaaccataatgtgatattctttacctaatatgaagccgagcattgctaatttgctatacgttcgataaaacttcatatgatcagagtacgatatttcgtagcctctggtgtgtgctgcaaatatggggcataacatgtttccacccaatcaaaaatcatggatggtaggatcgtattaaaatcctacaaatatcatcgtacgcaaagcaatttccatatgaagccatagccacattatcttttctttatccatgtcaatcggttacttttgtattaaatcctcactttttttttctattcacacatgcaagtctaataaattaataatccacaccctgaaaatcatatataagaacccatcccttccctttcattctacctttccctcatttctccctgtaactcctctctcatgtcccacggcatcaccacctctcccctctctagtggcgattcttttcccctctctttcatcaacaaggccaccaaggagactagatcggagacagtgagggtggatatcaagacggcagggtgtggattgagggggcaaaggtgtaaatcggggtgccacagcgtggatcagggtggtgacgatggatctgcccaatgtggtggaaggagcggtcgaatagtaggtggcagtgtagatagaggcagcgatggcaggcagagcttcgaggcgacgtcttcccgcaatggagcatctcaccatcgtcctcaatgaaccgtcaggtaggccctttttgacctcatttgtgatggcgacgcgtagaagtttgtttgcagcaacggcacgggccgacggcatggggcgaggccgcttcctaacgcgtttcctcgcatgattctcgcctaccagcagaggcgtggctatgctgaggacacatggacctcctgcatggttcgcacacctctgtagggtgcagtttctttatagttggcgtgaatatttgtctcggatggggtaagacaacatgccagctaggaacgtttggcattgccttaggccatgtacaatgcatggtctccgacttgtggttccatcctccaactaggctaagatgccacagtggaggttcgagagtgtcttcatttgttctagaataacctatagatgtcacagtggtttgaggagaaaagcagtggttttgggagaaaaagaagtggtccaagcccctgatcggaagccatctgagaaagtgcaagagagagtgcacctcgtctcactgttaaggggactcccaccatcgccatcagcgactgcaaagctcgccgactgcgccggagtggggataggagaggtgggggcgtcaccatccaccagatgcgcggcgaacacctgggatcccatcacggtgaccaaggagggaaccttaatccgcgccaataacagtgaccgaaggagaggcggcagggagggagctcgatcgtcgtggcggcggagagggagctcgatcgtcacggaggcggggagggagcttgttgtcctcaacaagcagaggccggatccgacgaccttgcgtctagatccagtggtgaaggggagcttgccatcgtgctcccaccatgtcccttctcccccagtggcagacgatgctgcggttgatgggaaaggtagagatgcggagatggatgacgaaggcgtgggcatcggcggaggcagcaaacatcatcaaaggtgagggcaagaaaaggggataggtgtaggaaggagataagagagagattgtggggagggataaaaaatatatgatgggagaagatgacagtgggaccgtgtaaaggctaagggtacctacgtactctttttgttattagaagatccaaaatacaaatgttgataataaaatatattagaagtactgacacgtaaataagtagggactgaaacacaaatatactttacagtgctttccatagtgagtgttgtgatatttgtgtagttctatcctatatgacttgttgagactgctgataacagtggtcttcgttgtatgaatacataggagtacattacttttaatcttttttagttatacatatgtttttttgaaagatacgaaaatatacgtgtaccgtgatgtggaggcgcgcaaccggttcactggtgctgcgtggacgtgcgggaccgatggtcctgcggcttggccgcatggcaccgcgcggtggcgcggtccggtcgcgcgccaccgggtacacgaaggcagcgcacgcaggcatgcatacatgcatgcacgttagtcacatactcacattagtcggctgcactcggtggggcacggccaggccgcggtgttttcctagccgttggtcccacgcgtccacgctgcgccacataatttcgtaaatcttttaaaaagacatgtataaatgcaaaaaattaaaaatagtgtatatttttttcctttgtcgtacatacccatggggtgggggttatttagttggtgaagatgtagtcgcccgcggccggtgccagggatcaccccgccgcagggcagcactatcatgttttagtggggaaagcgacggtgtcgattgtaatttttgtacccgcatatatatatagaacaactcggcaagattagttcttttagaaataatatttttttaataaataaattgtaaaaatagatgttgattggctaaaatcgtaaatttaataccctgtcgagcaaccgcagtttgacatctatattaaaatctccacgtaaatcatttttttacctcctattagctctcacttagattcaagtatccaaataatagtatggcataactgtgtaaggacaaattaatgacttataactgatgatatgcaaatatgctatattatatattcaaattagttcatttaagattccaaaatatataaaatcaccatttaaaacaatattaaggataatatggatagtattgtaaagtttagggactggatgtccggtttgaaagtcttggatgctagacggatttccattcaaagtttagggagggggtacttggacttttttataaggccccatttagttcccaaaaagtttttcccaaaaacatcacatcgaagttttagatatatacatggaacattaaatatagatgaaaaaaactaattacacagttatgatggaaatcgcgagacgaatcttttgagcataattagtctatgattagtcataagtgctacagtaacacacatgtgctaataacggattaattaggctccaaagattcatcttgcggtttccaggcgagctatgaaattaattttttcattcgtgtccaaaaaccccttctgacttccgatcaaacgtccgctgtgacatcaagaaattttcatttcgcgaactaaacagggcctaaattgtaatcgttaaaatgatcaaaagaaaatttattttcctccaacttagtactcctttcgtcctaaaatataacaacttatagcatttaaaatttaacccaaaatataataacttcttcatccacgttgtattcttaaccaatcacaatcattgaacttcattttttttccacatacctccacttttcaaccaatcacacacctcctatcttattctactcaccttttaataatcgtgtttaatcctaaaacttttatattttaagacagagttagtaacattttgttaaaattatgggacatgcttatattttaaaatggatatttccttgataagaaaaacacttctagagttaaatgtgaatacgacgatttttttttttacggagtaccgacttgtaaaagaatcttggagaagacaaaactttttatctatcataaaaccattgtacccgaagaatcctgtccagtggagcccacccgacgaaatcagatctcctaaaccaacaaaaagaaaagaaaaaggaaaaacaaaattccttgtctctatcaggcttgaccgcgactcccccacgaaccggtggcgcctcctttcctcgccgcctcgtgggccagctcccaggggggcattcccgtcatttcacctcggccggcgtggcgggaattggcgcgaaagctggcctcacccccggagacgacgagacacgtcgggcgtttcccgcccaatccacacaccgcgccggaggtgggccccactacccgacgcccaggatcgcgccacgtggcgcgccgacgcgaccgaggcgcggggcccataaacccggggaaggcgcgagagtgggggagcgggtgcggtgcggaaacgtggcgaggttgccgctttgtcagctgtcgtctcctcgcttcgcttctcctgtttgcgttgtttttcttctcgtcgcagccgatgcgatgcgatgcgagctgtgacactgacacatgcacacaccgctgcctgtggccatgttcacttgatctggctctggctgctgcaagtactcggcttgtggaataataacctcttctgttcttcacgttctgacttttcttcgcacgttcttaaaacacaataattcgagacgtaatactgctagtgattagtaaagaaaacaaaatccacttgttcgaaagaaagctacggaagcgtggaagactgttgctcctcataggagattcatccaggagacgggacaaaagtagtagtaaatccggacatccattttccctcatcagattaaaaatcaccaaccacattaacaaacccccgttgctgtcaccggtcgtgactcgtgagacgaccagggtgtgtaattaacagctaatcacccgcatcagcagccactagtcacacccgattctttcactccaactgcggctgtgagcgctgacatggtctgaccactgcgcaccacgtgagacgagagacaacgccacaccaccatttaattactcctcccccactccactcccaacaaaagcaaaaaaaaaaaagaaagaaaaaataaatatctgccacgcaattacactgttccgtttccacgcgggagacgtgccattcaaggcagctcacgcacaaagcgagcgcccgccttgggccccacgccaccaccatttactactactgctcacttcactagggagtacaaactccgctgggtttttttttactgccacgaaataataataataaaattaatataatactagtagtaataacattgctgctggttgctgctgatgcgccgtctcccgccaacttttcccgccccgagagcgcgaaatgggtggaggggggcagcggcgtcatttcacgctgacggcgttgctcgccgtcagccccgccgtcacgaagtcctccccttcccaccacggcagccagtcgaactccgccgccttggtggaaggcggcggcgccgagaggtcgcccagctcgacgaggaggtgctcgaaggatggcgcggtcacctcgtccgctgccgcgtaccggagcacggaggtcggcgacgcgaacgggttgaacgagctgtcgttggcgcggtcctcctccggtggcgccggcgtcggatcggggacggaggccttggcggcggcggcggtggaagagcttggggtcttgtccggggtggtgtgtcggcgagggtggagcttcatctgcttggccttggcggagggggtgtcggagtcggaggggaagttggtgacggcgtgggagcccttgatgcggagcgcggcgtcgtcgtacacggcggcggcctcctcggcggtgtcgaaggtgccgagccacagccgcttctgcaggctcgggtcgcggatctccgccgagaacctgccccacggccgccgccgcacgccgcggaaccgccggctcgccgccatccccgcgcgccgccgggccagcgccgccgtcgccgtcggaaccagccgcctcgggtgcttcggcgccggcgccggcgaggcggccccgacgtcgatgtcgatgacctcccggacgcgcggcctggagcgctcgtccccggaggagtcggtgtccgtggcgtcggcgtccacgaagtagacgcggacacgcttgggccgaggcatgctagccccaacacggcggctcctgccggcggcgagggagtccgccggagacatcgccggaggacgcatatccaccgcccgctacgaggacgtcaccccaaatctcatccaagaaaacgcacgaaccaacccagcaaacaaactcacccgaattggaggtaaaacccaaacaaacaagacctcaaatttctccttcaaacttcccaaatcaacttcaaaaaaacacaaaagaaaatcccaaagatttctcagatctaagcactcccccagtgagtgaactatcactaccaccactagctcaccgctcactctccaagaaccgggtcaaacaagcaaaggcacccggaaaatcccaaacccccaaaacctcaaaaccagagagatccaagaactcctcaaccgaggcaaaagaaaacacgaaaccctccgtcgatctcaggataatccggggggttttaagaggggttttagctttgaggttaagggcgggaaagggagaggagggggatttgttggctgtgggaggagaaaggggtaagacgaggtggaggatatatttatggcacaggtggataccactaccactgtagtaccactgttcttgatcttatcacgcttggggaaattactgttttgcccacctgctaggtccagctggaccgcgctgagagtgaaaccgagtgcaggggacagtgtgggcttcggttcatgtgttcagtggaagtttacttctttgcccctccctgtctggttcatttattgttttttttttatttcccaaaagaaacgtgtgtggttttgaatttgaagttgcttgaattcaacttgatgatgtattgatgttcataaccatgatccttcatggtgtaataataaaatccacttcaatcaaggtgtacttgttagtactcctgtttaaaagacatgatcacggggaagtttcacatgtgctcgagggattttccgtgtgcttcacctcgttttttgatggcttgttcacatacaatggcttgaaacttttgtgttaggtaagtgactggattggcatgattggtgagtttacaataaaataattaagtgacagttgtttctttttttaaatactatcaatatcgtaggctgaaccggtaaatataattaacgaataggtgaaaaagttatatgtgtacagcaagtcaataatttcacgagtaaaatggccattagtgcaaccagaggcacaagaggcacaagacccaaatgtacttctactaagaccctgtttctttcagcttggtattattataatctagattattaagccagattactataagctatattgttataatctgtagtagaataagcgactagttgtttttttttctaaattattatagcctagattattgggtttgcaagtctaaagagtgagtggggtggcatggtgggtaatttttcaccaataatctggaaaaagcttacctaaatgagcttatcagattataataagctgggctccagattataataagctacttcaataagttgtgtgtttctttcagcttactcccaataatctggattataataatcccaagctgaaagaaacagggcctaaataattactccatttttcagttcttgatataacgtttgacttttcgtcttatttaaaaattttctatgattagtatttttattgttattagataattagataataaaatatgaatagtattttatgtgttactaattttttaaaaaaaaattatataagacggatggtgaaacgttggacataaaaaactaaaaatgaagtcagacggagggagtaactatcatcaaatataaattctttaagccccatcgttttgcttatccttatacttatccgcaccacttattagcaaattaaaaaaagagtagttttgtagcaaactgaaacatatgtcgctattgttgtagcaaaccgatagttttgtcactaaaattgtagttttctaaaaattactaaaaaaattgtaagtaaaactttcatacgtctccttagtggtataatagcaaatgttgtaaaataaacatgatgaaaaatcacaaaattaactttaaaatttacatttaaaatgtaaattttagcttataagtataagcataagcgaaataatgatggcctttctgactataatggtgaactgtcctcatataaaacttattttattttgttttcaaaacaagtataaacgcagaagctcatctgcacgtgtgcacacactgaaccttatgaaagcacaccctgtaaatttatagctatgaaagaggacataactgagaaaatattattcgctttgatttcaaacaaccaccatcgctgtctaatttttttaactttgaccataattaaattttaaattattatatcattatgtatgaaagttttcaggactggaatgcgacctatttcgttgacatgaaatatttttcagtatttatatattctcttcaataaaaaaaattcgagcagacaatggtcgaagacaaatgggagtcctatctaggagtagcaacaagtatttaaagacggacataccagtgagttaccacagagtatagtgctgccgttctaaacacaacaatatatgtgcactcaaacatgaaaaagaaaattaaaaaaaattgatatgtgcaacataatgccatgtaccatcattaaataaaatcaactcaaaattaaatttacatatatacaaagaaacacagattaatttcaggctcgaagcggtgcacaacacacaccacatattcatcccaaaggaaaaaaaacagcacatattactgttaataaaaacacatttttttttatttttaccagctacgttcaaaaatacttcatctctggttattcacctcacaagtgcttgtccatgtgcatattcatagaaatccttttagaaaaattggtaatatatcaataagttgtaacacgtcatataatggcatagttccaattttccctatccgtttcatgtatactaactttgggacaattatctatttgaccctactttgaagcttaactaccaatttgacatcgtttttcccagtttgcttatttgacctcgtttttcaaaattgaagttaccgtttcaccctgtttccaaaaaccgtcagggttccatttagaacaaattaaaaaaaataaatttacaagcctaaataactaaaatgcccttatttactcatttcttatgctctgtatcctctctcaccagagcacaaatggctggaggtgcgacggtcatcgcggctgcagctgcggcggctacgttggctccacggcggcggcacgatgaggaggaccgccagcggcagcggcggctgcagaggggcgacgagggctggcagaccatcggcagtggttgtgtcagctcggggggcagctgggctcgacggcagcggcgcgacgaggaggaccaccggcagcacgacggctacagaggggcgaggcgacgagggcaggaggaccaccggcggcggcgaccgcggcgacacgcggtgggagcagcggcggaggcgataaaccacggtgggagcgcgacggcagtgcgtagtgggaacagaggcggcctcggcgatggtggggagcgggagagacggcgtgagcggcgaaggggttgacccgcggtgggagcggcggcgacggcgtcggcgtgcggtttgagcagggacggccgtggcgacggcgggagctttggaggcgccgacccgcgatgggagcggcggtgacagcgccggcgcacggtgggagcatgggcggtcgtgtcggcgcacggcagtgaccgcgtggagcatggtgtgggagctcgttggcgcgcggaggccagatggttgccgacagcggtacatgcgagggcgggcggcggcgcgggagcttgtcggcccgaggaggctgggcggcggcacgagagctcgccagcgtgtggagggcagagcttggcggctcgggagcacgccggcgcgtgaaaaaaaaaatgttgaataaacaattttagaaactagggtcaaatgagcaagggtataaacgtctattttctccctgaagttaacactgttagcttgcccttcacataatacggttagatccgaccttcattttttaaaataagggtcaaatgagcaaacttgaaaaattagggttaaattggtagttacactccaaatcaggggcaaatacgcagcaaatacgcaattaccctaactaactttttatttttcatgtttgagtgcacttgatgtatatcggtgtagtagcacgcgcgtgagattctcaccgtcagacatgacgcacctcgactttggggctgttcaaattgatgacagtttcaaccataccattatttggtaaaattgataattatgtggttatatttagtttgttactaattattggcaatacatatagaattttggcaacactattgaactaatcctaccaaaattttgacaatgttattaatttgccaaaattttggcattactaaattttggtagcgttcattttggcacaaactgaacaaaccctttattttaagagcaagggttttgtcgaatgtttatttaaatcaagattgttcttaaggggtgtttagatcccaccccaaaattgtacgctatgtcacatcgaacgtttgaacacctgcatgaaatattaaatataggctaaaaaataactaattgcacaaattgtgactaatttgcgagacgaatcttttaagcctaatagctccatgatttgataatatggtgctacagtaaatatttgctaatgatggattaattatgcttaataaattcgtctcgcgatttactggcagattctgtaatcagtttttttattagtgcctgaacaccctatgcgacaccctatataataaccgatgtgacacgccaaaactttacacccctggctctaaacaccccctaaatgcaactagtgcatgtgcattcatgcataaatatcacccgtaccacaggcgaagccgacaatgaaactcgccaatatcatagggtgctaatgccaccatctcaaaataagcaaacttttatatattatcagattcatacataaaaactagttaaaatcaatccacaaatcttatcgattttggatcactaaatgtgctttacgatccgtgctctagacccttctcctctatatctgatgacctcatcttcttctccagtgtcagtaacgtcccaaactctcacggaggaacagattaagatcctaagttggaataggggtgaaaggggatgggaggaggaggagttcaccagctttaaaggatgaccatgagagacgctgtacgatggtggacgcgcggcagaacgggccggtagttagacggcgacatcactgttgaagttgtaggggtcgatggtggatgttgggatggtgtttgcgacggggataaagtggggcgaaaaggttaggagacaatgacccatggtggcgaatttggtagcggggagtcatcggagacgaaaacgatgagatgcgggtatatcgcgggcgtcagctcgaggaggatgagaggtggggaatgagaagaaaggagagggaaagggaggccttaccggcacggcttgcacctttccggcgttggcgaggaggagaagggatcacgaaaacggtgttgcatagtcggtggtgttatgcaagggaagtgtgacacacgctacaaatctcaagacaacttcaacagttaaaaattatataatttaaattaggattttctgtcatgtcatataggtactcatagtataaagtgaacatcgtgatgaactggatcgagaaattaggaattctgaaagaacgaaaacattttcggataatcgagatcgttaattcgttatccactagaggggacgtacgtgcatgtaaacgtggaagcgcactaggcccgtcgtacaggagaagcacggaagctacggaagctggagcagtgcattaacacgctccaattacttctcgtgtgggtactaattaaatacggatcagtactccaatattaatagggatcgatcaaagatcacacggcacgtacgcgcgtaccctgcactgcatctgtaccgtctggcttgggatgccctcgatccatgcatccatcgatcgatcgggtccggccggtccggactgcctgcttgtacctgcacaggatatatgagcagtgactgtaactgtattggctacaaatgacctggccggtttcattaaccctcccatcacatgtgaatcagtaagtgcgtattaattgtgcagtagtaaaatcgaactgtactgttagaagcctaaaaaaaagcttgattttaaatcatcttaactacattttcggcacatgtcctgaatgcatatatattatattgatatatatcatgttaagatgtactggtacgtgctttcaagcctaattaacaatgatacgataaaaacaggtgtaagacctctttacctactccctccatacctaggaaagcttataattaatattataagaatttgctggttggtaacccgtttttataatctaaagaagtttgattttttagttttctttaagtttattttctgtattctacaactataagtgtttatattaatacttaatttccattccgaattacttacatagaaccattatatcaatttttaagatgaaatatggagttgtgataaattatggagctgcccctattaattacaacattagtacgcctttgagctggaggagtggattacaataaaaaagcagatgcattgataaggcgcagagagagaagatattagccaaatgttttgaaacatgggaatgagaggtattttgaaaaaaaaaaggaatgtaatttgagaccgacggagtagcatttcacaattcctttttactaatttcacatatatgtattcatttgggctaaaaaaaattaataatttgccactagttcacatcaccataattttttgggcaaacacgattaattctcatggtggagttataggcatataactctattcatcaggattgaaatcctaatatctaaaaataaattgcgtgtatttttagttggtgcacgtattgaaagtgatactccatatatatatatatatatatatatatatctatttatttgcacggtcttcaataatatattttgacaattaatttatttcatgttatatccccacaaatatgaaattaccatcacatgaaagtaatttaaaatataaatctaatgatataataagtataatactgttagtatgattattagttaaaagttattgagtttataatttaggacggaaggagtattgtcattattaataaaaaaccgaaaaaaagattgaggacacaaagcactaggatagccagcaggtcggccatgtttgagaggactctcgcggtgcatgttttcatggattgggggattagagacggtctgttatagcaagtataataggggctgaagagccggcgataacaaattcaaaggctgagttggcaaaaagctgatgagagagaggaccagccggcgactaagagcaaggataataataaagcccactttttactattagcctatcttaaagtcaacatatataatagattagctataaggttggctataattttcttctcctctctctatctctcacttacacatttaatgcatttgtcttgaagcttgtgataagctaactcttgcataagagccaacatccttaatttttcactacctctctcctccacctaagcttatagtacgtttatagctcactattatacttgctcttcttgctctaagagcaaggataatagtagagcttacttcctactattagcccattttaaagccaacatatataatggattagctataaggttggctataattttctcctcccctctctatctctcacctatacatttaatgtatttacccaggagtttgtgttaagctaactcttgcatgagagccaacattcttgatttttttgttatctctctcctccacataagcttatatagtaggcttatagctcactattatacttgctctaattaagcgctagcgtcacactctccaaaaaactctccaaaataaaatgtgggacccgttgcatgctttctacaccatacagaatgaagatgtgatgtagaatgagagagaagatagaataaataaataatagactattgcaactaaaaaaagatggatagactacttgttgtatgtattaactttttaccatggctatagcagacgtggaaattactggagtaagcagcgagcgcttctattaaccttgctcttagatcaggtacaatagcaggctataagccagctgcaaacatattttaataagataaaagatgagagagaagagcagcgggctacaaatctgtagccagctgcagcacggactccaagacgcaatgtgtgtatgacagtgggaccatatgctaatagtatagtaagcaactattgtataaattggctattaaattggctatagatgaattagagttagtagttggctatactattaaccttgctcttagcatcagtatagaagcccactgtttccacagatcgctgctcgacaaagttactgctattagcactagtatatagaacagagtaggggtgacatcttttaaaaaggaaaaaaaagggcacaatttgccactggatatatgtaattagttggaagacaaaaaaaaaaaagtgacactgccaatggacattataaaattttataatttgtgtaattagctgtagtacacccgagacaatattttatcatttccggtaaaaaagaggagagagaaatttcaaaaggacagaaatgccctcggcctcattaacatgtactcgaagctgagccccacggcaccgtcgccgccgccgcaggccgcggtctgcaggttcaaggccatggcgatgttgtcgcccctgccgtagctgctaggctgagcacgtagaagaagcaacaaaggccgacagtgaccaccatggcgagcgggctccgggtcctgttctccaccgacccgtcgccatggatccacctcaaacctgcacacacatcaacaagaaaccaatcaacggcaacaaatcgatcaaatgcaatgcacaaatcacaatggcgatggacgccgtcgtgacgagttgctcgttgccgttggaacttggaacgccggatccatctgttgaggtggaggcggacgccgccgtgacgagttgcccgccgccgcgataggtggtcgacttcctgctggttttgtgccgacttggcgcgtcctcctccgcatggcgccccgtaggtgagtgcagaacgatgcccaacaacaacagctagcagcagcaacgccgtgaagccggagatggcaccgaggccgacgatgccctacgaccaccaccacccgctgctgcagccgctctgcaatgccgccggcgccgccacggcgtagtgctcggccaagtccgcgccaccgacaccgcagccgcactagcagctgcccgccgccgccgcgcacctgtctgccacggtgcacctgtccgtcacgctgtgcgtatggtggccgccgcgcctcgccgtcgccgacggtgagaccctggcggagcgccgccgctttttccgccgcgcgccgagccgtcccgactcgggccgtcgcgccggccgcgcaccgtttctccgctccgccgcgtgcgtgaggaagaagaggataggagagagatgtggaccccactatgattagcaaatagtaatcaccctactaattacgaataaattaatccatgacgcgtgggcccaggtggttaaaaacctattaaaaattagattaaacatacactgtccatgacacgtggaacccaccgaagtttaaagaaggaaagagaaggggcaatctggtcatttagataaatatctcactcttttgacccgaaaataataaaataatgatacttgtgttctacggctaattacatttttttagtcttcatcagccgtgtcacgttttcgcggtctctcagtcaattacacgatttttgcatgccgtgtggtaaattttgccaaaaaaaaaaaaactacagaaacagaagctttggtagccttgacaggagaatagaagaaactactactactccaaaagagctattgttcggacaagtgcaccattaggtggcttatattattattattattatgctttccatttcaaattactaatagagtatcattatagcaattttctgataaaatatgaaggaaaaagataaaatatggagttctgataaatcactgagctacccctattaattacaatagtattacgccgtgtttagttccaaaggattttttcaaacttcgaacttttccattacatcaaaactttcctacacacataaactttcaactttatcgttacatcgttccaattttaaccaaacttccaattttagtgtgaactaaacacaaccttagtaccactttgggatgaaggtgggggtggagtattgatgaggggcaaagcataaaatatgctttgaaatgtgagagtgatatatatttttaataaaaatttgaatgctaatgacaaataatttgagacgaatgaaatagcatttcatagttttttattactaattttcacatatatgtgttcattcgggctaaaaaaaacttacaacttccttcattttaaaatacattgttttaatctcctattaggttattatatttttagtgcggatggagtacatattaatttgctactagctcacatcagtagaaaaaaaatatttgggaggaacacaattaaacatggtggcagccatggacgtatatacggagtagctctttccatacgggtaaagttcctaatatacaaaaaaaactagtatatgtgtatttttagttggtgcaaatatcaaaagtaatactcattacagtattaattaaactaagggtgcgttcgatccatggaaaatgagtgagatagcacatctttttccgcgcgcacgcttcccaaactactaaacggtgcgttttttgcaaaaattttctataggaaagttgctttaaaaaatcatattaatccatttttgcaatttaaaatagttaatactcaattaatcatatgctaatggctcacctcgttttacgtattttcccaatcttctcaatcccctattcctcaaactcaccctaagagaatgtgttggaagtttatgcacaaagtactaggacagccagcaggttggcgatgtttgagggaaagacagccaactgcgctgccacagtgccactctcgcagtgcatgttttcttggattgggggattagacacggtccgttaacatcagtatacaactagaagcccgctgtttccacagattgctgctcgacaaagtcactgcaattagcactagtacacaaaacagagtatgagtaacatcttttaaaaaaggaaaaaagagctacacaaacagatgctttggtagccttgacacgagagaatagaaggaaccactcctattccaaaatccctgctctcgatctcccaaagcaaaatcaccgatcgatcaggatcaaaacgtacgtacgtacggtctcgatctcccccctttctttttttttttgctcagctctcgacccaaacctttctgcttttcttttcccccttctctcctctctttgtgatgctgatgatgcatactgctacggtccaagacgtcctttggccgtctgcctgtctgtgttcaaaagaacgaaaaagcacgagcctgcctggctgcctgcccggcgtccgtcctggggcgccgtatgtcacgctctgcggcgcagtaccagtgcggtgcatgcatggcacggcacgcgacgaccaacgctacgctgcgcagcggctcgatcgccgagcgagcgagaccgtgattggaatcaccacccaaccgcgtgccgctgcccgctgcggctgctgccccccctactactcctagcccttgatgtccgaagaggatttggattggattggaccggtcgtcgccccaggggtggggggcccacgcctcgcactctcgctgacctggcctaaccgaatcgctgtgccgacgtcacccgtgctgctgctctgctctgctggggtgtgagggtagatgggtcatttcgccgcggtgggacccgtgggacgtgggaccacctgggcccctcttgctaccaggtttgcgcccacgagacttttctgttgttttctttctcgcgtactctgtcccatgaaaaccattcattgttagaggttatttgggagctagtgactaaataacatcggatattttgacactaatttaaagtattaaatatagattaactataaaacccattccataatcttggactaattcgtgagacgaatctattgagcctaattaatccatgatttgataatatagtgctacagtaaacatttgctaattatggattaattatgcttaaaaattcgtctcgtggattagttctcatttatgaaattagtttttttattagtctatatttaatactccaaattagtttctgcacatccgatatgacatgtactaaaaagttttagccccatctaaacacctccttagtattaaacgtggatatatcctaatagtacaaatatagatgttttttaattaaatttatagtactagcatattcaatatctaatactagatttttttttcttatgaagggtgtacggggttacggtcaatctttcacatatttcacgaggggttacaatgttgggaatttgactctcagattataataagaaagcagctacaatgctaggccatgttttcgttggttattgttgacggtcgttaacgatcagtttcgcccgtcaataataccaaaatagaggagaactagttatggttgcaatgcatatccatgttagaataataatattccactagtatttggatcactaaccttttgcagagaataaccataaaatggagaggaatcggcatcaaaccagacgataaatcaatcggacgatgtcgaggatcagacttatgtatgaatgagccaagaactcagaaatgacatgaccaattaggctaaaattcacaagcctgcagagaggagaagtctaggaggacgctagccgaaaatgggctggattggactagtccatggtttggccgaaccagggggttcggccgaacccccatctgctccgttggacatagggtttggcgtggacgtctaggattgctccccaatgacggttagagggcatttccgaccattccaactgccatgatcgtcattgggaggctataaaaggacttcacttcctcactcttttcacacacctcaaacaagagttctctcatattctctcaagttagtttagtgttctcaagctagtggaataggaatagagtagaaatcggagtccggaagccttcggaagagtttgggtatggctctagtagctcttctcttctcttttgtaagctttgtactttttattagaatactcttctttatacatttatggtattggaatactttccgagtatatgaatgccaactttaccctatgttcatgttatactgagtatactgctagcttatctgggagatgatttggtacgggtatagtgtttgattatgcaattactctatgtcatgatgatgatattagagtagtatctggtagtttaggagtggtttctagattacgggatatcattatttagggttatatgctgcggatgagaggtgggccgctgatggtgacagatcagtaagggtattccttcgcgcgtgtatatagtcctaagttaatttccaggggagggtactcctccgtatttagccccggttgtatggtcatgatgggctgtcgtaaggaactcgacagtcaggggtggcttctcgaagtaccaggagggcatcggatagagggtattagctagtatgtcagataactaggatgtatgtatactatgtatactagaagtatatgaatagatcctctttctctttttctttccacttggcttagatattttagtatgagaacgagtagcttcctgcttgtgtgtcactctacctttggatttatcttaacccctgcttagactatgattattacaagtaacatataaataattagtcaggttctctctactatgatctttccacaggattaaataaatacgatacccttggaatactctcgggtgaaatgctacaatagtatatccgtgcgcttgcggatgaactctgtaaccaaaatataccaggagtatttctgcgccattactaggaattatatttctggtaatgtcgttaagaaataccaacagttatcatttttaaccttaaacaatactttcatttcatattatgaaacaatttaacttctttctaatcaaagttatttaagcttggttaagtttttagaaaaatagccacatttaaaacacaagattacatttattaaatctaaaattaattttgttttgatagtatgtttgttttctcttaaaaatgttgctatgtttttttatcaatttaatcaaacttgtgtcaaaccgtcttaatataaaatggagggagtattaacatataataaaatttggtagttccatgcacctctatttgtaaaattagttaaaaaaacaactagcttattcccacgctccaaaataccaataagtagtaaaacatatccctagttaaaatccaatcacaaattccaagctggatgctttttacctctcaaccaaacaaacattttgcatcggtaaacttacaccattatggtcttatcttatgttatgttaatccaatcaataagggggaaaaaatgatggctagtccacatgtcatgcacttctctcattttctttctccgcataaattaattcaaattgcaagatccacgcaaagctactcaagttcttttaagatcattctttgttcatgcatctcttcctgtccccgactatttaagatcctattggggagcttttgagagctgatgtcgctatcagaatctctttcttgtctatatatatttatatttaagattctctctcaagatattactcactccatctcagaatatagtaacttgggattggattgaaagttttgtagcagtacgaatctaggattgtacaaatccttatatagatttatagtactagatgtgttcaatttagtcttgggttaaaatttttaaacagaggtactaagatttggtagctagaaaatacagaaaataaactgtggctataagtttgaatgcttaacagttagctggcataagtccattttacacctgatcacagctcttgcctttgtctaaaatttactcttcaactctaaaatcaggcatctaacacctctaactattaaaaccgttccatttatcccccagaccaaactaaagtggtttttcatgggcgtgcttacgtggtgtctacatgtcaatcttagtcagcataactattaaaagtaataatggcctcacatgttaagggacatctctctccctatcttttctctcatccactggtccccccctcccccgcttcttgctagccttcagcggcaatgaccgccaccaacgtccgcatctatctcctggacctacctctaacaacgagcacctcttggccataaaatcggtgttggcgagctcaaactctgcctctccaagagcctcttccatgcactggcggcctcgagctttgactaaccgcctcctcctcaatgtgccggtgagctcgagatcaacctcctccccactctcccacccctctgtatcaaggtccaacttagccactacgtctgttgagcttgctgccctggtcttggtgacgggtcgcttaaacaggaggaggtggcagtggagaaggagctatgacaatgcatcgaagggaaaaagcagtgtcgcctgactgcgtaggtgcagcatggggaaggaggtgaaacaagctgctgcggcaagcattgatgcaacctacactatcctccatttctaggagaagatggtcagctgcaaaggtagaggagacggggaggaggtagccaacaacggaggagatggtcggcatcaagatccaatgccagcttgcccaacattatcgtaagccggagtggaacgagctcaccggccaataggtgagatataaattgaagaggagacgatgcgcagagtcacctccatcgagctcatcatggaccctcatgtcaggggcagcaggacagagaggggggagggagatgagaggaacaagaagatatggtggcaatgataggtgtgacccctctctctcctcgctgaggtggactattgtgtacatgtgcattgatatcctacgtggcatccaatattgtataataccactacatagattttttttccaaacgagaacccctataggttgctggtggaccataatcgctctcgcctgcaaaaattgttttcagggggaggttaaggggcttcttaagactctttaagagatccgtctacgaaaatatacttattttcctaggcgagactcttaaacagctgtgtgcgaaaatgtattttcgcaaacaggcctattaaaggcccacctacaagtctaacttcctcttcctcttagcacttcaaaaattttcaaagtcatcatccttataatctcctcatcttctctctcacctcctctcctcctcatattatctctcactcctctctctctctctcagtctctctctctctctctctcatttctcacctcctctctctcgcacgagttctcctcccgagtggcagcgacgggtggctggctagtggcgggctcgagcgggaccgggaagcagcgggcttagcggtgatgacggcaactgcggcaccaggatgggctgatccgcgcggccgctaccattggggtgaggaggggcagtggtggagatgcatggaggggcgacagcagcctcggcgacgatgacggcgatggactgcggactgcggcgacgacgtcattgacggatgggagtttgctagggttttgagttttgattcttttttctttggaatttttattttttcggatatttatttttgcatgtgtatgacataagcacccgcatgcgaaaatctgatttttgcatgcgatgcgccacctgcatggaaaaacaactatttttgcagacacttttgggcagacggatggctcaaccgcatgcaaaatttggttttggccacatgcaaaaatacttgttgcagtagtgaaaccgcttcacaagagttcagaggcgtaaaatggaccttttacctatcaattactacttaaaatctcccgttaagaccttatttttgggagcttataacaactatacctataattttgggagcttataacaactatacctatagactctagttcctatgctgtcaaattcttacttaagattctgagacacactaattataaaatcaagaaataagtatattagtcattaaggcctccatacgacggtccttatcgcttcgcctcaaaagctctagcgaaaggcgatatctcaggggaaaaaaaatcttcgactcccagccccttttcttccttctccaatggccatacggttgtcagcatgggattaggggagggtctggctcctttattcactagtagagataggtttagatttagtcgggtctctctcgttctcgggttctacctgttctttgtgtagctcaagagggtcgccgacattcgactcttcttgtctcagcttgatagacatggcagacctcgtcggtgttcttgtcgttgtcgtcttcctgctcggtgaatcctaagctcatctcaaacgctttcagttgggagttttgctattttgcttttgggttgaaggattgttctctagcccgtcgaacagaaggagtgcaccggctttttgctccatcttcggtgtgtcccgcacctatggtggtcatctccaacatcagttctgtaaaaggcggccgatgatttctcctatgggctaaggtgtcttcaacctctgttgagaggccccatttgggtatgctttttggctctacccattgcagttaaccattgttcttttgctccttccgtcgccgtgcgtgaggatctgatcatcattgatgtagtcgttgcaaggacctgattgcttttttctatattttcgcgtatgttacgtttgaagtgtaatttgctcatcactcatgggcttttatacaaaactagttgttctttcagccttaccccattggggaatgtaactcatgtactttgtccttaattataaaacacatgagttttaaaaatacatacattagtcagatgcattctgtcatggtataaggcatacctcctatcctacgacttatggaatgtacgagactggcataccatcgttcatatgatatatttccgtatgtggtaaggaagtatacaagatattatgggaagtatcctcatgggctggtgattaacagagtcccactcgggaggattgggttgattctatatcatgcgggattcattgtctctgagttatatttggagactaaggcaactcttgatataaaaggcacactccctaaggggttcagatcatcgaatcatagcaccaacacactcaccatagtttacgaagccggaggatgtaaagccaaattcgccgggagatcttgtcgact

SEQ ID NO: 54215 - DNA, 1133 bp, Oryza sativa
gcatttctaggacttagacgcttgtcaatggcatttcttggattatctcaaataaataagtgaataacatgttgatccaaatataacaaagtgtgacaagtctaagttgtgggagtgaaacaaatatctacctaactgatgcatgagttctaaagaaaaactgagacatgattaaaatatttttcacgaacgggcaaaaggattgcacgtcaatgtattagaagaaagtagagtttcagttgtacaatgcaaacggcgagaaagaccattgtcggaggacaaacatgattaaaatatggcttgaggagaggagtaatgaacaaaacaaccccttcctatacacattggtggcttacaggcttaccattaaggtgcagtaacctctcttcccctgctaaggtaaaccgtggtgtaaagtgacggtaaatatttgttttagatttcaatcgctttaatttgtttgggggctagaatagctggatgcaattatcacctttcaaaagtgaaactgataacaagacaatgatatgtcggaggaagatgtaataaggttgacgagaaatagtacaacaagagtgtactacagatatgaacaaaaataatatcagctcgatctgttgggaagtttgctttctattcgaccatttgtacacacatgcattgatgcatatgtgcacatatctctagtcttttccaaatcatggacgagccatcataatatctcttcgacaatttgacgatgatatggcgcaaatcatgcaagatattgctgatcagattgcatggttggctatgtagacccagaggaatgatggaattgtacgtgcagataggtgttttgagacaatgacatgaacagcagctactcgtaacccgttgcatctaattctgcacttaattcctttgccaccttttaggttctcgcagcttttatgtgcgctttctctaaaggcatgagtcccttttcttgaaggaaagaatatactcaacccagtcgtcagtgcacgaatcgtcacgtactacctccgttccattgtaagtgcagttgtgggttttcatatctagtgtttgactgtccatcttatttaaaaattttatgaaaaaataaaaaaaatagtcacacataaagtatt

SEQ ID NO: 54216 - DNA, 2935 bp, Oryza sativa
ctaacagtgtaccggtaatttcaactaatcagagagctcaaagtagtagagcttacctaacttctaaatttaattccagaagttagggtttgaagtggagttatgaagctggccaaacccagctccacctctctagttcattttgtgagagagctccaccagctctactcccattttaggtgggctctagctccaagagagatggaggtagagctggagctgtgccaaacaagcccttcacatgtatatttatcgtactattggactgtccttttccaaaaacctttcatttcaattaattaaagataaaaaccaagatcggtccatgtcaaggagtgaacattattccttctaggaaagcatcacaaaaatcaaacaaaacaccaaaagtatattaaatggctagtggtgattcgtttttcttattctgtttttaaagataagaaagagttgtagagatttagctgtcacgtgcatgaacgattcagccgccaacatgatcttttgtctaggcctagtcatagcgtcttcgtcattgtgaaaataatccccctctcgcttggcgtttaagcaaggccatgaaaatcactgaagcctcatcgcttgctttacagattggcggaaccagcgacactagcgataagcgatactgtcgagtccaggcaacttatagattttttcgatggccagccatttctactaacaatattataggcaatcaactatgggtatctcagttggccagccattttactagatattgtaggacatcaaccagggatacctttaaatttcggttgcagttaataagccaaaaaacagacgataggaggcataacaaatatatggatattttaataatcttttaagaaacctatatatttagtgaagcaaaaacctatatatatttatatgtagttcatatatccggcaactgtaggtaatgttataattttttatccgtcatcaagagtcacatgactcacatcggggattttaattatttgtcacttttaggatgaagtttaacaatttgttatttatagtctatgacatgcgagccatcacgtgtctacgatgagtccagcaacgaatcattaaatgtcacatctaaaagtggtaaatagttaaatatctcgctcatatcaacttaattatttctatcccttggttgtgtaatctataattcaaattgtttcctttcatttctttctcccctgaagtcatgtcgttcaattctttttatttgaataaccgatctatattctatatttaatctaaattgtttatacaatttctaatgattgatcaaagcgttaattatatgaagtagataaaattttatgtcgcttagttagaaaacagattcatcttatactttatttctaccattattatacaatattttttagcaacttgtgggccgggttcctttcttcaattttcagtttaattaaaaattgataaaacttcaagagaaataaaactagcttaaaagcatgagcgcaataaatataaatccttcattataatctcaatgcaagaatatttatacaactataaatataaatatatgtaattaattactaagatgcaaggcatgagagtaagcaggatttatagagattcggcaaaataaatttaattaagcatgagttctaaagctcttctcggattggctacttttctcgtttactgtaagcatgttttcctaattgctaaacgttatattttaaaataattttatatagattttatcgacgtttgatgtcgcgattccggtatttgcatggtatggggatcgtcggtactaggatatacgcgagactgaggtaaaagagacggggacgaggatttttatacaggttcgggcccctgaattgtcaggtaataaccctacatcctgttggccgaagccagtattgctcttattcactataatcacaccagtacaatatttggggtagcctatctaactgttgtcgacatggcggtctgaaggtctgactcgtagtcgacaatagggtagtcttcctcctcgagttcgtgcccggcgagatcagagatagcgttttcgtctctcctaacagtatccggagacaccgtagaggactagccgtgcttatccctgaagttgatatccggcatcttgtcttggtgtatgttggcttgtatgttgtggcttctgttgttccatgtatgttgattgtccctcctctcctcctagagggccttgtatttatacccataggtgtctccttgtccaagtagaactagggaaaccaatatggatataatccgagtagtacttatcgtttctatgtagaactctggttgtctttccttatccggaactccctcgaggttagtttccatataagacatggtatgtggtgggtcctgccgagatttagtcaactattattaggtatgtggtatccataaccctgacagtagcccccgacttcaatgcaaatgaacggattcatattctcaactgcagaccatggagtaactgttatcgagctcacgtgaatgttctcggtgagttcagagataacgttagacttcctttatcagcctcatgcgggcacctaaagggtttgtctgagtcaatctccgacgtcgaccaagaaagtacagagcatacgactaattctcccgtcttgctgtaatcgagaatttggattgaagtcaagaaatttatctcggcgggtacaccatctcttcatttcgtattccttgtcgagatccaccaaccgttcttgagtaatcgagtaggcatagagtctgcgacggagccttgtcaacacttgtcgtactcgctttagtcgatcttggtatagaaccatagagacatggagtcttcgataatgtcgaatagaattttcctgaaatccatactcaaaaaagaatattagataaaaatagcccc

SEQ ID NO: 54217 - DNA, 5065 bp, Oryza sativa
acaccaatggaagtttgcgatgcgggagattgctacgtactggttcgagaaccagcgagcgagtagaatcatctctcgaacaacaatggagattgtggtacgggagattgctatgtactggttcgagaaccagcgagcgagtagaatcatctctcgaacaccaatggaggttgcggtgcgggagattgctacgtactggttcgagagccagcgagcgagtagaatcatctctcgaacaccaatggaggttgcggtgcgggagattgctacgtactggttcgagagccagcgagcgagtagaatcatctctcgagaaccaatggaagtgctagagttggtttattacatgtgcatctcatgtggccagcatgactcacacacccaacttgtagcatatccggatgtccgttcgcaatcatgtcgggtgatcaagccgataacgttcacgaggaattatccgttaacaaccttttcttgagtagtccagccatggccggtgctatgagataggttgtcggtcttcgttggtaggttgggcgcggactctgcatttgtcgagattgttctcgataatgcggtgtacttgaccacaacctactcgagtgctcaattgttcctgaataatattttctagaagacaagatatatagcagataatatcgagtatgtactaaaaaactacatgaatcttctagtattatcaggatataacgagcagattaaatatcagggcattatgtaaactgtaaacaagcatgatttatacagaagaagacagagcgagcctccagcgttagatcgcagtcgatttaacatcggggacacccgcgcaatagttattgtataaaaaacatactctaggcaaacataataaaatttggatctgacaatattatatagatcagaaaagtaggtacggtaaactgaatataaaatattgcatacctttatagatatatgccggatatatctacgaaattagtagatcaattaaattaattaatctactaattaccttgtaccaacaggaatatgcttgattgaaattggattaggcattaatctcgattagtatgcttcggataattatccatctcgatctcctggtttgctgcataatattcctcttcctttgtactgtacgcatgcatatgtgcaggcgttgactgagttgggcttcgtgtgtacatgcaatccggtaggcgtcggtgattaaactcgttaaccgtgtattggtcggcacacgtggtctagcaagtctcctgatcatggcaaacgatagttgtccgactcccacaatgcatgcgagctcacgtagacgtctaggattccaggagatgagtcgtccaattccatgggtgacggcggcgatgattctgatctggtcggaaaagacactccggttgagttagatctttccatagccgaagtcgtcgagtagttgctagagaatccatctcttgaacccatctcgtcgaaatcctgaagcaccaaaatccccctacctggtgcgccactgtcgacggtgggtacccgtagaccggatatagagggtattggggtacgctggtacgaggatctacgtggtacgacatcaagaaaacaagagacaaagattatactggttcagaccccttagtaggtaatagccctaatccagtggttttgggattatatggaaagaaccacaaattacaaagggaacagtagaactcggcgataccgacgagaccgtagtcgagttgattcgactagatcacccgacgacttgtctcctatagtctccgacttcgtaggctgtggttgtggtctaggctctgagatccgatcccttaggtcccctggggggtcccttttatatcgcagatcaggcggtctccaagtaggactcggagacatcggaccttgcacgatatagtaacgacccagtcctatacgggtaggaacctttccactggcagacttcgtgatggattcccttagcgtgttcagagggcgtccgtatatgcatcgatataccgcattgccgtgtagcatacatccaagggtagagggtataccttatccgtaaccctgacagatttttttaaaaaagacagataaatcaattttataagtttgtactcaattaatcatatactaatgtctcgtctcattttgtgtcactaaaaggctaagaaaaaagacgtgtctggtgtattactatactaaaacattggtagtaacaaaatcttgataaattttggtactgccaatgttttgttagggtagcattgaaaataaatgtgtttggattgatgccaattaggagccaaaatttatattatggtgaagaaagttctaaaatagtgccaaattgagcatgaacattatcaaacaagcttcaaaccaaaccaccacatttactattcaaactgaaaaatttgtagggcatatttgacattgatccaaacgtttgtgcatagctcttctttctttatattggtcgatcagtactgcttccaaattggagtaatcaaagacttatcttgagtagagagaattgagacaaatatttgacgcagaataagggaaaccgagccattttccatgcattgtgggtatatatatatatggatctccaccacatatttaccccttccgttgacataatagaccaaatggctagtttgtaacaagaccatggctccactttcttttatattataattgattgatacaattttgaatttagtttggttatcctttttgaataattttaggcagctcattttacatgtcttacagtactactccctccgtcccaatataagtgcagttttgcactattcacctccaacgtttgaccattcgttttatttaaattttttttatgattaatatttttattgttattagatgatagaacatgaatagtactttatgtgtgactaactttttttaaatttttcataaaattttcaaataagacggacggtcaaacgttggacacggatttttattgctgcacttattttgggacggatgtagtatcaatcataagggagttgggcactaaaagcaatgaagaaagggctaaaaactaatccataatattcaatcaacttaattatttatagatattattaaaagtttaactatatgatagcatttttactgagaaatctattaatttatcttcacatatcaaatctttttttttcatatgttattgatttaatatttttagatttattcccttaaaaaaagggatgttgaggttgaagtacgacatctatttgtgaacatagcaattaagtaattatcattgtagatgtaccagtggtttagtcttgctgccacttttgtagtagtttgtagcgtagtaatctatgatttgaaaataccatgtgttaattttttgacttggctacccgcatgcggacaaggagacttgctaatccatgttttgaagatgaagaaacaggaatgcgtcattgacagttgacaataaattattaactagtttgtccaaaccatttggaaactacataatcaataaataggagtaccactagctagtttgattttgtttgtctgattagtgacgatttggcatctgcccaggtgtctatcttttacagaaaagaagaagaagaagaaaaaccactcttccaacctctccccggccatgatctgtcgtaacaattgtcactttactttttaaagaaacatacgtctgaaaactgccacgtttaccataatttattcagctgaggccacgtcttcaccgacattgctgtaaggggtgaaaaaactaacatgtttggttggctatcaaatttaatttagttttgctaatcaaaagtgtgtcaagccatagattttgtggcttaatttcaaagtaagaagctgccaaaaattaaatgggctacctgcctcgagcggtagatatgtcatatgttaagttgcttgtggtcaaatagttgccaattggtgatgaagaagtttctgttgtggtttagttaccatctccaaaatgatcactgtaggtaatggcagaagcgtaaacaaggagcttttagaaaaagaaatattaagcgaagcaaaatgatgagatagaagaattctgatttcatctttggattgcattcaggacaaatgtgtcgttatggattgtcatttatcctatctttcatggaacgtatcatataaatgcgttgcttgtcaaatctattatctaccgtatgtgtatgtctaatcactgttgtatggatcataatcctctcctatatatctagcgttgattgggacgggcccgacccccgagcgaggagggggcagccgccactctaccccgggtgccaccccctcgaggaagtgccacgtgggtctgggggcagcctcctccctccaaactcggtgccctaagctgggaagggggggccgccgctccacccaggcgccgctctcctcaggggcgccacgtgggtttgcgggcagcctcctccctctaaacatgatacccctggacccatatcaccgacagtagccccccggagttagccttgaccaaaaccttccccagatggccagggttgacgccactctcctagtctaatgatatgtaggcccggttttctgtcctgtctttctgggagttgggcggttggagtttagccacgttcatacgttgccttaacttcccagttccttcccggtttccgaggcgctgtgggcacgggagcggaaccgatacacatgggttttttgctcaaaagaccccatcctctccatgattcgctcctaccgagccctagctcctctgcttttcctttttcgtcgccaccaatcttctcctttctttgctagcactagggcccatgcgcctttttcgcctcagcttgagggcgactctccagccgtaccttaggttgtgaacttattttctatatatatttagcaaacgttgttagattctctcaggcccacgacctcatgctgcacgcctcgcttgcccctgccttttgttaacctctgttcatgttctacttcatctactcaaacgattattttcacgtgtgag

SEQ ID NO: 54218 - DNA, 37277 bp, Oryza sativa
atcaagccaagctgggcgccgttggcagccggcggggccaaagccagctgctacggaagagccagcacagggggccccgggcgtccacggtgactagagctcgatgcagggctaggataaagctaggaatcgtagcccccacgcttttagcaaagaatcttttgaatggatgaagcaaatacaaactttttgttaccaaggagggtaaacgagcgcgcgacacgtgggtaccgcgggaccgcgaggaagagataggtgagagataaatataagccataataactttgctgataagcatgaacaaagtagatataaacttaaaggaagtattacaaatgctatgctcaaaaagatcccccggccaacgctgagctttcccagagaggccggctttggttcgggtattgcaatacctcctttgttacctttgtttatccttgtttgcatgtcgcgacttttcaaacgtttggctcgaagagggctccccaccctaggctccgaaccctttcgggaagcctgcgaccacttagtaaacgaggtcaagttcccacgagcctgcgccccacactacacattttgttcgctctctcctttcggtggcctccttccaatctcttttccttctacatggacgattactttcgcacgagtgtgagagccaaaaaactctaaggccagcaatccccgtccacagttgagccgggctgggcaccgtagcaagccagcgggaccaaagccagccgctacggaagagccagcagaagggatcccgagcttcgacggcactcggggctcaacttaaggctatgataaggctagaaaacttagcccccacacttagcgaagaatcattcatgtagatgggagagaggttgggctcttaccaccgagggagcaacaaatgcgcaatacgcgagcgtcgcagggccatgagaatagaaagggggaaattaaatataagatttcaagctgatgaattgaaaatttgaaaaatacttgaaacttaaaaggatgatcaatgcttgaaagacagatgcctttatgcatggattgtggtggtgacagggtctcctctttggcaaccagcctacaagatccgagcacagaacgccagcaactaagaagggacctctccgctggaggaggggacttgtaaattacacagtcatgtcggagcacggtgtaagcctgacttcccatcttagcgagcgtgcgacttgtggttggcgccaggtgaccttgtgcaccatgtggtttcggcaggttttcaaacgcttgatacctacctgcaagagtcctctcaggagtggaccgaggcgggcagcaggttcatgagccaaccccacgcttggcccctgagggccatggggaagaagctcgctatgacctagtcttcaccccaccccacccccccggcgcctctatgattgtcgtgcaaatctggagggactcggaggggttgacgccaccgtcgtacttctcggtgaggttgggcccgaactttgggggccatcggacattccgaagactcgccacaaaggtctgtccgttatccttttccagtgaggatgtaggggcctagccccctgcctggggtggcgcggttctcctgaggaggctacgccttcccccgcattggcggcgcgacgatcatcacgccggcgctcgaaagtacctcaaaaatcacgaacacgccccctacctggcgcaccagatgtcggaaggtgaactcctccaccagggaaccgtgagacccccttttgttttttggttcggctgggggcagcgggtgagattcgaggacttggtgagcgaaactgtgcgatcttgagggggttagcccctccaagacgattagacaaaaggggtttatacaggctcgggtcgctgagaagcgtaataccctactcctgtgctatgttgattgtgggagaaattgcaagatctccttgttggagccaaagatattcctcatgagcggcagaagctgctctagagattaaaatggctcgtccccttccgcaagtaggcatggaactccttttataccttaaggggttaccacataggcccaacaacctaacttagtggagaagtattacaatctttgcattaaatgcatatcttgtctcagcgcacgtcatcttgatgatggggcccatcaaatcttgccgcctgacatgggggtgcccctatcagtcgccatttaagggacgaagacttctgggctcctgtttgactagagcggataaactgactccggctatgatgagagactaaaaagcctctcattatgatgtgacggggcagagcacgccgcacgccgcctagcatactgacagggtgggggtacacagccactgtcctatcggtcattcgactggtcacggaccgatcatagatcggttgagtgcactgcacatcacattaaatgcggcgtggcgccaccgctcaggacgccataaatgcgggtaggtgggcgcctggaggcggctgcctaatccaccgcacgtggtgacctagagagggggtcggaggagcccgacccctagtcgcaggagggggcggccaccaccctacctcgggcccgatccctcctggggggagggccacgtggtgcctggggcagcctcctccctctagtcttgatcgggacgggcccaacccccgagcgaggagggggcagccgccactccaccccgggcgccaccccctcggggaagtgccacgtgggtctgggggcagcctccttcctccaaactcgataccctaagcttggatttggcggccgccgctccatcggagcgccgccctcctcaggggacgccacgtgggtttgggggcggccttatccctctaaacatgatactcccggacccatatcaccgacacattgtatctacataaatttcttactgtacttgttattcccggtccggattaaatcagggcgtaaccgaacaaggccttagccggtcaatagttgccagatatttacacaattaaaatgtatccatatccagatatttacacaactagaatgtatatatccatatccgagcaaaatacaagatagtattatcaatttatcatagagtcaaagtgtcaaacaattcgaataaggacgaaaactggcttaatcacatttattttcataattttctctattattatcgaaacggaaaggaatactctggacatgaaaggaatacacgagctaaaatgaactggaacgatatatatctcacgagcatttatcagaacatgaaaaccgattaagactcaataaagagatattgctagtcctttatttatatcaacaaaaaatattaaattgccttctaattttagcaaccgtgtctacatacatataaatactgtagatcactacctcttggatcacgcccttgaaaatacttcatccgtcccaagataaaagaagttttagagttggacacggttattaagaaagcaagtagaagtgaatggtaaagggtgattggatgagtaatggatgtatgtgagaaaagtgaatggtgaagggctgggattggttgagaagaaaatgttggtgaataagttgttatattttgggacatatcttgagagctaaaagttattatattttaggacggaaggagtatattatagtacctttacgtacggatactccaatctattatattattaagataatattaaaataaagcaccacattcgctacaaagattaaaataccccacattagtttaaaaaaatagagttcacataaaaatacaattgagaataactaaaattcagaataaaaatgaagaaatattaacataaaagttcatccacaacataccacgagattaattaaaatttataataaattatgaaattagaaaaaaaaggttcaagtaggaatactattaagaaataagtaaaattcggaataaaagataaaaaaaatgaaagaagagaccattcacaacacaccactagatttaattaaaattagaataaaaaaataaattctgaaattatagaaatagaaactaaagagcatgtagaaatataatttataaataatagaaatacataataacaatttcgataactagaaatacaatttagatataactagtatttcaaaaatattgaaagaaactaattaaaatttaaaataaaaataaaacaatttccaaaattataaaaagaaaaatgagagttcaagtacaaatacaattttaaaataactgaaattcggaagaagaagagaaagaaacattaaaagaagggaccatctgcaacataatacaagattaataaaaattctaaataaaaaaataagctctattatattattaagtagaaatataatttagaaatatctgaaaatataaatgaaacataggaatattgaaagaagagaccataaaaacacaacacgaaattaattaaaattccaaataaagaataaaatgaattctattaataaattattaattgaacaaactagaaatacttcaattttgagatggagtatatgtagcacgtaagaaaagatcaatcgtcgctgtaaataacggaaatacggaatcgatccggattacggggacaacagacgaagagctcttcgagtacggaatcatcttcaatttttataatagataaagattttcaaattgaggtatcatccgaataaaaaaaataattcatttccgaattgagttatcatctgaactgacatggtcatttccaaagattatcaaaatcggtttgaaactatccgaactgtttacgcgaggtcctatctacgtagagagagacaccgtctcgtctccgatgagtctacttgatagatttcaatgcacaaaaatccatataggccgtgtttagatttatttttttttcaaaaccatcccatcgaatgtttggatatatgtatagagcattaaatgtggacccaaaaaatcataggagtagctatatttatggcgccatattttttaccaaaaaatagtcggcatgtatttacattgtaagtccctaaattacatatgtatttttagtgtattttcaatgtaagtcccaaaattacatatgtaagtcctaaaattacatatgtaagtcccaaaattacatactaatttacatatgtaagtggtgtataagtggggtataactactgtgtaaattttatttgacgtatttttacctaaaaatttgtcaccatatttttatagttgctaacgtcttgcatcattgtatcgactgtaaacaagcaaaaaatgtggcgacagtattttagcgaaactcaaaatcaattgcacaatttacatgtaaattttcagacgaatcttttgagtctaattacgccatgatttgacaatgtgatgctacagcaaacattgctaatgacggattaattaggcttaataaatttgtctcgcaatttactgacgaaatctgtaattcgttttatcattagactatatttaatacttcaaatcgtatgtccgtatactttaaaaaattttggccaagtaactaaacacagccatattttcagtcaatatgatgcttacgagggaatctaactaatttagaatttgaccatatttttttatgaaacaagctagaaatacttcaattttgagatagagacatggagtatatctaaattgggacaagctccagcgtggtcacctattctcagctactccctccgtacttgtaaaggaaatcgtttagaacaacgacacggtctccaaaacacaactttaacttcttgtttctataaaaatatttatttaaaagtgatatatgtatatttttatgaaagtatttttcaagacaaatctattcatataatttttaccttttcaaactcaataacttgagagttatttataatttatatttccaaggtttgacttaaacattgtccggtttgacttaaacattatcctaaacaacttttttacgagtatggagggagtacgtctgtttgggcaattgaaggtgataagttcattacacgtaaaatgagataagccattagtgtacgattagttgaatactccatactcgtaaaggaagtcgtttaggacaatgtttaagtcaaaccttgggaatataaattgtgaataactctcaagttgttgagtttgaaaatataaaaattatatgaatagatttttcttgaaaaatattttcataaaagtatacctatatcattttttaataaatatttttataaaaacaagaagtcaaagttgtgttttgaagactgtatcactgtcctaaacgacttcctttacgagtacggaggaagtattaattatggtacacttgataaaataataagttttttaaaattatttaaagaacttttatataaaaggttttaaaagcacgtcgtttaacggtttgaaaaacgtgctatcggaaaaaatcagcctcaatcagcgtaaaagaatccttgatgcatcccacaacgcagaaataattcgtgctcctcaaatgggagaaaaagaagtccatgtacaaatagtttgcagtacatacatacggaaatacgtagtgtcctcctaaatcacgtggctgcctttacaaattggcgccaaaattcaaagtcttgccgccgtgcagccccgtgctgctcaacccggccggcacgtcgaacgactccagcgaggcctcgaccagatctccaccgtcgatctcctcgccgtcgtcgcatccgtgcagccatgtcaggttcctggggtcctcccggagcagcatggcgtcgtaccgcgagctcgggaacgcgtcccccgcggccacccgcggggaggatgcggccgcggccgcgtcggcggcgggcctgcctttcgccggcgtggaccgtcgtccagtgggcgtggccgagatgtcaccggaggaggcggcgggcgtgatccccaggcggcttcttgacgccaccgacgagaggccaccgctccggcgggtggtgggggttgcgtcccggcgcgccgccgccatcaggtgccgtgccgctgctccctgccataggctgcgcttcgcgtcggtgtctgtcgacttgttccgaccgccgccgccgctcgtcggagaaccgccgctcgcgccgcgcgggctagagaggtcagcagtgcggcgagcggcggcgctggtgttcgctacgtcgatcttccggcgactgtcgctgtttcttgatgattcatgggtgaccgcctcctccctccgtgcgttcctcccggccgagcgccacctctgggctgccgtgctcgccgccgccatgccgttgccgttgctttgcttccccgacgccggcgcctgcctcggcttgctgctggacatgggcggcggcgcgacacgggacgcgcccgccgcaatgctgacgtcacgcgctcgcggcgagggcgacgcggcccgtggcgttgaccccgaacgtgccacggagttggcgccacgtctggtcgctgcaggttgctgacacgccggggcggttgacctcgggctcgacgtgccggcggcgccgggcgtcgcgcgctggagcgctccgctcgacggcgccgtcagcgagggtctcgacctggacaccagcgacgacgcgctgggttggccggcggcggcggcggcgccgaacacgtgcagtgcttgtgttctgtccctgtgacggggccaagccgccccggccggcgcgccccttgcggtggccggcgtgcgtgggctcgtcgacgccgacgacccccgcggcgtcgagcccacggacgtgctgctcgccgtgttgatcgacgacaccgacgccgacgacaatgtccggcggccggagaacacggtgcccggcgcgtgggcgacggtggagagttgcgacgtcgcggagctgctcctcgacagcctcgacgccgggggcccgttctcccgccgtgtcaatggcagctgcttcgcaatcgcaagggggagaaatgggggatcaaacaacaatttgcaattgcaagaggtgaaaattttgatcgggtagggcgagagcgcatgcacatacccgtgaattccctttcgcgtatggcgccgagctagctctttccagccggctcggcggcggcgcggcggagacatggtggcctgcggcggcgctcgtcgccggcgaccagagtggcgacgccggaggtgtcagaagcctgccaacgcaattcggtaaaagaaaaacgtaagacaatttttcatctacatttcggggtcaatgcaccaccgattcatccgtaccaatcgtagtcatgcttctcggttcccgtcgacaagagcttgccgccgccgccggcgtctccaccggcggcagcgggggcggagctctttgcctttcccctcccatccggagctcctcctccccctgcattgcagaaatttcctcgttctcagcaagaacgaggagggattgaggagcggacaatctcaatttctcaccggcgtgatcggaggcggcgccgcggcgatcgggctggctgctccgtagctcggagaagaactcgatgctctcgtccttggccgccttgctccggccgcgccaccgcaggagaagcttcgccacggcggaggtggacggcgacgacgacagcggcttcttcttcgtcgtcattcccggttcacgatgtcgcaaaatcgcaatggattctttgatcgcttttgggttatttggctttattgcaaatgagaggagaaaggaggcgttcaaggaggacagggcgttaatttataaaagccgttgaaactgtcctcaatttggcattagggattgaaactgtccaaaatccaatatgaaattctgatcgtctctaatctttgaaccatttctctaaaaatgatttaaaaataaagaataccataacctgtttctaagcctcacactttagtactttacgcatcttgaaagaattgtgccgtccgtggcatgggtttggagtttagactcacgccgcgtcgccgctatggtgtgataaaaaaaatcaaaatgtttatatttaaaattgatttgcacgtacgtttctttttatgctttcagcaaattattttaaaatttcatctgaaaatttcaatgccagaattaaaacaccgacacaattgtctaagggaaagtcttcacaactgatttgattcatgcccgagcagttgttacagatatgatctacatggacgaagccctagtaatagaatacgaggatacagcttctgtaatgtaaaaaatgcataacacacagggttatgcttattcattcaaccctctttaatcttcggttttgctataattatacacaagccttactccgtatgtaatactataaaatactgcacactcgatttttgtcacatggcaagaaataactagttccgcagccactcaaagcaacagcagaggccccagcagaatttcgaaggataatctcttatgaaaacatccctattgtagccgacgacgtagaagctgaaacattgcttgcgatgagccattgtgacacggatcacaggcacgacggagatgatgtgcctctcggaaatgaccctcgcggacggtggaactggaagccggctagctacgacttctgaggagaactggttgagctggtacgaatcggcgaagaatgcaggagtgcactggtacgcctgtatgttgcatagctgaatcccctgggctctgtggaatacttcgtcaggcacagaggcagctcccctagttgcgctcacttttcttgctgacagtgtcttcctagaaacaggaaaatttcaagttagatcaacgcattacgtaattattgaaaaaaaaaacgtaaagtattttctccaaaacatgaataaaaagcataaaagaaatttcctgtagaaatcatagaggcgttccttcaaaccataatgtgcatatcatcacgttataagtgtacaaattgctttgcttggttgatggcaaatcatggagaaacgcctttttctactatgccatgcataagttacagatacactgatagctttaggagatgcgactgtaaagcatccagcaaatgaaacattaataaataagttccctgaacatcaccgaggtattttgtatgaatcaactaatatgctaggactctctctaaaacaatgaaactaatatgataggccaaactcacaattaaagcatcaattcacaagatctacaacaacaaattctccactacgcttttttttaccacatttgcaggattactgaactattaaaccaatattatcatgatataaagcattgtagcaattataagttcctttcagccatcacatattttgattttattttcttgttactatacatcgtctcaacgtaaacactaaaacagcaacagcagaaaaagaatcaaattaccatcgaacatgagcagtgctttttgcgagaagggaaccatagccactacatgtcttgcatgttactaggccacgcgatccacatgctatacaaggcaacattcctttaccactgcacattccacatctgttacaaataaagatacgcacaaagtgagcattttcaacagaagtggcatacttttaccagtagatgtaaaatatctcaataataggaaagcatttttcaaattttagagtactattttctatctaatcaggcatgaattaaaaacttaaataaaatagcaaccattgacatgtaaatacaaataaatatctagtggaccaaagaacaaatgcaacaatactgccttaacatgtacacaattttaccaactcaaattgaacaggcaaccaaaattaggtgattaatgtggtgatgtgcttctttagtggcctttaaattaggtgcaaatgtgaactatttttttagataatgacactaatgtaaacggcgagatgtagaactaaaaaacaaagttagcagcagaagtgcaggactaacactgtatcagatccatcttggtgagcaagtaaacccctcccatgacatgcactgcaacgggtcatctgatttgccttgtaaaatccgtgctcctgaccagcattgcaaataggacatggtatctctccacgactctcgcaatctaggagaaaatttagatcagaaactagaatattcaaaatagaaaaaacaatgatgaataaattatgatatgtgccgtgcaaaacatatataccatcatactgataggacaattatagtataaaggaagaagccagaagtgtttgataagaaaaatatatttaaggagtccaactacaaataattttaagaaagccaaaggtcattccgagtctttgtaattgtaagacttgtttatttgcaaggttggggttttctgccccctcctcgtgtttctttcttgcttaatgaaatgatacacagatctcttgcatcttttaaaaaaaaactatctcctattatcttttctcctgttttggtgagttcaagtgtgtagtgtcagtgttgcaattcctgggtgggtaggtgccagagtttatctctaacgccgtccacctttttccctctatcttaatgaaatgatacgcatatctcttgcgtgttctaagaaaaatgatgtgtgttaaaaaacccaaataagtgcacatatcgattcctatataacatcataacaacataaacgaaaagaattaaggtgatgatatacgatgggacgaaaaatatatttcagaactttagctgacgcttagaaggatatttgcagaatagataggaactaggacaaccgcaagaaacacagtagttgtagttgggaagtacagatattacacaatcggcaaaagaaactatatgactaaatgagtgcttcagaatgaaaaccatacctaagcatttttcaattacttctgagtgagggatcttgaccattacttctttttctggtacaaacagtagaggaaactcagacctcagatcaagttcccacactgcaagcacaggacccttgtctcttccatctattttcccaccatcatagggttccttgttagttacagtgtccctttcctcgatgaaagtttccaaagttccaacatatacattgcaatcctcaatagaggtaattttccatgtgcgagcaggcctacttccccagcagcaccgatgcccaacatgatcaataaggagctgccggatctctacctcatccagtacatccctgtcagcatatttcaatcattccatgtgaagaattggtatgatcttgggaaagaaagcattgcaggaaaaaaatggaacaaaagggaaataatgtgcaggttagctatggttcctttccttttgccatcagagaaaaatgaggaatcattatagatattagtgcaaaactagttattccaatgctccacatcatcaatctctttttatctgtctaacaatctggtacttctacaaatattctaggtctttttttctcgaaaacacaggagagctctgtttcatttcattaagaaagcaaatatatgtacaaagaaggggtcaaggaaacaaccccactacaaccaacccaagcgatgctcaataacaaatattctaggtctctagagctttcttccttcaagatgcattatccctcaactacaagtaccaagtcattcccatcccaaatcacttcttgccactcttcaaatttgcacaggacaacagaccaagagcaaacagtgttttcatttttatgagatttggggccaacggacaaaccaagtatcaatcagcttacataagttggtcacaaagacaataatttagctgttgccatgtacttttttaatactggcacaaattaaattaggcatgtgtgtgctgttgaaagctaactgcttgagcagaatgcacaatggtataactaatgtttggaaatatggattaattgtgatttgaatatttcagctgtgcgctgatgtactgagaatctgaggttatataagcaccaagagaactatttccaggttgacttttggatgcagccagtattttctctgttgaatcctatatgcttatagtggaatttatggtttttagtgaaataatatatttctggtcaatcttatcaaatacagtattttgcatcccagtgcttattgctcattcgctcattttccaagttttcccccctttttttccgagaatttattcgaaggaaaattcaacaatttcatattagtgtgcacgggcattatctcttcattattattcatgttaaattattggtttgtagatggagttgaaggcaagatcagctaaatcaataagaggcaacccaacagatatttattttggattttggaggctagaaagatcactgcactatttgaccatcatgtgaatactacctattcaacaataactggtaaaaggaggtggcatgcatcaggctacaatcagaaagatgactgaattggccctacttacaatctgagtatgtgtaattggcactacattagctagcaaattgtcaaaatctttctggcctgactgtgccatttgtgcagacatatcgtttcgcaatattatccaactggccactgcaacaccaaatcaaaatattgcacattccgcttgctaaatatgagagataatctggctactgcttgccaactagctggctactcttaagaacctttacaagtacctggcatgggaaaaggaggcgcaaacaagttcagaaggggacatataggagcaactgggattcaagtagggtggatatctcacgcgttttaatggacacagcgcctctctcttatgttcgtcttcggtccccaatttcttaccacgttcacacttcatactacccattttagttatatgatcttgcggcagcaggatcataacagctaatcagcaaatacccgatttcgattggaagtgctcaccttctgccatcatgagaaggctggtattcgccgccatacgggtacggcccttgaggaacaattgctaatcctcctgcaaggtataaccaactgatgttagggtcacggacacagctgatgcgatgcgaaatgcagagagacgagaagaagaagaagaagaagaggcgatgcggaatcaccgtgagggtgcggagcagtaggggcagctggcgatggggacggggagtggatgtccggcgggtagacgtcgtggtggagagccggcggcggtgggtagtagctggcggaggagatcgacgcggcggacctgacctccgcggcgctgacctccggccccacgccccagcccgctcctcctcctcctccgccaccgccgccgcgcagcgccgacgagctgctgcggcccaggtactggtactgctgctggtgctgatgctgatgttccgccgctgcagggaacggaattcgacgaaacgaggcaggcagggtgagacgatcacgagacggagcctgaaatgggggatcggggagagaacgagggcggacggcgaaggcggtggcagtacgcctacctggcgacggtggcggcggagaggaggaggagaggagggggcggcgctgctcctcgccgtcgcgctccgcctccatggtcatcgtcgagttgggggttggtctcacttggctcgcgagtcgcgagggggattataacggcatgagctgcctgcagctctgtaaagccttcgccgcgaaggagtctcggagggaggaagtcaggcggccggcgtcctcccgtctaaatcagatgggcgcgtcgctgtctccaatatgtgattgaggaggacgacgacgaagacttggccagctggatgggctggccgctggcctgcctgtctgggaattcactgcagcccgttcagtatagtagtctcaactcaaagtaaaaaaaaggaaaaagtacaccgaaggtccctcaacttgtcatcgaattacaaaatcgtcccccaaccgcaaaaccggatacaacgcatccctaaacttacaaaaccaatgcaaatttggtcctttggcggttttgattccagttttatccaacgcgacagctgactcagcgtgagacccacgtgagacccacacgtcagggtgtccacgtcagcaccctactctcttttcccctcctctttctctgtttctctccttccttggcccgtttggttggagggagtttttaggagagattgggagtttagagggatgaggctattaatagttttgtttagttgggagacatgaaaattttggtgggatgaggatggggaattgaggaaggaactccatccttttcaatacctgggtaggggcaggtaattgggagggaattcctcctttactttgtttaagcaaatctcagccatccgtttttattaatgacctaatctccaactaaattccctatcaatttccatcacctctaccaaacaagatattgggattaaaaatcaaattcccatcttaatctcatcatcaattccctcgtgtaaactcccaatccccttccctcgagttaccaaacaagccagcactctgctctcgcatggggacggcgctagggctgtgtcacgcccagaaattcacgaaccagaatttctaagctgaatgtgtattaaacccctgtccaggaccagccagggtacacaaacgacaattgttgacatacagatccacgtcttacgaaaatataaaagattacaaatgcagcggaaaagataaaacgagctagacttggaaacttgacttctgtagcggggcgactccactccacaggcaatcattgacgtcagcgacgaaaccaactttgacaagacagctcccactaggaagatcttcagctctggtgtgggggaaaaagagcaaggctgagtactacccactgtactcagcaagtcataccgggagaggaggtatgatgcaggatatatccaaaggaggctaaaggctcatttgcataaagctagcatttaaaagcagtagttgaaagcagtaaaacagctgtagtgatttatcaatattaaccaatcactgtccaacgctacccacgttgcaacaggcccaaaccacctcctgaactaaccagttccataagctaactaggggtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatagcaccacaccttagggttcacccccgtccccagcaggcaacgggcagcccccctttcgtgccgcggtgaatccggaagccgatcaaccggacaccccggccgacccaactccatcacgcccaccctcgcctgggtacgtcgactagagaaaagctacactacaagcccagccgttgcccacgctggcttgtggtaagtacggtaagttcttccagggcatcccgcgaaccggtccttaatcgccatgggcacgactaacaaaaccatgcacccacagcccaccatgtagtgtattttaattaaccaacaccattacggtggcactaaaccaaagctatgccaataatcaaagtctatgctttaatgtgatccccttttgtgcactagttgaactaagcatggctaagcatctcctaaaccaacatctagtcattttaatacccaagttatcaatagcgtaagggaaacaacatatagctgagtaataggacccatcccacatgatattgtaaaacaatgcaatatttaatagaaatgcgggacatttgtaaattgggtacaatatgatcaattgtaatgtatgactagccttgctttcgcactgatgagaccacagcaacttcttcgagaaaccgtggatcgacgaaacggccgaaatatacacgacagacaaagcacacaagcaaaacaggctataagactactgaaagaggaaacaaaaccatttttaatagattctgtgcatttttatgaatttactgatacttgaatggacttaatcggagctcgaatgaattagttatgatttttagaagattctctgtgtttttactattaaagaaaagccttaatatatttattgcgcaatattgccccagggctgacgtcagcaagggagggggcgccgacatgcgggccccacttggcagtggctcaaggggccggtccaccgtggactaggaccacgcgggtggtccaccgccggtccacgggaccgacggcccagatcggcccggggccgatcggacggtgcgggcggcggcctggcacggctcagctcggcacaaagccggccgaccggccatggggtgcggcggcggcgcacgcgaccaccggcgacggcaagcggcggcgcgagtggcggcgacggatggtgcacaggtcgacagtggcggctgaaggtgatggcaagcgcgcggagagcggcggcgcgagcggggaaaagtgggaaggagggaggagaggggctcctcaccggagggcggcgaccggagcggggatgaaggtggcggcgacgacctggcgacgaggaggggcggacgggcggcggcggcacctaaggagggagaggagaggggttaggggattggaggaaacccgcggcgagaaaaatggccggccggagttgaagggaatggaggggctcaccgacgtgcaaggaaaccggagctcccgaggggttcgggcgatgtgaggcggtgaccgaggtgctccaagcggcggtgaagctaacggcggcggcggcttggcgcggtggcggctccagtggcggcggcgcgcagctggaggcggcggcgagcggcggcgcggcggcgagcggcgcgagctcagtaggagtcacgggagggagcggcgagagcggaaaggggaagaggagggcacggggaacgttttataggcggagggggaggcggacgtggccgggaggacctccgatttcgccggcgacgtggggaggagagaaaggaaatgtggggattcaaaatgcgaatcccgccccttttcgggtgcacgcgcgggccgggagacgcggggagagggcggcgtcgcggggaagacgcgtggggcgacgcggcgtgggcgcgggaggagcggcggaggtgggcgcggcggtttcggtggcggttgccgacgtagggcgggcggccggaggaaggggatgaccccgacaggtggggcccacctgtcggcgtcccgaggagagagggaggggcggcttgggccggcccacaaggaggagggcgcgcgcggtggcggggtggactgggccgacggcccaagaagaggaaaaggagggaaaagaaaaagaaaaggaggaaaagattttccctgggatttaaagattgcagtttgcttattttaattggttaaaattatttcgagagctctgaaaatcccactaaaaatcttgttaatgtattggagcatggggaactcaagaaaaattccaccacgccgaatttgattattaaatgcatttattagttaaggattcaactctaggttaattcaacaatttctttaggcaatttatttaacaaattttaaagctggaaaggggaacttcagggcgtgacaggctaccacccacagcagcgcgcgcggccggagggtggtgcagccggcggctcccgggtggtggccgtgtgctcagggcggcgcaagctcgccggcttccccaatcccctcgtgcgggtcggccggcggggcgaggcaggaaacgggcagcggggtggcgtgggccgcgtagcgacgcggcggcggcggcgtgctgggcgcaggcaggcgccacgacgatgggtgaggaggtggaagtaggcgcgggcggcggtgggagtagccacgcgtgggcgggtcgagagaggcgcagacgctgatggcggcgcggtagctagctttacgtcgtcgttgatctcatcgatgcgtggggtagcaggtagctcatggacacgttcacgaccagagcgatgaggaaggacatgatcatgttgaacccaagcgcacggcaccctgcaggatcagtcggtgcatcaatcatggtcgatgacagctcctcaaggttgccgcggacggggcactagatcaatgactggcgactaccgcgcgacgatggtcagggagtccttggcctccacgcgtgggggagaccctcctgctccggcggcgtgggagggcaggcgcgggaggacgaggcggaggcggatggcgccaacggggagagggaggtcgtcgccgtcgtcatccatggccgcacgtggaaagacgacggaggctggcggcgtgggagggcaggcgcgggaggacgaggcggacgcggatgccgccgactaggagcgcgaggaagccaccgtcgtcatccatggacgtagatctggcgtccgcactatcggctgcagcggcgagggcggcgtggggggaggccctcctgctctcacgtcgtcgcggccgccgccggtcgccggcctcccgacatcctcctctcctgcctggcgccctcgctgcgccggcttgcccggactaagaagaaaaagtgagagagaggaggaagggagagaagagggaaaaaagagagagaaagtgatgacgtggtcaacctgacatatggggcccacgtgggtctcacgctgactcagttgccacatcggataaaaccaaggtcaaaaccgcctgaggacctacagtgagtcggttttgtaagttgagggatgacttatatctggttttgtggttcggggacgattttgtaatccgacgacaagttgagggaccttcgatgcactttttcctaaaaaaaaagcaaaaattgcaaaaaccgcccaagatatcaaagtatgggaagcagatcgtctgacgttgggcggccaacagagggacgtcgggcgtcgatccatcgtccgatcggcatctcgcggcgttgttgcttccttcgttccgcatcgcacgagcgcagcgaggacgacccattcagcctatttacaagcaaccgtggagggagaagagggagaaaaacgaacgagactgctcgtccactgtcgtacaaaaaaaaagaaaagaaaaaccaatcccagcatggctgcccgccgctccgttgaggctcgccgccttcctcgacacgggtgtgggaggagcggaccaccgaggaagactccttcgacgtcgccctcctctatagccctcggccccatgtcctcccccacgtgagagcttttaggcatcggcatcctcgacaacgacggcttctacggtggcggcggcggcgccaagctgttcaccaccacccacgtcggagggatgccaagagccgcacaaaaacaggagaaagggtgaccactgctgcctagcccagaaaagcttcaaaagccctgaagttttatgattaagtgcagaaaagcttcttgttgttcattcaccatcttcatcgccataagaacagcagccgaaaggtcttttttttccctccatccgagtatattggtgcccttttttccctccagaaacagagcaatgaacggcggcggcacacggcaatgaggatgcttgtgggccattttcactggcgtgggctgactgcgatcctgtttgaccgccttattcgttgcgctcgtgcgatacggaacgaaggaagcagcagcactgcgagatgtcgatcggacgatggatcgacgcccgacgtctctctgacattggccgcccaacgtcagacgatctgcttcccaaagtatgagattcccctataaaacgattggttacaaataggtcctcctaactcatatttatttgatatttctcttcacttatcattattcacgtgttatttttctcttttacatatgttatatgatttctattgatgaatacgactctagacacatctttcaaaaaaaatggaccttgatcgtgttgagcatctttttcacttcgaatctaccaaagaaaataaacacaatcaaaccctatgaggcgaccattggcaggtttgatccaactaaaagatcggtgtgcaatcggatccacagaaactgggtaaaactggactattagaccactgattaaaccggcaggtctgatccaactaaaagatcagtgtgcaatcggatccacagaaaaccgggtaaaaccggactattataccacttattgggaggaagagtcgtatagctgtccaaggaggcacgtgtcaggtatcgaaccccccaacctccctctggaggcatgcttccaccactaggccatgtatgtgttagtgattttagtacatatctcattttagttgaaccgggttgagccagtggttcaatcgagcaaaccaagagcgaggcttagggtgatatttgggatgttttttttaactagcataagggtgtgaactataggataggatgggatgttgtatgttagattaacatatggtaataaactgttaaatatgagtatcatttatgatatgttggatctttcggtgacagataactatcttttgggtagggaatgacgttgatgatgtggctacaataggtttcacttgcatgaacatcaaccctcaaaagagggggtggagagttcaatagtccattcatcaatggattggttgttactcacatatatttgagtactagtaaaatgctcatgctttgctatgggtaaaagaaaatgctatattataatatgttataaacaaaaatacatttttttattaaatatgttagaatcacttgtttgcttatttaaatatatggtattcacttattttacacaaacattggactatagattagaaatatcgagggctacttttacaaagggttaattggatccatgccatgcaattttgctgatttgaaaaaatatcactactattcatgatatcggctatgtgccgctataatttgagggaattggaacagtgccacctcgtcacaatttaaatttctattaaaaacctccgttagccccaactgcacgtgtggcctagcagtaatagagtcaaatgtttttattttatttacgtgagagtcaaatgcttcttaatgtatatcttgttaaagtctagcgcttatcaaatacgtggttgcatgccccataatcgatcaggtttcgtaaccgtttgtgttagagcagattctttgtcccagtagtctaaagaataacttctttttcgatcgatggggaagaactcgataagtcgtcttgcgaaaagtctttggcggcgatgcatactcttgtttagtaggagtatgcactctaacgttattagcggctagtattctcattaatatagtaataggttaacactacgaaggatatagaatatcttatgcttttaaatatggttagaacataattatttatttaatttgtttcctatttttagcttatggaaaaaaaagatttgcaatctgaccgcgttgccgctgcctacctacacttcccagttccactgcttcgagcccagatcgtatatatgttgctgcaaccgggacgcgcaccagcacccgcacaccatatgacatggcacgatggacttctcgtaaccacgccagacaagatctcgtgactccaccctccctcccccgaggaatttgcatatatgccactgttaaaaactggcttcgctcgaatgccatccctaaaatgggattcgctctaatgccactgttaagatgtgggcgttcgctagaatgccatttttcccgtttgttgcaattgcaaaacatttttcatcaaaatatttttttcttgggcctttttcatcaaaatatttttttctcggaccgttttgcccctggaccaaatcaacatctctaccagtatcgttctctcgtctgttccaggcgtgaagacacagatcgaggagaggaagaacagatggcgacgacgccggcgcccggctggcgcgccgccgcatccactagctagcgcgccgccgtcttcccccacgtcggccgccgctcttcttccccacctcgccggcgcagcttctcccaccgcgccgcctctcctctccaccacccagtgaactccgccgccatggaaggctctctctctcatccttccaatcgatctcctcgacctgctatgctcatcccgtcgaaaagttcgattcttttgctccgatcgtttcgctgtagatttggttttgttttatttgtgttttgcttttcttttggtctctcttttttgttggatcgatcttgtctccgacgatgtaaatttatactttcgttcttctgaagttggcaatgtggaagaactatatggagacctgaactgggggttcccatcgatcaaatcttatcattttttttggtttttttagttgagatttggtcaggggcaaaacggtccgagaaaaagttatttttatggaaaatgtaagcgagcgaaaccagcttttaacagtggcacatatacaattctcccctccgcccgtgacggtttcggcgacaaaacgaaacccgcccccacccccacacccaaaatccgtgtgcgccgccccgcacgggcgcgccccccgtcctcgcccccgtcgccgcctatatcaccgacgaccctgctttgctttcctcctcctcctccttctcagcgcgagttagatctccacaggagagaatcccaatcgggcccctcctccgcccctctccctctcccccctcaccgtcggcctgccggcgacggtatatcgaatcgaggtcagtcttctcgtgctccagtcattggggtttcctctgcggagggatcctccttggggttgggtcgtcggatgtctcaccccagagggattggggcgggggatgtcgggttggatctttccttgttgctgtcgttagctcgttgcgtacggggaggtgggggaaaaagacggaagtagctatgcgttctttttgtgttagcttgcgtgttctgttgtattccttcctaattggtgcggagaatcgtgctaaatgtgtgtgtttgtgctcctttctgtcgcagtgctggagcagctctccatgcaggaatcgtgaactgctggtctgttttgctggaccgagacgattgctttgcttcatgattcttgccgatgctgaccgtgttgcattgattggaccggggcatgggaatctctgaatctgaatgagtgccttccattagagtgaacatggactcaagagttggagtggtcctattcttcctgctctttgtccttgtccgcgatgtctcagcggtcgctgagacagaggttggcgttgtgcgcgtcgtgcaggaagcgcctgataggaagcttgagggcgcaggcgggcaggatgggttcaagagcgggaaggtgccggtgtctacggtcgcgtggtcgacgcttgcaatggccgctgccaccggtttgggtgctctgccattctttttcctggagctagaggcccagtgggcgggactttgcaatggactcgcggcaggggtgatgttagcggcgagctttgatcttgtgcaggaagggcaaatgtatggcagtgggagctgggttgtgtttgggattttgagcggagggtttttcatctggctttgcaagaaggtacttcctgtttcattctcttcagttttctgtgatatcacttatggagtactatttagtacattagcattttcactaatctacaaatatcaaatcatgtacaaatgtatttaaacttgacggagctagtcatggatgtcataaagacccattcagttcatatgttcatttaaatggcatgtacaatgtacatatcaatacattaacataattaagattgcaattcacttatacacatattgttgtggttcgtggtagcttctatgttagaacactggcattcaaaagggttttcctctgtcctaatatatgttggcatactcataatttcgttgtcatttaacctacttattcctgactcctgaatccaagaatcagattctaataaattgagggcgtgcaatattcaatattacatgttgaaagtgcattcactattgtacttgcatattaagtgcattcaccatcgtaccagtttggtttgatggttgtgttttgggttgtcgtcaatatatttctttacatgtatttttgttatttatctcttacttagatattttgtattatttcattttacacagtttcttgagcaatatggagaagtaagcatgctcgatataaaaggtgcagatgcaagtaaagttattcttgttgtcggaataatgacactccattcttttggggagggctctggtgtgggtgtttcctttgctggctcaaaaggattctctcaaggtcttttagttactatagccattgctgtacacaacatacctgaaggcttagctgtaagcatgttgctatcatccaggggtgtatccccacaaaaggcaatgatatggagtatcataacatctttaccacaggtgcacttgctctatccttgaactgaaatatgagttacctgataaatgtccttgttcttgagtcaacatgaagagttctctattttttagttatagacttatagtggttcatgttttgtagccagaaaaagtgaaatcagtttttttccttttgcaaaggggctacaatctgaatttccttttctataaatttagttactatactatttcacttttgtgtctgtgtgtacatgtgctattctttcagtaaattgcattggcggtacacgaatttgttaggtgagtgcaatctagtgcataaacttgtaaaatgctcgttttggtgtacggacttgcctggtggttgtgaaccaaggccaaaataacatagcaaggctaattttaccaagttggacgttgattaggacgtgatatgcacatatgagatgggtatgagatatgctatatttataaactcggttcctacattaaccttctttttgtttacacccttgcatcattactcaggttttttatgtctttctctaacaacaatcatgccttattttaccttttattgaacatatatatgtctatattgcgtcttctcacttgcatgtttacatcgcatcctaatcaccacttaaatcgatgagattagccttatggtgtccttttggccttggtttgcacgcaccagacaagttcatgcaccaacacaaacattgtacaagtttatgcattagtttgcacccacctgacaagttcgtgtaccaccaatgtaatttactcatgtttcttttgtgcagcatagcacattggtgcatgcatgcgcatttgtgaaatggagttacttttatgaataatatatgatgatctttgtccactgattttttaaattggaattcttccattgctatgatcgttacttattagtgcaattataataatggtagcaagggaagggagcattctttgtggtggcatactcttcacaatttcctatcttgcttgcatatctggtagttcctcatttatgtttggtggccatctgtgaagctggacatgctaggacttaaacgccctaacctgataaataagaaaacatggccatctccaaggtcctaacatttgttcgagtaaaatcagcatttaagacttagaaacttttgctgaatgcctctctaccgctccttccattctttttcagttgcagttcagggcatcaacacttctccaatacacatgtctgattgttgccttttcaaatcatatatgcatgagaattattttaaaaataactacatgaaagtacttttttgtgacaaatctattaatgtcattttaacatattaaatcttaatgtttttgcatatatcattgaattaagagtttgagatttgattgcacgcattctaaagtgtcatctaattgaaaatgggaggttgtaaacttgtgagaagccatcaaacttatcactagctcgttatgcatacttctgtagattttaggaaatttagctcagtaacatcacaaagaagcaaaattagagataatattggcgcatcacaaaggatctcaagtgttaaatgaaatatcacgaccatattgtggaaaataacaaagccatagataatcacttaggctatgttcggttccttgggattaaacccccaaggggaacctatccagggagggattgagtggatccctcccatgtcacttaatccctgtaggatgaattcccttgattttcctaatccctgtcttcaaaacgtttgttcggttttggcttggtgcgcctgcttaaatcccgtgtcaaggcagcaataggcaacagcaacaacagaaggactggtgctttcctgcttcaacgttgcacgctgtccattgagtttagaatagcaaaattgattttcaggttggcagtttagaatagcaaaaaaatattgcaaaccgatatttttgtataagtgaaaagtgcaacatgaatgaaattacacttcagtaaaaaaatattgcagtaacctcatcaattacgcgaaaaccacattgattaatcattaaaacaaaaatattgcagtatcatcaaggcctgtatccggtttaaggcaaggaggcatcacccaacaaagcttgaggtcacttgacaatacagagacaactaaatacagtcatagaagtgaaatttgacaataaaaaaggaaaaagatgaaactatgtcatgattcacttgagctataaaaataaatgtgagctgccacaccaggactcctagaccaaatggttacatcagcaatatacaatggttcagagatcaacatttgttgctcctgcaaaaagccatcatcttgtacatgtctgctcattcactctgtatctgaactaccatcctctcagacttcctcccaaagcctgtacagaagaaagaagtttccttcagttttcagttgtaaaatgcaataatttaggcaatgctttcgtgcagtgagcaattgtctcaaatttcctgaaaccagccaactattgatcctgggcaacatttttaccaagttttcagtttgacaagtgattgtttgtaagctgtattgtgtgctttgcctaatagctagcagtgctagaaacatggacatgcatatgagactactgctagcagtgcttcagatatcaaaatgaaattaggacacatataagattgagcaagcaaaaaactgaattcaatagtagctacagtagaagcaaaaatcagtagtctgcagattaagcaagcaatagctgcaaaaatcatgttttacatccagaatttcttcattagatggttctaaaaaagatctactaaaaatggaccaacctaggaaaatttttagaccatttgaaccatgtaccaaaatagttcagtttaagtaagttgtattctgccgactgccaagagctttttacaggcctgaactaaagctgcacatgactcatttttcttactacttcaatttgaactttgtactttgttcagaaaatatggcatgtggaatggctcattgatctacttgtattatgggcactgtcaagtatgggtgagattacaagagcagacaacttgttggaatcacttctgatgaacaacagttgtctagtatttctgaaaaatgaacagcattcacttctgatgcctcaatattattacgcactgcatgtttttgtggcattactattacctgccaactaatttttagaataaaccattttcataacctttatgtacaaatttaaaacaactcacaataagaatcagaaaacgtggtctttcaactactcaactaccaggagaatcagcatattctcactagggcactacaaacagaggatcagatccaggaaggacatgatcagagcttcagactaagttaggaatattactcagaacaaatcaagggagaaagaagaataaatcaagaaaccttgtgaggaacaaagaacagatccatgtcttcctgcttctccttgccatagcgcttagagcttcagtggcgccatggtgagggggtgtgatgctgcggcgtcccccgccatgcctgccaccgtcgtgcgccgccgcagtagcacgaggccacgggcgcaagaaaccctaacactagaagaggaggctaggggagataggaagtgaaggaactcaccggggagaaggtggccaccggaggagtcaactgccggaggagagagcgtgccgtcgccgtcgcgtcggagtcgcgctgcgctgtgcagctgtccccgctgcagcgccccctctctttgtgtcgctgcgtcgagaggatttttttcctcgccaccagagaagctgaatatttcccggcctatgacgaggggaaaacaccggggtgggccgggataaaatctcgcctgggcttaaccgaacgcctatacttgcgtgggccggtatcctttccacgccgggattttccacggggattgggctccgatcccggccgagaacggcccaaccgaacaagcccttaatggggattgccactattattttccttttacttgccaatagtgcaacttcctgtcagtatttcattgtgagcgaaatgtttgtctacttgtatgcaacagcataccaacttggtttcaagctacattttggtgctgacattcttttgccttccacactactctgaccatgtgttcatttttcttggttaatacagccaattgttgctgtccctgcattcctttgtgccgatgcatttcaaaaggtgcttcccttttgtactggttttgctgctggatgcatgatatggattgtaattgctgaggttcttcctgatgcttttaaggtgaactctaatcatttagttagaagatctgttaatggctgaatcttctgttccattgatttgtaaatgcagttttgctcatcttttccttttcatgcaggaagctgctccatctcaagttgcttctgccggaacgcttgctgttgctttcatggaaacattgggtacagtgcttcagggatttactgatggccacaagtaagtttcctctatacaattccggagtactatgtgggtactttgaatttctgattgatgttattaatttcttctgatctgcagctcagaagatacagcaggctttttggtatcacttgtatttggactaggtcctctttttggaggaattgtacttgttgcattctctcttactttcagcatgccacaccctcttttgactggtgtagcatcaggcatagccttccgtctcgcagcatggagacctttacaacttctaatgtcatcgaagatgggtctatttaccaccttattcctcctaattggaggttctctcatttaccatgtcgccacatcaaacatccttcagctagttaaccgcaagaaatcttctgttaatgtaattacatcatcctcaggcctctcacttagtgtcctcacactgcaatcgctccttgcttgcggttctgtcttccttcacgcatatgctgaaggtcttcaacttggtgtggctgcgcgcaaggcttatggtctagggcgctacatggttcttccagtttcccttcatggtctaccacgaggtgctgctgttgcgagctgcatatatggtgccactgatagttggcgggcagccttggcagccgctgctttgaccggctttgcagggccaagcgctgccatcagtgcaatcctcgcgaagattgactacagtggactagactactggatggtcattgcctgtggtgctttgattccaagctttggccgagtcttcaaacgctcgctaaggttggacatgcggaagagcatctgtgggcttttgataggtttcgcctttgcctctgtatgcctgatgtcgaccagattcatttgcttgcacactccctactgcaactcagctccagaagcagtcacataacctttcttttctttgctggtacagttgtagaacatgtaatatcagtgtaatgatgatacaggaatggaaaaattattaccgttcaggttgaggaattcccttgtatgaacaaatcaaagggaaataggcatggaatatataccggtttaatttttgtcttttcacctgttcgtcctgaaaccgtggattgttgccaaccttgaaagaaaaaaaaggtggtgtgcaagttctggtttactcaactttttatggtgccaggtggtactatactggattactggcaaagttattgtaagatctgctttattgattgatggatatctactttagggtaaaatggacaaactgtacatctgaactcattctggtggataaaaaccatttagtttgcaggagattaaactcattaaccgtagcaactgatcagcttttcttctagttcaagctcaaatctagcaaccgtgtttatggcatatcccgtgttttactgtttataataaataacagcttcttcgtacctccaaaagttgcatgaaggaccatgtactgaagcaacataattccaaaagtttctccaactcatagtacttgatacttcattccagttttaagggagaacccaggacactgcactaggacaagcaaagtttggaatttttatggtgatgtgaagacagagaacatgagatggagtgatggacagtaatgtgaattgtaaaatagaccaggcatatgaaagtgttaccgtgaatcgttgcagcagtatattgaatttccatagcagacttatttcagtgtcacagtatttaatagaccccgatccaaataaacaatttgacaatcacaacataatgtggtgatgtttagcgtaatggaggaaatttcacaaagaatttaacaaggaaaaggtacaaatatcataaaagtttaggatgatatcccataacctctgggtgaaaattaggacatatactataattatttagccatatgcattggttttgatgcaatgacctagactttaatgaaattatttggactttcacacacaacttttctttttaccattataaatgttgatttaagatctaagggttctaatgctgctaaaacatggcagccacatgttagccccatgttgcttcctgagcacttttgtaaccttgctaattgcggacaaatagagcggcttttaccaagaaatgagtcttttggttcataacaatatttcatcaagaaggtcgttcggcctccactcttggtcattataccatatttcaatattctagtcatcataccacctttcaagatcttggccattgtcatgcccactctatttggtttcatccattgtctctgctctcatgttagtaatgtcatgctctggcttgcatgttaactgagaggatatatcttggcatgctcgctcgacaaggtcttaatcaactaatggtagagaataatgttaggcgatgcttttcatttctgaaggcattaggaaaatatttcattaagcctagagcattttagaaaattatatgaaaagggtttgcactttgttatcacctatgttgacaattgacaaggaacccatacaagcgaacgcttttatcgtggtagatatgtcaagcatgtaaggcaagaaaaacctacttgaagcgctcacaatttttatgcctataaagttcatgtgatttatgatgttccatacaacggcgtaatatgcctactcagaatttgtatcgatgagaggtcatggaatttttcttaaaggcatggataaattggctttaaaagagcagtcgttttattcatctagcaactatgatgctatttcacattcatggtagacgttttattaggagtgtgtatgtttctcaccaagctcgctttacgagacgaggtgatcaagacaggcaagctgaggcaaagtcttcctagggctccaaatgcaacttatgtttttttttcttttcctaattagtacggttatacaaatagccccccatcaacttaagtaggatatcatgtaagaataaggcaattatgaatgtattatgtcttatcttcatctctgtagcatcttaatcaaaattttcccatttgagcataccaagctagggctaccctctatatctcaacctagagatcagacacggtcaagtagatgctactctttcattacattccctgaaccctcttctacttaactattttataattaaacaattattgctagacaaaaggacttgatcctttataccctaaatttcctcataaatgtttaggttaatttaaactttgcatgaatatagaatgtgatatattgttttagtaatttaactttattgtttatttgcgaatcaataccaaggatttatttttggatcataggtcgtttagacaaaacaatgtgcaaccgcatacccattaatataagagagaatcccttatataccactccaaattaaccggttccttatatgccacttcaaattggctcctcccttctatgccaccggtttaagtttgtcgtcccttttaagccattgtcgtcactccaccgtcagttgaccgttaactttatagtaaaaagacgtatttgcctttgagagttggtatacaaccaatgataggtatttttcatttgatagagaagttggtacaacatataaaaattgattattattttttttatcacgtgcaattttagccatcaccataacaaatgaatttttaatataagcatgaaacataaagcttcccaacaatatttttaatacaaagagcatttttcactggttctgacaaaattttattcactcaaaaaggatttaaaataaattagttatgaatttttgaagtttacactttttttagttgggagggcatattggtcatttaagaaaaaactaacatttgactaacagtcaacaaacataatagtggtgggagtggcataaaagggtggaaaaacttgaaccagtggcataaaaggaagaagccaattttaagtggtatataagggaactggccaatttcgagtggcatataagggattctctcttaatataatcatagatagatggtgaaaaaatatacaattttgcctcttgtccattcttttccaaacataacactcaaattacagagtttttattcgtatatttattcactccattatatcatactcattcatatgcagataccaatataaatcatcaccttttattgttttttaaaaaacacaaggatgcctaagtcatattttcataacagtaatatccttatattcatgctagttaatgtacactttattagatgcatatagggaataccattctactttctcaataatacataatgtgaaataactttaggagaaaaaaaagggatggggacaacaccaattaggattcaagactaaagaggtattaggagttggttattgagatttactcttctagcatacttcattcgtctctaaaaaaggaatctagaactgaatatgacatatcttaataatacgaatttggacatacgtaggctgtgtcacatccagtactatgttggttttttagggaaggagagagtagtagggtatttattgttgttaaacgtgtgatgagaaaaaggataggctctgaataatcaaatcatgattagaacagggtgaaagatgaggagggagggggcatcatatactagttaaaaaaagagatcaaatgcacatttcaatctaaatgtataattattcaaaatttctttagtcatgatctgaggatatcgtctaatgaaaatgtttgaatttttttccaatggcatttagcatgcaaatagcgcaattgcttaataatatcctagctattatgtcacttatctttattttacttgttaaacatgaggccgaagatttaccgatgatcttcgtccttagaaaatgttaagaggttataaatatccgtatacggtacatgtacatgatgttacatgcacatgtgatgtgtcttagtagtgatatgtgttacggttacgtatataaccagaagactaattctaaatcactaaggtcctctttgtttaggcttataagccaacttataagtcaaaaagtctaagcctaaacaaataagcagcgttttcgtttggcctttttgaagccataagccacttttacactattaagccaaaagctaggttggagaagcttttttgacttatatgagttagatgtatgactctactactaaacttaggatattaaattcactgccttataaatcatataagccaataagctgacttaaaaaactaaaccaataaccctaagcctaaacaaagagggtctaaatcaaaataaaactagcataagaattaagaacagaaatacaggccgaggccaccaccggcaccggggcgagagaagcaagaaaaaaaaaagccaaagaaaccaaaaggaaggcaggcaaagtaaaccaacccaagcaaggggatctctcgaatctccccattccaggggcctcgtctcctcctcctccgcctccgccttgtagggtttcgccgccgccgctgccgccggcgatggagccaccggcgggaggctcctccgatcatcgccggggtgccgggaccggcgcgggcgccggtggggccgcctcgccgtcgggcctccgccgctacggcttcagattctccgcctccagcctcctgcaggccccgctcgctgcgctgctcgagtactccggcgtcgtcccctccggccccggcgccccgcaggcggggccgccctcggcgctgtcgtcctcgccgtcttcttcgtcgtcgtcgtcggaggccgatgggctgctctccgcggccgcggctggggacggggaggtctcgatccggatccagggcggccccggggaggccgacgcggcgggcgtcgcgggggcggcctcgtcgggggaggactcgatcgaggcgaccgccgccggggacgttgacccggcctcggctgccgcggggaggggtggcggcgccgacgcggaggcgagtggtgggggcgcggacggcgcgtccgggaacgggggtggggaccgcgcctaccagcggtatgacgtgcaccatgtcgcgaggtggatcgagcagatactgccattctcgctgctgctgctcgtcgtcttcatacggcagcatctccaaggtctaatactcattctcttgtgctcgtgccattgtgtgattataagcggtgtgacttgtccaaaacaaaatcgattttccttcatgttgatgtccatatattgtttattacaaatgtttaaccaaaaaaggaaagtgattttgtgagtaaaacaccttgacttaggcgagttaatgtttgtgattaggctggtctatattattattatgtgttaacttaacatctatgttaaccatttgagttcctgggatactattttgtttgttattttttttatcattatggtttagaggataatatgatcacttgattatagtcgacttatctcatatagtgggttttagcctgctttattagatgaacctaatggggagatatttatagcttggtattgctagttagctgccctaactttaaacaggacttgctcaagcccggcttcttatattaggttggaacttctctttgtgctacattatctggaggatattgtggttgggtaccagtcctaactcctaagttatggatcagatgacatatctgcgtttagttgtttaccatgacatgaattttctgctacatgattatctcctagtggtcttgaaatgatgattaagacgcatatatcatatcaggttcttagcttttaacatttattcctttggaggccgcaccaatcaactcataatttatgtgtttatgtgccaaccatttttttggcaaggcctaatgatgatacattaatattccagcagctagttgtatccaattatgcaccgcttcaattacttgcagttcacaatcttggatgttatattcatcttgccttatccattcatactatcctttacttttcaaagtgcatgccctctatcatttctgccactacaaccaaattgtttttttcctgtcaagaaaggtcaatggattgagttaacatataaatccatctttcaattgcatatctatttttgcttgtgcaatgattgccatgtaagcatttcaatacacactaaaggaagggttgttgtgcaggtttctttgtcacaatttggattgctgctgtaatgttcaagtcaaatgatatattgcggaagcaaactgctttgaaggtcttatttcttgatgcatcactttccaattttgcaatgaaattattttagtataacagaatcagaagactactggccagacctttccttctggtgtcataaatttgaatgccaatgactacataacaatataatcatgcattgt

SEQ ID NO: 54219 - DNA, 1339 bp, Oryza sativa
aaaaattgctgtgcttgtcgggattacagtaatcttcatgattcatgtgtttggtgtctattggtggtacaggaatgatgatcttctcagacctctgttcatgcttccgccaaaagaaataccgccattttggcatgcgatttttatcatcatggtcaatggtactgatgcttccttaaagggtttcttgaatttgctcgcatgcatttctccattatctgatagtgaactctgaccatatacatagaagtacctttattgacctgctagattaaaatttattgccctttgtaaatgtatgtacaatgagcaattttgtctcgtttttcatatcatgaaaaatcattcaaaatgacctttttttacttcactttctgctgctttttaattcaaggctttgtgttgaactcattagtttctcggtttgtattagcctttcgaattcccagcaaatttaaagatgctcttcagttaaatgtgtgatgaaaactaatcatttaataaatttatttgtacacttagatcattaaatgtgctagaaatttttgaatgcctgaatggcacaaaatttatggtgtcaattcatagtttcaaactgctaaaattacacaggcaacatagatttgttttagccaaaaaaggttcatattagctgtatggcactatcttcatttacttaaagaagtatgttttctaggattgcagggaaaaacattttaagttatctgttagcacaatttatttcatgttgcagttggcatttctaaccaaatgccacttgcagatacaatggttcgccaggcagcaatggccattaagtgcatgctacttatgtactataagaatagcagaggtcgtaactaccgtaagcaggtgacatttttttctaattgtcataaatttattttgtgattttatcatcatgtttatagcatcttgcctttagttgttggttctacctaacttctaatgataatcaatgcagtgattactatgctggttagagattgtagagatctagccaaactagtgaagtgatcgcagccatcaaaattcaaaagtaccaacacttagtatatgtgggtgcttttgtgacagcaccctttctcccacactgaattatctttatttccacatatccaatactgagtatatattgactagaaactaatcataataactgaatgctgaatgatattgtatttctatgctgggctatctttatttaataactgcatgtctatgactatacaattatttttatccccttaagttttgatctactgaattagtctgtgtagcagctcaatgcttagacatcttcaaatgtgtccactag
